United States Patent 10,724,096 (METHODS AND COMPOSITIONS FOR INHIBITING AND TREATING NEUROLOGICAL CONDITIONS) - sequence listing, part 18

SEQ ID NO: 147 - DNA, 260765 bp, Homo sapiens
tgactagcaaatggattcttatatactttgcaaaacatttcaaaatgtctcacggactcaactaagaaaaaaggagacaaaattatagacatagtcatttctttactttggacaattttgtcacctcattcagcccacaccaaatatacttccctagtcagtaaaaaggagcaagtgggaggccaaggtggagcttatctgagtcaggggctaccaatccctccatgagagctgaaaacaatccgaggtcaagagactcacagcccatgactatgctccgtagaggcagcttctcccagatggctgagggctgtctgtggctgtatctgttctcatacatgacaatgagggatagagcaggtctctatgaaatcctgagcaaggccatccttgttgtgcccctctgacctggacataggtggcactggattcacttagagaagtaaagtgacttgtaatcatgagaaaaacgaaaagaaagggagatggggagagagcctgtggtgtgtgtatgaacagaaagagttggtattttaatagtttaatacactgaatatggtccctaagatgccaggtcctcttccttggaacttgtgagtgtctttcttactatttagagcacatttgtagatgtaaattaaggatattgagatggagagattatctggattaaccaggtgggccctaagtgcaatcacaaatatccttataagagaagcagagacagatttaaccaaacagaagagaagacaatgtgaactcagagacagagactgaagggaggtggccacagccatggaaacctgcagccaccagaagctggaagaggcagggcagcctccccctagagcctctggaggagcctggcggctaacgcccaggtctcgatgcagtgaaactgattccaaacttctgccctccagaactaggaaagaatgcatttctgttgttttaagccaacaaattgttggccatttgttacagcagttctagcaaaataacacaaaatgtgctctggatttttccaaagtgcaatggttgtgtgcaatcttcttgttcaactttctaacgctatacgtaaatggattggtggaggattttatggtgaaaaaaatgcacatgaaacccataccgcatagtgaggcacctgtcgtagaataaataatgatgacttttagttgaaaatgacatctggcaagtaatatcttacacagcctcttaattctaggagattcagaggtgcataaaacagaacactgagtacttctcgctaaaaagaacagttacatttcatggcatatcatctggttaaaccctcaggacagcccttgatatctgtagtgctccatttcacagatgagaaaatctatcattagagggcatgggtggtttcaccaaagtcttatggtcagcaagtgctagagtgggatttgaatccaggtgtgtctgacatcaagtctgttctatccacagatggatcccacagcctgtaaaatgggagaagagacattttcacaggatgctgtgaaattcataggtccctgccgcctctgccccataccatgtgaaccctaacattaagctgagcctcttctgcagtttcttctataaaatgcaactttctccaagcttttacaactctgaacagctttatttcagacgtggaggcagaagcacatcttgccttgtcctgacccttcctcccctcttctactcatttccatctctgaccctgtccttccctctcagactgtgtcacagatctaatttgttctcctactatgaaaccccaacctctcagtagcagtgaaatctgacctctaggctctcacagatacccagaatgtacaaaagttaattgaaggacttacccaggaggttttctccctaagaggaattctggtgctagctctcctcatagtaaactatactctgtctcttgtccaaattgactccaaaggctgacaagctggaaagggttgggagatcagagagaaactatcccctcagaaagacaaatgccattctctccccatgtgtgagtttcctgtagctgctgtaaaaaaatcaccatatccttactggcttcaaatagcatgggcttattctcttatgattctggaagggagcaatctcacacaggtctctctgggataaaatcaagcttccctgtggacaccatggggaagagcttgtttccttgccttctccagcttttaaatgctgctgtctctccttcatcatggcctttccctcacatcactcagcctctccctccatagtcacatctccccaaatttgaccttcctccttccctcttatgaggacaataatgattacaaggagcccacgatatactccaagatagtctttctatcttaagatgcttcatcatatttgtcaagatccttttgccgtataaggcaaccttcactggttccagagattagcacatgtaaactttttaatggggatgggagaggcagagtgctttacagcctaccaatcccccttatcacccctcaactgtcctcccctaaggaagaatccagtgtcaggtggctgggagaaggagagatcagggagcagccaacagctttataaagtgagagctggagggatctgagtcagggccctctggtctgggggtttcctgggctgggggattcttcttctgctgctgctctaatgcagacatcagagtgtggggtatttgttagaggctcctctgattttgtgacccagaagaaaggaattggtacttaatcagaatctacgagagattggtagaggaaaattaaatgtttttttaaattttctgaagttctctactcactattgtaagagttaaagaaggaagaaagaaacacgaaaagtggctcaacagtgaaagacaggtttattttggagaataagcctgagaggggtgtctggtcgagttaggtcaggagcactctctcttacagactaagaatagttaagggttcagggcaggagagcttatcacaggcttggaatgtttctgtgtctctttgtcttgcctatctgggaggcagagtttttgtgtctgttcccatgcatcttcctgcagctgcgggcataccccccaagtctgcttttagcatccctttcttagtgtaccaaaagggaaaggaatgtgcttattagggcccaccattttactggggcccagtatatgaatgtgaagtttggtggttaccaagaaactttccctgctcctgtacccaagctgtcttatctgtgttttactgtcttggagtgagtttgcatgtctgatgacctgaaccagagaagtgatttccttgaaatgcatgaggttagaaagggagctggaactttagatggtggtgtttgtccaagatgacgatgcttctgctctgtcaattataaaaggagaagtggcaagaatttgacagcagacaccaccacaattgaggatttgcctatagtcttaggttaagtttctaacaacaaggattctcatggaagtaccttaattacaagcggcaggaaaccctgagacagaaggtggaacgtgagagagggaagagatgatggatggtgaaaggcccatcagcaagcagctacccatgaggaccactagagctcgagcccaaggggaaacacaagaaaacgtctctgggctattccacctgaaaggtgagggagctggggtatttatatacctcaccttttctcactgattgaggactgttctaggggatgctcatttcaggccctgaggtctgccacatgtgcaggcagagctgcttccccaactccagcgacagcagtgaggcacagacatggccatgaggggtcagcagaagtacagtgaaggggaaagcctgcgagtgaagacagactgcaccatccatgcagaaaaggtgtggatgtaaaatctggatcatccacttgtgttagctctctatggaataggaccttgactggtcagttataagcagatgccctagaagatcagacaagtcttccaggcagagcatcaacacccataaacctgggcttcccagacatgtctgaggaccacatgattggcaattataccttctgtggcagatgcattctggatttatgtggagatcaagagaatccttttttttctagtatttggatctttgcccccaagccttttaaaggctgtagtttagattctcattctctgtatttagaaaaaaaaaaatcctacttggaattccaagagtggcttctcctttgtgctattaattccaactcacacaataactcagactcaggtgtaatcatatcttttcctaataaaatcaggagaggcattgccatgtctgtgctgctgaggatgcggagaaggaaagactgttaaggtatagaggaagcttcatggctccttctgccaaaactttccagtgatgtccaaagcatggctgcaatttgaaaaatgctctctgcagatggaggcaccaggagaagcatccgtggcagcccaccctcatacatctgcttcccttgatggtttatgttatgacttgtaacactgtgggagttactgttgacagtagtaagttgcaacatcatcaggctgcaggctgctgatggttagagtgaaatctgtcccagattcactaccactgaacagagatggaacccccgtttgcaaactggataccctatatatcaggagcttaggagctttccctggtttctgctgataccaggctaactgattggtaaaactctgactcgcccggcaagtgatggtgacactgtctcctacagatgcagacagggaggatggaggctgggtcatctggatggcacatctggcacctgagattggaaacataaaaacaaatttccacacaatcaatcatgttgtaagaagcccttcctgaagacccagacagtactgagcacactggctgagtaaattcctagtgttctccttccttacctcagagccagagcagcaggagccccaggagctgagcggggaccctcatgtccatgctgtgtcctgactgggactgacttctgcacagagtgtgaccagtcaattaagaagtcttcagggcaggggcctgtgctgtaggacatgcaaatcagcaggggatggggcaggctgggcacagctgcagggctggctcatctcagtaactcagcacaggggaagtgtccccagggtcccaggtcagaccagggcagcccagatttgtctgtaatgaagctgttttttcctgaaggccattttgtaatgaagaaccttttcttgatacttgtcaaaatttgaaatactcctgattacttgagggagtaatgtattccattggtgtatggcaattacataggtgaatattcttccctttcagaaacacatagtaaagttttagaaggtgggatcatgaggtcttcaatatactctgaaagggagggggtgtaaaattgttccttcttaaaaaaaaaagaaaatttatcaagataatgctaaacatatttgaaaatgttttgtaatgaccttaagccattctcattattactataaggtcaagcaattcactgtaggtacacaaagattatattgtaagtcctcaaagtatgtttcactcacagatccaccataatgcaagtaagtagacctctttaatgctggggattttatgggttgcattttatttttggtgtggggacctccatattcaacccccttttctgtcatcgggtattatttcccaagattcctcaacatgaagggctgactagtgatgccagatctgattacttcaaaataagacacttaattcttctttcaattttaggagcctggattaggataaacttgaaattatccaaggatcaattatcttaaaagtatgaagaccaagatcatatcccctgggtaatgctctgagctgcactccccgccagcaggttccttggggctcaggtgcagcttctctggaacctgaattcctggagagcaggtgagggtgagaccttgggaaagaccaggacattgaagcctctctcttattgagggcaactgctacttggtgcatgtccctgccttgcacaatcaatgccattttcctcttttactctttagcagtaagtagggacatcaccgtaactcagatgccagcctcctgtctcatatccagaagagagaatgtccatctcctaagaagcaaatggccaagtacatgaagaaatcacttggatctggataaaactggacacagatttgtacacattatatcacatctccaatgtggtccagggcatctcagcctggttcagcagcagaggaagtggattcaactacatcagcatcagtgggctgcagcctgtggttctggggcgtattaatgatgcttgagttaagaatggccaaattactgtggtgtagcctgtgcacacaccctcatgctgcctattcataggcttgggttttaagggaaatatcttgtgtagagggaaaagtttcttttgccctctaaacgtttgctgaaaatatagaaaaaaagacaaattatactagaaacaggcaaatacatttattttgcatgcttggaaaaaaatcacagaagagggattacccagataactcagtgaggtctaggtgcttatatatccttcacaggggagagggaagtggggagtgtcggcaacctagggagagtaaatgactcaagaaaagaaatggatcctcaaaagaatacgtaaaaccctgcctggatgaagtcaacttcaaatttcttctggatttaatttctagtgcatgttaatattctctggtagaaaaacattcccagagagggttttaatgacaattggcttgtttctggaggatctgcctttaggaagataagggcgatttaggaaaagcccttttgtgcatttgctcttttctaaacaacttcagtttgaagtagtcgccctaccaatgtagcttatcttgagatgttacttcccagattccttcagttgcaactgacctgccaggaaacaccattctagagggatacagctccaggtggaaagtacaggtgcttttttctaaatggttggagcagtccctctctgcatcccatgcctttccctttcattgcgattctgctgattccccatggccatctctgcccctcactgctctctctgagaaaggcagctctgcctgcacgcatggcagaccacggggcttagaatgagccttcccttggatggtgccatgatttcactgtgtcccctcaagtctatctgctgttaacttaatccccaatgcaagagaattgagaggtggggtctaatgggaagtgttcaatcatgagggctctgcccttatgaatgtattaatgctactataaacagagcttgtgttatggatccacaaggtatttgactgactttgtgcagcaaaaccggttatccatactgagtttgcagcagaagacaggaaggcagggcagctagcaaagaggaccaggcatctaatgcttaagtcttgacctcccttatgccttacaggtaagggtttttaaaagcaggggtaaacttcagtaaatcagaagttatagacaaaattgtaaatcaataaatacatagatagaggtcatgtaagatattactagtcaggtgtcaatttcaaatcaaattcttcatcttggagtacttacccaaaaagctggtagagaccagattaccaggagaacctcagcccgatgacattgaagttagccaaatgtcaaaaatctgttaagatcctgattttagaattcaccagctcctcagaagtttggtgaaatatgagttattcagactacactcagatcaagttagcagctagtctggtgtgacaacctgtttttaatcaatgactcaaagctgtgatcaccctgatgtcaaatcaaattcttcaatatttattctacatctaacaagtacatcactaaagacagtgaggtttcatgcacgttgcttctgttaccagtgcatggtggccaggttcttggcattttgagcaaagaattggacaaaatgcacaaacaaagcaaggaagggatttattgaaaatgaaagtacactccacagtgtgggagagggcctgagtataggggctcaagggccccattacagaattttttggggtttaaataccctctagaggattccattggttacttggtatatgccccatgtaaatgaagaggagggagtaaagttacaaagtcatttacttggtgtaagccctatggagagaatatttcctatcatagctgaagtgtgaatcggccgtatgttccctgcctccagaccctattttcttgcctcatttccatcatagaaacttctacctatcttttgctgcatagcatgagaaagataagcaagatgacaattgactataacactcttgttctgggttgtcctggagccccatttgtgttattgtcaactcttggtatcctaagactatggccacaggtctgagttctaagttccttctcacacccacagcctttcccaggaatcactttggcttccttcgtgctgggacccaacctcttgccaccctccctggaatccagcactaactacttggaagcttttctaagaaccattattagttcattgattttcagtaggctggaatttcaatgctttccaggacaaaaaagagagtggtgattcatgtgtccctggggtcattaagatgttgtggaacttgtggttacccaagaacctcttacattggatgagatgggcttatatatgacatgtgaaaatgaacccatattattactaaatataatttgatgggactgcagaaaaaagttcatttgtggttaattagttgaaatgagattatgctttatagattatttagtaaatttttggtagagaaaatctcacatatacatatacatccacaaaccataacacatatattgtatgtacactcacaaatcatatatgaactatttaatgaattttcagcgtgaacacacctgaatgaccaccaaccataccatgaaacataacattggcagtccccaagtacccacctcccttcttatagtcctgggcagagagcccccaaatcacacaggtaccctgtgccctcctttgaaactgttccactctcaagaccctggcatgctgggcctatgatgggagtggcagcctggtaaattttcttcaggatcattcttacattgtcttcatgaatagcatctgcagttcttaaatccctatgattctctttatcaaatgttcacttggccacatccttgatgttctccctcagacaagctttttcattctttataatctggccaggctgagagattttcaaaactttaagttctgcttcccttttaattataaattgtgtctttaattcatctctttattctcaccttttattgtaagcagtcaagagaagccatgctgcttagagatttcttctgccaaacgtcccacttcatcactcttaggttctgccttccacaaaacactgggacacaaacacaattctgccaaattctttaccactttatgacaagaaatgtctttccactagtttccaatagcatgttcctcattcccctccattcctcaaaataatgtcctttattgtccatatttctgccaacattctcttcgcaaccattagacagtctctaaggagactgaggctttctctacagctctgctcttcctctaagccctcaccagagtcaccctttgtggtctgttcgtggcaatacaggctttgacagcgcacacttccaaactcttccagcctctacccatagccatttctacattaggggttgtgtaggggttgtgagagcagcaccccacttctcagtagcaattcctgtcttagccaattcttgctgctatagcaaaatacttagactgggtaatttacaaacaatagaattttatttctcatagttctggagatgagaagtccaagatcaaggtactggaatatttggtgtctggtgagggcctattcctcatagatgctcccttctctgcagcctcaggtggaagaaatgcaaaaaataatctagcaagctttcttgtgcacttttattagggcacttctctcattcacgaagcgagaccccctcatgaactaattatctcttgaaggcccaactcttaatattgctttaaggattaagtttcaacatgaaatttggaagaacacaaacattcaggtcataactactttctctgtaacataatttgcaattttctctgtacataatctttttatttatgaatcatgatagttttaattctttcttttcacttctcatttttttgtttttttgttgttgttgccttgttgcatgaagcatgagaagtatgtctttttaagcactcactcttatgagtctgatcaaatgttgttgacaataaaattggtctaaaagcctgctgtgcaactaagtctgagaaaaatttgggaattaaaataaaggaatcaaaattaagaaacattaaaataaaataagttcagagtaaattactcctcagaacttcaaagtttccaaataaaggcaaagatactacaactgaggggccactaaagcagctactcatgaaggaagcagcttgtttgagggaaaaaaaagtacctatggtgttttgaaaggttttgttttatgttgaataactgtgaaattccaactactatacagataagagtaatcaagtgcaaaatcttcaggttccaggttactgttggtgagagtaaagtacatcccagattcacagctactgagccccactgggatgtcagtggccctggtgaatgcaccatgcttgagcagctggggatcctgcccaggtttctgctggtcagtcagagcagccagtgctctgaatgatcctgcagatgagggaggctctttgccctggagacaaagacagagaggtgggagattggtcaacgtaatttctccagtattctgacattggaataaaacaaacaagtcacctatataagctgcatcaaacccagtgtcttcccagtacagccagaatcactgctacactgaattttaattaggatccttgctcagcagtggtgccaggtcagaggaacccacaaggttgagagagtttcactgatatgcagcaccatttccttctcccctcaccatgtccccctcatttgacacccagagtaacaagagacagagaggctgagctggggcttccgtggttccctatgggtcctaactgagcagctcttcccctgagctcttatccaggcattgataagggttctgatcagcagggcaaccgggagggacatgcaaagcagctggggcaggcactgggcttccagctgcagagaccacctgcctcctcctgtctgcactgagcagcccctgcccaggtggtcaggtcgggaaaggccattggctcagcctgagggtagagcttccctgtggctacagaatttaatccctgtcctcctgcctcaccagtcacctacactcagccagatggtgttttgcacaagcatgttgagcagaggtccccaatctttttggcaccagggatcagttttgtgaaagactatttttccacaaactggggggtggggatggtttccagatgattcaagtgcattacatttattgtgcactttatatatttatttatttatttatttatttattgcggcagagtctcgctctgtcgcccagactggagtgcagtggcgcgatctcggctcactgccagctccgcctcccgggttcacgccattctcctgcctcagcctcccgagtagctgagttcaggtcatcagacatgcaaatcgactccagggaaacctgtgcttattgggccccgcttctggagaaacccagacttgaatgaccagcccaaccacattctcctcgcccttagatccagaagcagcagttttcctggaccctccaagatgcgcttcctggccctgctcgtctgcctcctggtgctgggctttcaaggtgagtacatttcccactgcagaccatgcaggggccttaaccctggacacagcgataatgacctcagtgagttttggaaattacattgtgacgtggtgaggtgttttgcctaactctcagtaggaaactgaggcacaggtgtccagggctaaccaggaggcagaggtgtccacagccgtgaatctgttatcagccaccctgaggaccacagagtctctgtctataagattttaagacaaaaaaaatgtgtcttgccaccaaaaaaaggtctttttttttttaaaaagtgcttcttgttagaaacacgcatgggcaattctgaacaatatcagataaatatcagatgaaatacttcttcctactgaccatttccactgctcaccatcccccaatgtctctttatgtcactaaccgctttacctacatttagccattggtgctggtggttgcttggcacctgggtctccactctgtgacctctactaataggttagatgagtttacactccaagcgggaggtgaaagctgcaaggtctgagctcttgggcacagacttccttttaccacattctactggccaaaacaaggccagagcccagcctagatccaagacatggggaagtaggtcctccatgggagaaccatcagcaagccggagcctgaagatttggcactttatcactttatcagtatagcagtgtgtgtcccacaacgttcattcagcatgaaacaaaacctttccaaacaccataggtattttttttttcttttgatcaagccagctgctgcttttgtggacaactgctttggtgacccctgggtttttaacattattacctctctttgaaaatttggaagtcgtaaggagtaaattgccgcaaacattttattgtgattcttgattttttcctcagactcagctgcacagccaggtttcagaacaattttattgccaacaacatttgatcagactcacaggtgtggatgcttgaaaaatatacttctcatgcctcatgcaacaaggaaatatctcattctccccttataaatgagatgagcacccttatcaaagtgcacaaaaaagcctgctagattattttttacatttcttccatgtgaggatgcagagaagggagcatctacaaggaataggccctcaccagacaccaaatattctagtgccttgatattgaacttccatctccagacctatgagaaataaaattctaacgtttttaaatttcccagtctaagtattttgttatagcagcaagaatggactaagacaggaattgctactaagaagtgtggtgctgctgtcacaactcctaaaatgtggaagtggctatgggtagatgatggaagagtttggaagtgtgcgctggcaaagcctgtattgccacgaacagaccacaaagggtgactctggtgagggcttagaggaagagcagagctgtagagaaagcctcagtctccttagagactgtctaatggatgagaagagaatgttggcagaaatatggacaataaagggcattactttggggaatagaggtgaatgaggaacacgctactggaaagtaggggaaagacatttcttgtcataaagtggtaaagaacttggcagaattgtgtttgtgtcccagtgttttgtagaaggcagaacctaagagtgatgaaatggaatgtttggcagaataaatctctaagcaaagtgttgagggtgcaacacggcttctcttgactgcttaccataaaaggtgacaagagagatatgaattaaagaaaatcaaaaggaaagcagaacttaaagactggaaaatttctcagtctcgccagatcgtgaagaatgaaaaagcttttttgagggagtacaaccaaggatgtggccaagtgaacttttgatacagaaaatagtgggcatgtaaggatgccagatactattcatcaagacaatgaagaatgtccctgaaggcatttaggagatttatcaggctaccactcccatcacaggcctagcatgccagggtcttgagagtggaatggtttcaaaggagggcacagggcaccagtgtgaatttagggctctctggccaggactataagaagggagatgggtaattgtggactgccgatgttctgtttcatggtatgtttggtggtcacccatgtgtgttcagtctgaaaagtcattaagttgtgcacttatgacttgtaaatgtacatactatgaatatgttatgttttttatatgtgggatttaccctacaaaaatattaaataaattaatctataaaagcataatgtcatttcaactaatcaacttcaaatgaattttttaaagatctcatcaaattatatttcataatatcatagattcattttcacatgttaggtataagtccatctcaccacatataagaggttccacgtacaagtttcacaaagtctaaatgacctcagggacacatgaatcaccaccctgtctttctggtactgcaaaaaattgaaattcctatgtactgaaaatgaatcgtacttaacaatgattcttagtgcctctaaatttatgaaacaaattaggtaatattcacagaacaagaacaatttgcttcaaagtattttctacccccaagactgcactgaagcctctggcaattttactcattgaaaggtgaaactaaaacatagtctttttcctacttgctatatcattcatagaaatgagatgagtaaaattcaagtagatacgtgatgagagttgttcatcgtcattcaccttgaagaagagcctcacggagaattctggtgaccccatttaaagacaaacctgtcagtcactagttctaaagttggatcatatcaatatttgcaaaccttttctcagaacaatgggtcccaggcacacccaataaatagatcttttgcatacagtcttcatgtttcttgcccaacttctctttgctcttagaatcttacggttaaaatgagcctctttctggtgatataattgatacaccatatgtttcctcaatttaaattgaacaatttaattgtgttagtatattcacagagttatgcaataatcacattgtgaaaggaaaataaccatggggcccaaaaatcactaagctgaagggattagtcaagctgggaaattcttagggccaatctgcctcccattctattcaaatcatccctctgctcactgagattaattcatatcttattgcctctttggaagcgctaatcagaaattcaaaagaatgcaactgtttgtcttacctacctctgacctggaagccccttccctgcttgagttgtcccgcctttctggacggaaccaatatacatcttacatatattgactgacgtctcatgtctccctataatgtgtaaaaccaagctgtgcctcaactaccttgggtacatgtcattaggaccagaggttgtgtcacaggctcatttccttaaccttgggaaaaaaaaactttctaaattaactgagacttgtctcagatattcggggtttataacatgaatcacttacagaacgtttccatcagccttaagaaaccctgtgcctattagaagtcacttggattttgcccaactcctcaggcaaacaagagtctactttctacatttttaaaatttgcctcttgtggacatttctcataaatacattcagactacatgtagtcttttgtgactggcttagttcaccgaccaaaaggtatgccgagtatttctatgttgtcatgtctgtgagtacttaatttctttttatgacctaataatattctattgcatatacataccatattttgcttttccatgtatcagttaatggatatttggtttttttctagtttttgtctctttgagtatcactgctacgggcattcatacacttttttgtgtagacaaacgttttcatttgggggtgtataatcctataagtggaattgctggattatatggcaattgcatgttttaccatttgagaaactgccagaccgtttcccaaagtggccgtaacattagcctgtgtaataagaagaaagaatctcttagtgaatgagtattgagaacagctgaaatatttgagggtgtaaaaaataaatctgaggtagctcagagacgctcattcattactcttttaatttttcccgctcttcataaatgagggtctccaatttctgccttgtagatgccaactcactcccagagttattgagaggacggtacaggctgagaaccacacggggaagttgggtcacagaaggaggaatttgctcaagacacaagctaggaaaaacaaaacaaaattaaaatggggagctgaataaggaaaaatgagaacttcctgtgggaggaacaagaaattgagaaggaatgccttgtctttatgctgtgtgcctatctttaggtttctgggctcctaaacttctggacaagaacccccaatttgaagttactgggacactaatgtctactccttttactagttaactgtttcattggctgtcgaaactcctcacataaagtagaagaacctcaagaaggcagatttttttttatgcctggttgaataaatcccatgaatctcatataacaggaaaaaatattttattaataaacaaccactgtgagtgagttctaaccaaaacaaagggaaaatatacgaaggatcaaaatgcaaagaaaatacgttttgcacgcgcatctacagtcttaaagtaaacacaggaagttgccttcaggcctgtgtctctgtttcaggaaactcatcctcctgctgagaggaagacgttgcagcctcctcagcctccatggtgttgatggtgacagtgaaatgagttccagatccagggagatggaaccaggttgggaccccaagaccagggtggaagcccttaacatccttaccatgtcttgtgagatatttatttactgcccttcacaaattgagtttaaaatatttgcattttattttccgccaactgttctgctgtcagacagcattttttatcatgggggagagagagcaattagtccctcctgaacatctggtcagtggttagtctgatgagaggagttttgttaagagaatattagtgcttcagttgtcctgatttaacatggattctcttcccttggggagtgaatacaggttttactcaggccttcacaacagtgtggaatccagaagtgttggtattaatgccactgtggtgttttttatgattttgttttcacactttgtgtttttgttttactcatattttaatatagtttattttatttgtcttaaattttcctttaaagataatcacgaagaaaatgatatatgcatactttaattttattaagcctacatgaatctacaattctgtatttccaaagtcaagaaaaaattggtgattaattttcaccatatacttaattagcgtaacagcaaaactgctccttttattgtcttcaccctgactctgctttatgtttttgcataaggaatgttatcattcttatttagattttttagattataattatgtggtatcatattacataccttatatttcaagaattattcctatacagtgacttgcatttgtaagtgaattttcaactgacttagattcttggtttaatcatttctactaatcaagcaagattccttccagcaagattgttttgttttgttttgtttgttacatttcctggtttgttataaagcatgcaactcaggaagtgcctaactgaagagatgcatatggcaagatgacggggtaggttgagacggggtgagatggtgcaaagcttccatgtcctctctaggcagccacctgccagcacttcaatgtgtttaccaaacccaaaggttttactaacagccttttatttttatttttttatttattatttttatttttattcttgagatggagtcttgctctgtctcccaggctggagcacagtggcaccatcttggctcactgcaaccttgacctcctgggttcaaacgattctcctgcctcagcctcctaagtagctgggactacaggcacccaccaccaagaccggctaatttttgtatttttagtagagacgggatttcaccatgttggccaggctggtctcaaactcctggcctcaagtgatgcacctgccttggcctcccaaagtgctgggattacaggtgtgagccactgctcccagccaccaacagccttttaaaatcacaaggcacagcttcctttactggagcatgctgcttaaactcttgatgaatcaaaataaatctttcaagattttctatttttttacatggtcatgaaatttatgttggtgtgtattttcaaaattgcacatttccttcatatttgatcatttccttagttcgcaagcatgggcataatgactttttgtggttatgtagctatcactacattgttctctgggaacagagtttgtaaactacattgctgaagcaagcctgatttttatctctgaagaaagaacctcccttagattttggttttttattggatcctgattttttaacatgtaaaaatcacctgtgtgtttgctacctaattttgcctagatttccgagtctgttaaatttgcactcatgaatatataacagaggcataaatattttaaattatgtttctctttatcacccctgttctaatgactagtatatagggaaatatttccttattgggcttgactttcaatcctgtttttctgtctgtttcactctttcttttctttatttaatctcatatacctctacttcatgaactgagactgttcttccaacttttatattacttatttgctcattggcagggccagttctggttgctatggtcccgccccttagttgcttttttaaacaagtacatttagatttttattttctcatgtatcagcagtgttgatagattaccttttcactcgttacatctgagtgaaatgagtatgaagaaatatgttcgttccattttcatccgggtcctgatattttttcttcattctattgattacataaaatattttgtagaaattttctttgaaaattggcagggtatttaattttgtttttttctctctaatcttttaaaaatcaagcaattacatttgtttatttcaattaataatactcaacaatgataatctgttaattataacgtcttgatcatgacgcagtttcatctatggctatttgttgtttatttattcgaaactcagtcattcatttggtgattagtagcaatgtgataagctcctgtgactctaactcacaaaatgcaagttggggcaataacttatatctcatttgaggttatccacaatcgcacattcctatctcctaatgcagtttatttcttttatatgtatgtatcaaataacattttgtcatttatttctttaaagctacaaaaatatgttaatgcaaactaatttattagtcttttctttcatgcttagtgctttgcatattctcttcaagaaatctttcctacatgcatattcatgaaatatctttttatactattttctaaaagctttcttcttttgcctttcacatttcagtttctaatttagagttgatatttgtatcagtgtagaagtaaaatgaagaggttaagatttattttgatgtaatatggatatctaattgatccaatataattcagttattagaatttttttctactacatcactgctatggcctgaatgtctgcgtcacctccaaagttcctgttaaaactgaatctcaaggcaacagtattagaaagtagaccctttgggaggtgattaggtcatgagggctcagcactggtgagtgagattcctgtctaataaggtggctttacacagacttgccacttttgcctttccacctccaacatgtgacaacacagccacagggtgcaatcttggaagcaggaacagtcctcaccagacactgagattgccagcatgttgaccttggaattcacagcctttataaccatgaaaaaaataaatttatgttgtttgtaattatccaatctaaagtgtttatttttttttgtacaaatggtttgagacaattgctgtagcacttttattgtaaattgagtgactatatatacatgcagatctggttttagattctctgactcattgcacagggttatctgtctcagccttcaccgataccatactgttttcattcctgttgcttaatataagcttcaatactgggaagtgttaatcttccaatcttgttcttattatgtaagattaccatggttgtttttttgttttttttttgttgttgttgttgttttctgcctcttcgaatgcccatctaagttagaaacagcttttaaatttcaacaaaattcacaggattttgattgtcacagtattcaattaatttggagagagttattatattgacaatattaagtttcctaatacaagaacatggtaaaacctttcgcttattgagtctccttgattctctctcagtaaccttttgtacatttgcacatactctttataactttttattttaccataatatcaaacagtgacaagttggaaaaacactgtaagaaatataaattggacccagattcatctactatcaatagttgactttctacttccatattccttctgtaagttggtattctgggtactattaatacacacgaaacaaactacccaccaacttaataacacatgaaaactgcaatcaactgcctatcatctctatggttctggatgtttcctgggctccacaaggttcctgccaggctttcctaaggatgcagtcagtgagtggctagggtaggcgtcatctcaaaggtggatgacattagacgtaaggttctcagctggagttgtttgccaattcatgtggctgcttggtttacttgaaacttccagaggaggagcaggcagaagttatgcagcctcgatgacctcttatagcctcagaagacaaacagcattgcttctacacagttgcatgcctaccaaaattcaacagaaggaagcataaggcagtaggttcaatgggaggagagtcaagatcaccctgttagaaaaaaatgtaggataggagatcttgtcacagccttgttggagaatacaacaggcatcagtccaccctgtgaccaaagcaattcacgttcctcccacatgctgaacactctaattcttacctcaacatgcccaagtattattccatgatagtgttaccgcatcatcaaaatgatgtcctaggggagtgatatcagcaagatgactgactaggagacaccagccttcgcctgcctaccccaaaaaatacaaacacaaaaacaaaagcaagaccaacaatgggacagctatccaagatggaaaatagcccttggagtgttcaagagcccagttaagaatgtgcaggaacacaattagaaaaaacgcccagaataaccatacagaaagcatcgccagaagacggcatgcctgagagtcctgagacctctaaaatgaaagaagcaggaggcaattgttatcagccaggaggcagggtcactgcactccccatggcctgctctgtggaggacgctgcagcctttgcagctaatgacctaagtaaacccccaggcagccccgaccctacaacattcccagtggatgcccattaggattcattgttgaggattacagcagcctgctccagaggacactggtgcttttggcattaaggtaacctgcagctataatcatatcaccccagagaggaagatgctgtgaaaccctcctcccacactctctcaagaagcagccccttctgtgctgcctaggatggggcttcattgccctaaacccaggctccagggcctcatccgtggctggcaactcagacaccgagccacctccatgtggaccagcccaggcccatgcccagatttgctgacactccaactgcactgtcactccaagtgcaccagcagcctggccctgtggctgctgtggaaattgcctaagacataaaacaatatacagccacacagtggagtgaaatgcagagaaaaaccacacagaaatgatcactgggagatggcatacttgagagtgctgagaaataatggcaaatacatcaagagtaataaaagacgttggtctataagatcaagacaaaaatcactgaaaaaataatgaaacttattcaggataaatgccatgcattatcctaaatggtagtgtaaccattcaggataaactacaactatacatattatataactatacatattatataattattatattatttaacagatagtgtaaccactcaggataaactacaactatacatattatagttaaaacgctgaaccagacaaagagaaaatctcaattgtatcaagaaaaaacgggctcattttaccagaaaaacaataatagaataattggctaactgttcacaagactgatagaggctagaagacagcgggattacatatttaaatgccaggttcgggggactcagcaaagggttcaatatccagttaaaacatgtttcaaaaataaaggtaaagtaaaaacatttctttattaaaaaatgaagagaaatgattacttgcagagatgtgctctataaaaaattcaagaggaaattcttcaaaaatcacaggaaatcacagcagatcgtagcttgaacgcacagcgagaaaagaagacttcaaaaataataaagaaacaagaaagaagcaagagacagccaaacaaacgtgttcacttctatttatatgagattgtagcacagggaaaaccaaattattataatgaatatctgaataccagttaccttgattgggatgggggagcagttgatgcctgggaaggtgcacaagggatgaatctggagaatttgaaatattctagagattcatctggatggcgaacatacgtaaaacttagttgcatatttaacatttccatcctttgtgagtgttttatatcaattaaaaagtgtaagaagccaatcctgcaccctgaatccaatatgaatttaaaaataagaatcatcatatgtttacggaatcttaaccttgctaaggagaagtgagaaatgcacctgggaaattctaagtaacgagaaatctaagagagaagacaaagagaaaagggaatttatcctactcatgcagcacagattttatctctattggtttctctctaaacagagacaatatttaagtcattttgccctcaagagaggctcccaccatccccttggctctttccaccccactgcacccatcaggggatttgcatattgtcccctagggaggaccttccattgtgagtctgagataaaagctcagctctaaccttgccttgactgatcaggactcctcagggcaccttctcacgatgaggctccctgctcagctcctggggctgctaatgctccgggtccccggtaaggacagcagggagatgagggaggagaatggggtgggagggtgagctctgggggcccaatgtctcccatgtgtgttcagtccacgtgttagatatgcaggtctttttctgcagcatgaggcatatgatgtactgatctctgagagggaggaagattttagaaggaaggatatgtgccctgaagaaacacaagtcttagaaagaggatgatggtatgggagaccactttgtgccttgcatctgttgagttctttttgaaattggatattcctgaaattgcaaagaaattatacaggctgaaataataaatggaaaattatgaacatgatgcacaatatttgtacataactttgcccttttctgtcatcattccaggatctagtggggacattctgttgacccagactccactctccctgtccatcacccccggagagccggcctccatctcctgcaggtctagtcgcagcctcctgcatagtaatggaaacacctatttacattggtagctgcagaagccaggccagcctccacagtgtctaatctgcaaggtttctaaccggttttctggggtcccagacaggttcagtggcagtgggtcgggcattgatttcacactgaaaatcagcccggtggaggctgcggatgttggggtttatattactgcatgcaagctacacactggtcccccacagtgctacatcctggaacagaaacctctctgctgggattgcccagctgcccacatgtgctgcttgtctggggagcagctcagcagggtctctgagtctgcaaaaggggaggctgttggagaactcaggggcaggtttgctgttgaggactctgggccatgaatcctcagctgtacctcaagcactacctgtttgtttacttctttatgttttcaagacagggtctcactctgttacccagcatgaagtgcagcggtgtgattatggctcattgcaaccgtgaaatcccaagctcaagtgattttcctaccacagcctacggagtagctggaatcacagggggcatgccaccaagcctgattaatttttgtatatagttttggtagtcacggggtttcgccatgttgtccaggctgctcttgagatcctgggctcaagtcatccacccaattcggcctcccaaagtgctgagattagaggcatgagccatcgggcccaattcccgctcttgctgatgtacctgtcacctgacacagccttgacagtcataagtaacaggggtatgaggaggttctagggccctgtgagttaaaaatcaggatgaaagggaaaggagaatggaagctcatcttcatcctccctccttgcctacagttgtttattaaatttattcagcaaaacagccagacaattgatcatttctggcaagacacactgaatacatcttagggtttaacagtttgggatagatagatagatagatagatagatagatagatagatagatagatagatatagatagagatatagatataaatatagacatagacatagatatggattgatatagattttttttgagacagagtctccctctatcgcccaggctggagtgcagtggagcaatgatcgcagctcactgcaacctctgcctcccagtttcaagcgattctcctgcctcatctctcaagtagctgagattacaggctctcgccaacatgcccagctaatttttgtattattagtagagacggggtttcaccatgttggccaggctggtctccaactcctgacctcaagtgatccactgggcttagcctaccagagtgctggcattacggcatgagccagcgcacccggccatattttcaagaaaatatttggttatatttaaaattggcattttcctagtttgttttaacttccgcttcttctatttagcactcattgcccactccgtaagacaggagagacagcattctccactagttctcctcagagggagctggctgaggacagtcagtgaaatcttggtagtgagcgtcaaatagattttgtaatttcatagcagatacaagatactaatactgaacctttttttaattacaattatctctcactgatagaaaaatggagttcttgaaactccaaaagctggttttagaaataaaaagcaaatcctggaagatgtagtatactaaagatgtagtattttccatggatcactgggaaaataaaggatgatggaaacttttttatttcccaaagttcagaattcaagattggacagactgcaggaataggggccttaggggtacaggagaggtcggctattgttcaattaaactgcccttggtttacggtgggtgggatgtggatggtggtggtgatggcagttgatgtggacccacaaaggagccaaatatgtttcttgcgaagaatcacagagttgaaggcactgctgcgtggcttcctgggcggagcctgtgccactgggagtctcacaggaaagtaatgtcgtgagtagggctttaggtgtgtaatcaccaaagggttagtgaagtccctgtacaaggagacctgaggtcatgtcactcagtcttagtgaaatcacagcagccaagcagagcttctgaaacttattctatccttagaggaggtctagcagagaccaccgtctgggtctgggagatgtcagaagcactgacatgctgagcagaaggcccagcaagacgtaatccagcaggttttgataaatgacaattttgatattaagttgtcataaaaaacaataaaaggttttgaaataagtaaatgtattatttttacacaatgtggtcattgcctaaaaataaatctgatttccatattctaacagtaatggtatagaaaaatgtatgatttgcatatagtcacttaaaataatgctccaaaaatatttatgaattattcaagagcatgtctgttactgccgtgaggtgatatgattaaagtaatgttcgtatcaaaaggacaaaatatctttttttctggttaaaaaaatgaatcacatcagaaattattgtctattctaagatgatggatcccattgtgaatgaatttaaaattgtatttccaagcagaaatgtcaaaaaaaaaggaaatcatgaaatatagcaagtaatttgtcacacgtacaaagaatgacaagtctttagagtagttttccattcatgagtgagaacacacatccaacccaaaatctactggtctcactcccataatcactagtgtggagactaaaggtagtgcaatttaaattacattcctaaccaaaaaaaggttcaaaaacaaagaaaggatgcttcatagaaaatatcttgcaaaacaaagaatgacatgtctgtagaaggtattcacaagcagggactcacatctaaccaaaattctagggatttcaccatcacaaacactactttggagcctggagatgctgcacatcctcctgtgagcagaacactcactgggaccctgcacagtgtgatggccccaaacataaagctctcaaggaagctccgcctctcagcgtggaaggagaggctgcggtgccaggggatgtgtccacagagagtcgagtcaggtgggctcaggcagttgcctggagagtctttgaggaagaggacatgaggcctcagtcacaggtacatgctcctcttctgtgtgaacaggggccaggtctctccagggcaccttccagagcctcttccttcctaactccttggggtgctcaagccctacagaccctccagtgttggctgccacatcctcactggaccagccgctaaggtttcctgctgtcgtcatggctgcagggatgctcagtcacatcactgggaggagaccctagtgtgtcccatcctcaactgctacaggcatacttgacttgaactatgtttgttttgctccattgaacattttatgtcacattgttcacagtagagacataccccctccaccactgaccctttccacactgctgcacccaccaggtgatttgcatattgcaccctaggggaggaccttcccttgtgagtctgaggtaaaagctcagctctaaccttgcctcgacagatcaggactcctcagtccatctcacaatgaggctccctgctcagctcctggggcggctaatgctcaagatagaaaaaatatgaggtgggaaaatggggttggaaggtgagttctgggagctccatagcttcccatatttatttcaaccatgtgttagaggcacatggtctatgctccaggaaagagaattcatatttttgtcttaagaataatcaggattcacctccaaggaacaatgacctctgattaagatcttgaaaataaagagttccctgctggctggtaaataatgggttcattttagaaagtctactttccatgatataaatcaaaacttgaaaatatatgtaactgtaaatcagtatcatagagaaatcatgaaagctgctcataatgtgtctatacaaacttgcacttctctgttattatttcaggatccagtggtgatactgtgatggcccagactccactctcctggcctgtcgcctctagagagccacccccatatcctgtaggtctagtcagagcctcttgtccagtgatggatacacctattcgtattggttcctgcagaagccaggccagtctccacagctcctgatctattttgtttcaaaccgggcctctggagtcccagacaggttcaatggcagtgggtcaggcactgatttcacactgaaaatcagccgggtggagctgaagatgttggggtttattactgcatgcaggctctgcagcttcctcccacagtggtacagccccatagagaaacctcccttctggggtgtcccagctgctcacatgcactgcttgtctggggagcagctcagcagggtctctcagtctgcagaagaggaggctgttggagaattcaggacagagtttgctgctgaggactctggcccatgaaagcctcagctgcacctcagtcccacatgttaaggctccatcagctgccacatgtagccacctgctctgggaacagccagctctgatgaaggaagagtgaatgaagctcatcttcaccctccttgtctggcccacatttgttgagtccatttatttgcagaacaatcagatcatggatgcagattagtggtaacagaagtgaaaaacatgttgcaaacgactggtctggggatagttttatacatggtaacagttgttcatgttgagaaattgctatcttcccactttccaaactttctctctcctttaccactcacacgaacctgccctccctagtactatggtggagaaagcattctgcaccagctattttcacgggagtatggctaagaataattagttataatgtctgattgttttttactacttatagatttttaaaatccaggggaaatataaatcctaatcccgaaatagtttgatttacctcaattaccttttgctgactgaaaatggagttcttacaattccaaaagtgggatttgaaaataaacaaaataactcaggaggaaaacataaagtttatataacatatcacaggaacaatgcagaattgcatgagatttttattttcttctcaaattcttagaattttaaaagtattttactgacatagtactttagagaggaaatatctagtactatgttgtcataagaaaatcattcgaagaatgaataaatgcattatttttacatgaccctatttttttcctgaaaataaatctgaatcgtctattttagttgtaaatgcatagaaaaattatgcccttaatagattctattaactcgtcatttagcattaggtatgtctcctaatgccatccttcatccctccccccaccccacaacagtccccggagtgtgatgtgccccaccctgtgtccatgtgttctcattgttcaattcccacctatgagtgagagcatgcggtgtttggttttttgtccttgccagagtttgctgagaatgatggtttccagcttcatccatgtccctacaaaggacatgaactcttcattttttatggctgcatagtattccatggtgtatatgtgccacattttctttatccagtctatctttgttggacatttgggttggttccaagtctttgctattgtgaatagcgccgtaataaacatacgtgtgcatgtgtcttaatgggtgcagcacaccaacatggcacatgtatacatatgtaacaaacctgcacattgtacacatgtaccctaaaacttaaagtataataataataaaattaaaattaaaataataaataaataaatagattctattgacaataatgttctaaatttatatgctttcttaatatgagggctgcggtctgatacatatctgtatacattttgccatggaacttttaaacctaacaaatgctttccgttaaaaaagcaatagtgctttcttcaccataatactagagagggcagtttcgtgtgagtggtaaaggagcaagtttggaaagtgggaagacagcaatttcccaatatgaccacctgttaccatgtataaaactatccccaaaccagtcgtttctaacatgtatttcacttgtgttaccacttgcctgcttccgtgatctgattgttctgccaaataaatttacatgaacccgagtaatgagtgatgtcttttacatgtgaaaacactgtgtagagacacaaaaggctcattgaatctgatgcaggctaacagcttaaattatacttgagatgatttatgtcaagataacggattccacaggaagtgcaattaaaattcccatgtgtcatttctgttgggttgaaaagttgcatggcaaaatgtatatagatgtttagtagaccatagccctcaaattaagaaacataagcacttaatatgttattcaaaaatactaattaatgtttctttgagcctaaatgttattacagaacgcagtaaaagaaaataagatgtaagtagcaacagcaggagatacagcaattccgttgtcacgttagccctcctgtgattgacagcacctagtcaccttgagtttctgcttttctgtgagacagaagataaaatcaaaacccattcaaggcggttagatatattcttaggaaaagcaaacaaatgtacaacctacctgatgctgatatcccaaaggtctatattctcaagtcaaaatggtgaaaagtaaatgattccaaatctgaaaggagagagacacaaggagaatcagagcataattaaatttattacaaagaaacctcaaaatatggtggactaaatgtgacaaggtttctgtgtctgtgccatggcagtgcagaggcaggcacgtggccttggtggtgtgggtggctctgctccatgaggtcactcaggtggacaggaggcacgaccaccctgagagcacagccttcctccttcctcacagtcactgcccccatggtcatcctcaacagcatgaggtggaactgaatggagagaaagctgttttcttctaaggatcaaaaataaatacagaaacaaataaaacctctagctttccatcagggacaaatgtacttttgactcagtcacagatttgagaaattttccattgagcgggtctgctggtaaacccacgttcattgtttgtttgttttaatctgaaaatgtgtttacatgattcttgaagatattctttgacaagaaacttccatatgtggtagcctatttgaagttgtcatttactatttcatcattgctgctaaaaagtcatttgttaaaaaatccgtgactctaactgttcttgtttgaaaggaatacgtctttttaagatactcagattccttttaagctcttcatctggccctccttttttctgattcaatgtattgtttaattttttacttatgactaattaatcaattaattttcacaatcacagaatcaaatgtccgataagttgctatgtcaaagacctgtctgaagatggcaaaaacactccacaataaacaaaagacaacaccatggtctcaggaacactgggaaagtaggagtgctggtgtcccattctcaacagggagcccgaaaggtagaggcgggtctttcttgtgacctgggcaccggggaggagccacccatgtgctgagttgtgggaacctgccccattctctgagactggaagcaaggccccggctgtgtcccacctgctatggactgaattgtgccctcagattcatgttgaaaccctaatttcaatatgactgtagaaattaggacctctaaagatgtaattgaggtcataaggggggtccctgatccagtagaattcgtgttttgttgtttttgctttgttttgtttgtttgcttgtttgtttttgaggcagagtctcgctctgtcgcccaggctggagtgcagtggcgccatctcagctcactgcaagctccgtctcccgggttcacaccattctcctgcctcagcctcccgagtagctgggattacaggtgcccgccaccactcccggctaattttttgtatttttagtggaggcggggtttcaccgcgttagccaggatggtctcgatctcctgacctcatgatctgcccgcctcggcctcccaaagtgctgcgattacaggcgtgagccactgcgcctggcaaattcgtgtttttataagattcagagagctctcctttctcccttctctctctaattgccttccgctctatggaaaggctgtgtgaagacaccgtgagaaggtggcatctgcaaaccaggaagaaggtctttaccagaaagcaaaccctgctggacatcgatctgggctattccaggcaccagaaatatgaaaattaaattctgtggtttctgccatccaatccagtttttttggtgtggcaatgcaagctgactcatccacttttcccactctctctgagcaggatcagcctcaggagaccctcgtggacgtggggacctggtgttgctcctcttcctcctgcttttccaattctctggtgaagagggagaactcgggcttcaccttcagtttcagttctgtgtattaaacatgaatttaatgcagtttctttgcattaaacatccttcaagatgaagtctgtcgcccattttgcttgttcatcagaattcagtcaaactgaatgaagtagttatttagaattaacacttggggatgttcataattgttccccacttatgtgacagttgggatattgtgcggtgctcatctccaggcccctccctgtgttccaggagacagggtcactgtcaccagcagagccagtcacggaaataacagtgtcctagcctagctccacaggaaataagggctgacgctgatctcctgctggctcccactgccccctggacacgatgcccgcctgggtcaagggggtgagtctggacagacgtcactctggccatcaacagcctaactaccttcatgacctcccattgtgaacagagtcccagaagttgcttgagccatgaaagttggacagagaaatcccacatcactgcagtcagaggggggctgtgaaaagaccgtggggggggggtttcatactatgatcatgcagcactgagccatggctgccactctgtctgacgggagcccccgggggaagatccactcacactgtgctctagaggtcgtttttgtcaccatcttggttctagctggtttgggccagtttctgtagcgcatcctcttttgtcgagatcctgttccagtcagcgttgtcatgaccaatgttgggatcggtgctcagaacacaagtcctgatgatctcctaccttacactcgctgccttctgtgaatcagatattctgataaggatcctgttggatcctactcgaatcaggggccacacagaccctcactgagggctgaggaccacaggcatctgaagataagcagaggtccagagaatgatagcccctgactgtcctctgtgaagacagcttctccccagatggctgaggactatctttggctgtgtccttctttctgagtgataatgagggatagagcaggtctctaagccaaaccacaacatttcagggacaatgatacctatgcaggccctcctatgtgtgctgctctaacctagacataggtggcactggatacgcttagggaagtgaggagatttataatcagaaggaagaaagagggaacgagaggaggagagagagagagaagagcgtgtgatgtgtgtatagtaccaacactgaagagtcattctataatggtttagtgctgagtatggtgctcaaatgatcaggctgtattccatggaaactatacaggtacctttcacaggaaaagagcctttgcacatgaaattaaggattataaaacaggcagattatcctgtattgaccaggtgggccctaaaggggcctgtctttgttaaatgtcatttttaaaaatcctgcagaagagaaggccatctgaagacagcaacagagattgaaatgatttggactcaagccaatgaaagcttaaaccaacaaaagctaagagaagtaaaaaaaaatagacttgcccctggagaccctggagcagctttgtctgatgacagcctgctcctggctgctgaaactgatgctggacttctggcctccagaactataagagaatatatttctatttctttaagctaccaaagttttggtaatttgttatagcagcccaaaaatactaatacaaatggggcttagaataaatccagcctaaaggtagtataatgattgggaatctccacgttcgattctctaatgttacacatattagaagattttatgaggaaatagcgtacaggaaaccccacggtgtatactggagcatctgttaattatataataaatgttgataattcttagtagagcatgacatctgggtagtaatatcttatctagaatcttcattctaagatattcaaggatgcagaaaaggggccctaagtagtcttttcatacatatatatgcatagatacatttcctggtgcatcaactagagaaaccttcaggacagcccttgatatccttggtgctacttttcacaggtgagtaaactgttcatcagagcacaggggtggtttgcccaaagatacatggccagcaattatcagggctgagcttggaacccagcttaaatatgtcgcttccacatggccacatttgttccatggaggaatgaatggcttttaaactcagagaagagacaaagccggaagggtggtgtggaattctcagcaagcgccttgctacctctgaaccttgccatgattaccacaattataaactcaggcctttctgcagttttgtccacatagcaaaacttcctccaagtctttaaaatttaaatgtctttctttcagatttgagggcaggagcacatctcgcattgccctgaacactttgcttcttttctaccatcctcatctccctgagccggctcttccctctcaaaatgtgtcctatcaatctgatttcttctcctaatgtgaaaacaaatgaacaaatagccccctacttttgtcatctccagagaacacaagagctaatcacatacccagagagtatgagagtttaaaggatttatccaagagcttttacacataagaagtattctgctgctagccctcttcacagtgaaatgcctgtgtgtcttgttaaaactgacactaaaaaatgacaagatagagccattttgaagaacggagggtgaccattccaagataattcaggtgtttcctaaattttctaaatatccctatgcgttaaaaaaaagatttgacaagaattcagaccataccgtccaagaaagaatgtttttctgctttcttaggttggctctttcagggataatgatgcctatgcaggcagcatgtttataatgcacaggaaacacggggaggaaacaaggcagtgaaggaggaaagaaaggagggactccaaaagtctcctcagcaaagagctaccgctgaggatggctggagctcaagcccacgtggaaacaggggaaaatgtctcagtattattccagctgagaagagagggagctggggtatatacacctctcctgtcctcactgattgagggctttctgagaggatgctcattccaggtgctgtgaaaggccatgtgtgcaggcagggctgccttctccagtttgacatagagcagtgaggaacagatatggccatggggagtcagcagaagtacagcaaaggggaaaggcaaagggtagcaagagtgactgctacattcacctccccgcacaaaaaaaatgtgtgtatttcaatccagagcttcttctctctgaacctaaatcttagcaagcagtttgccagtaatttcccttgaaattcaggcccctggaaagcagcaggagatctgggtacaggctataccactgtggtctgctcactcttagtgatgcgtgagtaatgctccctggactccccaggttctagtcttctcatgtcgatgtagttgattccacttcccttgctgcacaaccaggctgggatgcctgggcagaggcagacatgtgaggtataggggttcaaatctgtttccaagttttatccagatcccaagtatttcttcacgtacatgggcggtggcttggcaggagatgcagattctctctcctggaagtgaggcaaggaggctggcgtctgggtaaggatgatgtccccacatactgctaaagagtcaaagaggaaagtggcatcgatggtgcagggcagagacatgcactgagtagctgctgccctcactgaagagaaagtgttcactgacttggcctttccccagggcctctccctcccctgctttccagaaagcccagttttttgggagctgtacctgaacacctgggaacattccggtgggaaaggcagctcagagcattagcaatggtaagttaccttgttcttcttcctgtggagacaattgatcatatgggtcagcaagacggaggtgctgtccatttagtccctggttattacagagacctatagctctggattatggaagatctgtgagtggcacaggcattgaggaatcacagcatcattattgtgcatctgcagggaatggcttgaaaatagactggtaataacaaatgtttcaggtcactacaaaatacctttgaatatttaaatatgcttctgacaaagacttttttcccacatgaaacaatgggagcaacgtgacaatcacagaggtgttgttagtataacaaagggattgtcactcccacaatgtccacttaaataacttgaagacctgatagccccattctctaagacattatcagacattccctacaaatggtcatactctcctatatactcccgatacaactctaaaatatatgactccatgtagtccctaggtttgaattaaattttgacttttttctcccaaaatatctcttgtcgaaacaacggatgtagagagaaatacattccctccaggcaaatctgtcaggcctggtctgacctgggaccctgcggacactgcccctttgctgagttaccgagatgagccagccccgtggctgtgcccagcctgccccatcccctgctgatttgtgtgtcctagagcgcagccccctgccctgaagacttcttaataggctggtcacaccctgtgcaggagtcagttgcagtcaggacacagcatgaacatgaggatccccgctcagctcctggccttcctgctgctctgtctcccaggtaaagaaggagaacactgggaagttagccacccagtgtgctcagtacagcctggctcttcagggaaatcctcgcataacatggtgaaaagtgtaaatatttgtttttgtatttccaacctgagatgccagatgtgacatccagatgactcagcctccatcctccctgtctgcatctgtaggagacagagccaccgtctcttgccaggctagtcaaagcatttacaactatttaaattggtatcagcagaaaccagggaaagcacctaagttcctgacctatagggcatccagtttgcagagggcgatgccatctcagttcagtggcagcggatatggaagagatttcactctcaccgtcagcagcctgcagcctgaagattttgcaacttattaatgtcaacaagagagcattttccctcccccagtgtgacaagtcataacatcaactgctaggatagcagatgagtgaggccgggttgccctagatgcccctcctagtgcctcaatctgctgagttgttttccagatgcagccaagttttgaaggtcgtctggaaattttggtaaattgtgatgaggtggctcctttgcacccactctctttcctcctcatccccagaagcaaagacatgaaatgcgagtcctgatttaataaagagatttaaccacctgaggagtctgttatgggatgattggaattcttgtagcaaaagagaagccactctagcccttccaagcaggaatcgttttaatttatgaaatcagtgtctaaactacagcttttcaaggcctggttgatgttagtcacggaagcagatactagagacatgattctctggtgctcctgcagaaaccagggtgcaccctaccctgcaggtgtgagctgcctagccacatggtccttggatctgtctgagaagcccagagtgcaggtgctgatgctctcagcctcctgcagtatgtctctaggtgattctctaggtctcaactaagtccacttgtctgtctgcaggtgtcaatgagcattgaatcattctcttctgacttccaaatctcgtggaaggacccctcagtgaacaactctacaggaaagtatagagggaaaggtggttctgaagaatgcgctttcagaagtgatggtgataatgaggaactgacagctgaaagcccaacatggtcagtattttcacaaaatagtgaaaacttttgccagttatgcatggcctcagaatacatttgaatatacttgcacttgtcacatagcaacataactttattaagtcatagacacagcttaaaaatcaggaaattgtatgacatacataacaatcattttacaaacaaatgaaaaatatttcttaacaaagaaaccaaaacaacagaaaaacctgaacattggtgtaaccttttttaaattatgaaaattctttgctactcaacatgtatccagaatccagcaggatcattagcacactgagagcatgatacatatgctaaatagcagaacgaccttcagttcactgaatgagaacctttgtttagccatggtagttgataacaggtgacctataaaaggtttaagaagctatgttctatgtgatatttgtttcagctaaagagataccgtggtggtgggcaccattggccccagctaccagggaggctgaggcaggagaatcgcttggacccaggaggtggaggttacagtgacccaagatcatgtcactgccctccagcctgggtgacaagagcaaacttctgtatactattatggcaatgaggctatttttaaaaatttcaatggaaagccacatgttgcagccacacccagctttattttctaatccatgcaacatgacatttgaaaacaattggaagattgtaaagttggagaaacataatgatctgtccatggaataataaaatgctttgatgtttaaatggaggaaaagtttgtaggaaccataataattaccaaggtgaaagaataacttaaaattgtgtgtatctgtgttcaaaattattagacttcattcaccatttcaacttggtttggggaggttgcccactcctgctgccttcatcagaatatggtgcctgggtagatactgccctttagccttgacctcagatgaacacaatccataggttagagacaagctctgctccctgcagcaaaaccacccagctgagccctgtcttgaagagtcatgttaatactaaaatgatcatccagaaacacgataaaacttgatgtaatacactgacttttaagtagttggttatcaatcatcattgtgcaaaaaaagtgaccaatgtaatacttacacattcacccatataggatgtatcttattataattagtggcagaagtataaatatttggtaatgtatttataaagctaccaatgagaaatttaaaaagaaatttaaaaaattatatataaataaaaagtgtaaaatttaccttatttatggaaactccacatatatatatataaacattaatgtaggtacatatatatatatttatttgataaatagttgggtgcgtgtagttccatatgcatatattcatgtctaaataaggccatttacatatatatatgagaaacatatgcatatttacaaaatgttttaataaattaaatctcttaagataattctatttattcctcatcaaaatagttggtttctagaaccagatatagtacctgctctggctataggaatgtccttgaaatttgatgtatttctaaaacactcaccaaattcatgtgtcaccttaaaatatttttctaacttacttgaggtgccaaagagtatgaatggagatgattttccctaatgttaaaaattatatccttgtctcctaggtaagtcctcattctttgtatgtctacaatgatgctattctggacagagttctatccatggatgctgggctgatgtcacatcattctcacagtcaaggatggcctggagagtaaaaatcataacagtgagcaaagtgcaagtgttatatccttgttcattttgcagagggagatcagccattcaatgacattgtctatgggtttgaacaaatcatcagaccttagaaaaaacagaacagaggattagagacaaagtcatggtggaagagccatgagtagacctttcaaaatgggccaaaagttgcctaatctatggggtagagagcaagttgatcacgtaacttgctcaggaagagctttttggggttgtgaaaatactttatatcttgactttggaggtggttagaaggattatttatttgcaaaaattcataaaaactgtacatttaaaaatcaatgtgatttattttaactattattatcctcaataaagatagttaactatatgtagtcagggagctcaaggtgcaactgagtaatgctgtcctcacatcttctattcttgcagtggactgcaactgtgtgagcaagaatgtctgggagattgcctcagacctaagagtaaagagctgtgtctctctggcaagagcccaattttctttttactttgattttgtcttctattggatgagaatttaaataattctcatagattagatcaaagtagcggctttttcatgtacacttattatttattgaagctaaaattccaagcaaaataaaaacttattccaaaagtgaagaaaagttttcacctgtgaattgccactactcttcagcttgggaaacacagcaaatccttgtctccaaattaaaagaaaaaaggaaaataaaacatttaaataaaacaatataaatttttttctaaaattagttaactaagcctgtcatacctttcgttttatgaccatcactcagaaattgctattattaaaatttacctgagttttaagcataagagctgtaatgtggcttgctacacctgtttattaaatagatagaaatatactgacattcaattttataggcatacataattcaatatagggctacatacatatgtagctatatacagatatgcattcatatatacatatatgtgcattaacacacatatatgtacatttacatatatacagatatagatatatttagatatctataaatacctatatagatagatagatatttcaaatatgtatatatatatatgaactacacattacacatatatgtgctttttatgctttttatatctgtgttcatgtcagatgcaggaattaatttttgtttctaatgcttttattcgttttggaaatgaagtttattgtgaccacatataataattctggaagcatttccttctttttaattctcttgaagtttgtgtaattttcacaaggttggttccagtaaacgaaacataagatggaaattttccttatagaaaagttttcattatagagttccttttagtttagtgaaaatagttgccataatttatttcattgtattctacttttatgtgtttgctatcctgggctctgtaataattttccctttttaaattatagattgtgtattttgcatcttttctctgtcttttttatccacctttcctgcttcatgaagcagccatggggtttaactccttccgggtaatttttctgaacttttacgctctgcttcccttttaaacgtaagttccaattccaaaccataactttgtaagtgcataaaactgaaggctttaaagggcacccaagtcatcacttgaaggttttgctgctttgaaatttatttggccagataccttaaattaggtctctcaggttcaaagttccacagatatttagggcagggacaaaatgctgccagtctctttgctaaagcatagcaagaatcatgtttattcaagttcccaataaatttctcatctccatctaagaccacctcatcctggacttcatggtccatatcactatcagcattttgatcagagcccctcaacaagtctctgggaagttctgaactttgccacatctttctgtcttctgagtcctccaaactgttccaacctctgcccattacccagttctaaagtcgcttccacattctcaggtatcttatagcaatcccccactaccttgataccaatttactgtattagttcatttccacgctgctatgaagaaatacctgacacagagtaatttataaagaaaagaggtttaatagattcacagtatgacccaggaattccactcttctctatagacccaagagaactgaaaacatatagtcaaataaaacttgcacatgaattcttataacaatgttatttatgatagccaaaaagtggaaacaacccaaatgtccatcagtgcatacatgcaacaacgtggatgaaccttgaaaacattaagttaaatgaaagaagccagtcacaaaaggtcccacagtaaattattccatctctatgaaatgcccagaataggcaaatctatagaagaagaaggtaaattagtggttgtcaggggctaggaaggaagaggatgggaaatggctgcaaacagcgtgaggtgttttgggtggtgatggaaacattctgcagtgacattgtggtgatggctacacaactctatagtaaaagccaacgagttgtttacttaaagtgggtgaactttatgccatacaaattatatctcaatacagatttctttaagtcttcaagaagccctctggtaaagaaatcagcctaacccagccctgaactcatctgaccaccaaagcttttcctcacattggcaccctgagaaactggtattctgaagaacgcgctttaggaaaaactgctttagacaacaggaatttggtaagaagaactttgtttctgtgaacacatatttgcatgtcagggtacatccttttgtattttatttatatttagtgtgtctatgtcttgtcttcttggtagctttacaagaatttcgaggagagaaagtatgattttgtctctttgaattcctacttctcaccacccataatgtggtgcacacataaatatctgtaaatatgcagttagaactttgcatcactaatgagttaattaaactattcaacaaagccaaaaatacatatcatggaccctcgagtgccaggcacagtttcgggcactggggatacaaaaatgagggagcttacggtttagtctgagaccaggccaggagccgcgcagtagaggcacctctccctggggtgtctgaaatcattcctgtgaactctaaatacctgagacagggctcagtcaatttaagaagtttactttgccaaagttaaggatgctcctgtgacacagcctcaggaggtcctgacgacatgcacccaaggaggtcagggtacagcttgcttttacacatttgagggagacacgagccatcaatcaatatgtgtcacatgtacattggtttggtctggtagggtgggacaactcaaagttggggcttccaggtcagaagtagataagagacaaaaggtttcattattttgcatactcgatcaaccttccactgaatacacaatttagtctggctcagtgaatctgcatttttacatcaacaatagggcagaggaagcaattagatatgcatttgtctcaggtgagcctcagagagatgactttgaacagaatgggaagtaggtttgccctaagcagttccaagcttgacttgtccctttagcttagtgactttgaggtcccaagatttagtttcctttcacattcccaaagcacatttgtcatgtagtagaaattattgaacaccttaatggaggcaccgtgtttgagattcactcccttgctattgaaaagcagacacaaccaatttcttcttcattgttggaaaaggttgctttccctttggttgggcaccagtggaagacttgcactgaacagctattttggccaaaactatgtctctcaaaggtgagtcccactggggcaaatccaggtgctcctggtctgagcagcctgtaggaaggacaggcgcagatagagcaagggatgcaccctcctctaccctccactccgcatccaccctgtggtatatctagggtggcacacagaatgaatggcactgcctaaatgactttttctttatttaaaaaatttactgcatttgcttaagcatgtacgtgagcttgtcctgtgactccccagtcccgaagctcagctgaatatctgaacactgggctttgaaaaaaagaaagtgaccctggagaccaaaaggacagctggctcataggaaagctgctcatggcaggcaaaactggagggcagagaaacgcactaaccttggttgatacagtttagatatttgttccctccaaatctcatattgaaatgggatccccagtgttggaggtgggccctggtgggaggtgtttgggtcatgggggaggatcccacatttgggcatgaaagtacaaatgcctgttcccatttagggctgcgggtttccagacttgagggtgggggcgtttgctggggaactgccctcttccacccagtatttccttgactcttgtctgtatcaccaagataacacactacaaatatgggaaggagcttggaaagaaccatgggaagaaacttgatgtgatcacagcacccccagtgagggcaggcgctcagcagggcagctgtctctgagttagcagcatcaggaagcctcccctggaagacactggctgcaggacgaggctgccagcctccaccagggacatctggaagccactcttgctggcttctgtggaggccaagggcagccttcttggcaggctgccagctctctggaggctcttggggcccatcctaccctcaggggacctggcaggaaggtcagctgactgctcctgggtcactcacggatgccccctttttatgccccaaaatgaatctgaagagaagaaatcctagcctctgccaagcgctgtcacccagcattgcagcctgaacacatccaaggggcctgatgagcagcacctggtcccccactggctcagacgcttgaagctactgaatttacatgtaattaaagactcgagtgcagaccgcatttcaaaacagacacttggtcagagataggaggccttccccatcagatggttttgttttgctttttctctgcatatgggccttataatttgccaaggtaaggttacaggggccacagttgttttgtttggagatgagaaagctcaagaatgacctaactctgtcttcaaatatgcggaggcatttattacaaggagggaatggctggctgttttcttcttaaactgcaagaaaaggtggctcagctgaaatcctgaagacctgcacacatggccgccacacgcagcccttccccagagcaccttgcatgtaggaagcacttcttgccctaaagcctaggactgcctgcctttgagaaggaagcttaggccttgaccatggttgaggaaggaggccccagtatctattttggagaagtctagtaggttctgcctggtggctggcagccaggacactgactttatggcagaggcttcattattttaaaaaattaaggatcctcagtgagggaggccttattcatggcagggccctttgtgtggctgataggtggggcatcaaagctctggcacagacgtggctgagctgaactcctctgaatcatagaggtggggaatatggaagcctatagctatgagaaagtccaggaggagacaggagaagcttttacccgtccagaaggaggggcagccgaaggaaggagagagggaagagggtggtccagtgcaggcacagaaggttccaaacaggctgcacctgcactggaccaccctcttccctccttctttcagctgcccctccttctggacaggtaaaagcacttccgtcttttcagtgtcatggagggagcccgagaagagcaaacattgacatcaccaccgctgcccacagcagtgacaccacgggcacacttttaaaagggtcgtatcctggaccggcacttcctcaactctctctgtcctaaagcctctggagagcccttaaatttgtggtccttgaagctattgtaaaggtaagatcttttttctccccaagtcctactcatcctgacttttcaagtttgtggtgtctctgataatctctgctcctgttctttgagaccatccccgtcactctccactctcccacgtgacacctgtaaagtctcttccagggatctggggctgcattccagggtctctttgctctgagctctctgaggcctcaggctgtcataataaatcaaatggcagggatcttctccaacatcatccttcttccttctgctttcctacgagggtggcaggttcaacgtgtctgtagaggcctcgctgtgtgagggtctgaagggaatttccaatttgatgcaggggaaggaagggagagagagactaaaaattggttgatggccaccatgtgccaggtgctcccaatacagtctcaaactcatgacatctcccagccaatggattcaccccctttaccagttccacctggagctccatctcccagacaagcaaaggccatgttggggggctttggagtcagctgcctgccatttcatctcaggtgttaccgtgggaaagttgtttaacctctttgagcctcagttccctcacatgtaaaatggacctacgagtttctcacacagggttgccctggggccaggattgccagataaaatataggatgcctggtataaaagttgcatgggacagacttatactaaatatgctccccaaattgttatagctctaaaatattatggctccaaatcaaatgtctgaactctatgagacagagcaaaaagcacgaacacaaagaagtaacagggtcaagagaaaagagcatgcacttggagggcagacatccaggaacaccatctctgctctgtgtcaagccaggctgtcactttaactgataattaaatgcttctgtgcctcgctgactcctctgtgccatagggacctaaagaaaggccctacctccctcacacggcacagctaagtactttgaaaacattaaaagcatgaaaacagtatgttttactctctatctgggatgggccaggagcagtggctcacacctgtaatcccagcagtttgggaggctgaggcaggcagatcacttgaggtcaggagttcacgaccagcctggccaatatggcgaaaccctgtttctactaaaaatacaaaaattagctggatgtggtggcaggctcctataattccagctcctcaggaggctgaggcaggagaatcgcttgaacctgggaggcagaggttgcagtgagctgagttcgcaccactgcactccagcctgggtgacagagaaagactccatctcaaaataagtaaatacataaatataaatacacaggatgtgtgcagtgatatgccaggaagttcatagagtgtcagttttcatctctccctcctgcaccaaaaagcaaactcatccatctaagagcactcaagactgaaggaaacctttacagaaaaatctagcctgttccttctaatcagcaggactgcactgaaaccgtcatggagattggcatccttttctctttctgaagacctctggggaggcagattctacaaacagccttggcagctgatgtgctagcacagtgtaggataacttataaatacagtcagagccaaggagggcctccagaatgcagcccagcatggtgtgcactcgtggagccctgacatacagctaaggaacattctgaaaactcaagccatccctctcatcactcctcttccttttaattgcaattgacccttcagaaatcaagtaaattaagggggaggggaaagaagaatttgtgctagtaagacagattccgaagaatgtaaaatgaaataataccaaacacacagaaatagaatactttaggcagaaagaaagggatgaagaggtagagggaagcatttttcctcccagtacatagtaggtcctcaataaacatttgttaaatgaatgcattcttaggaaggacaatctgctcatccatatgaatgagaaatgttttgctgatacactatttggaagtgactgtactacagctgatttaatggtaaagccatcaagtctgcatttcatccttctacctgggtactggctccaagaatctgttctctatcaacacatcaagacccttgacttagagagcctcatatacacagcaggaataaaaggagaggagaaatagagaatgaaactcagcctaaccttcctcatctagcccttttctaattcatccggtaccttttctaattcttcgcaaagatactgcgtaagttttcagaagctttagctgggccacacctccaggcttccaggatttgaagaattatgtcaatatagaaaccagtttctggacagcgaatagcaaatccaaaatcactctaaattggtgattgtcaaccaggatggttttgctcctaggggacatttggcaccacctagagacatatttttaaatggtcacaactagcagttcttattggcatttagtgggtaggggccagggatactgccaaagtgcctgtaatacacaggacagtggcccacaacagagaattatctcaatatctcagcaaggaattatgtcaacaaagccacaattgagaagcactgtgctagattcaaatctcttctaccgtgtcttctcagaccaaagtcttacccgtgacaacttatagtaacctctctgctttggtgtccacaccttaatctaccaagtcaacagatatgtaccaaatgcctatagctctctaccaggcatgcaagcaaggaaaaagcagcaactttcctcaaaataaaaccacagaagttagtcagaaaagaaagcgcaaaacagtgggtaccttctcaaggaaataaaccaaacaaaaaatccagacagtagccaagcacagaaatgcatatagtgttttcatcatttctgaggaaatgagttagaatatggatggctcaggcctcccgggttcaatctgaagtcttttttttttttttcttttcttaaggaagctaatagacaagaaattgagaaagaatgagtggaggccgtttggtttagtatgttctctggaacactgttgcgtttcccccgtagaaagagtttacaaatggtagttcagttccaggtcagcccagaagagcttactggacaatagtccagctgaggtgccaaaaccacaggagtccggggatacacaagccctgagttttcttggaagaaagaaggacaaagggattatctgtttcttttctccttagactccctaagtccccttctctacaccacctctctcagaggtaagagtaatcctagaaaaccttcaactagtttttttgttttaatttataagtaaagtacatacaaattaaaaatgtgctcctggaaaaaaaaaaatcccatctcagacccatatcctcaggctcttttcaaagagacaaagtcactgtttattacatttcttccagaaatactctctgcatatactcaaacgtatgcatgcatatatcacctttcaaattataggcagaaatggaagcatgcagtctgttgtgtacttttttttcaactattttaagttcagaggtacacgtgcggaatgtgcaggtttgttacataggtaaacgtgtgtcatagtggtttgctgtatagatcaacccattacctaggtattaagcccagcatctattagctgtttttcctgatgctctcccttcccccacccccgtgaaggcaccagtgtgtgttgtttcccgcccatatgtccttgtgttctcatcgttcagctcccacttatacatgagaacatgaggtatttggttttctgttcctgaattagtttgctgtggataatggcttccagctcccaccacgtccctgcaaaggtcatgatcttgttcctttttatggctgcatagtattccatggggcatatgtaacacattttctttatccagtctattattgatgggcatttgggttgattccatgtccttgctattaggaatagtgctgcaatgaacatacgcgttcatgtatctttataatagaatgatttatattgctttgggtatatacctagtaatggaattgctgggttaaatgatatttctgcttctagatctttgaggaatggccatactgtcttccataatggttgaactaatttgcactcccaccaacacgtataaaagcattcctttttcattgcaacctctccagcatctgttgtttctggacgttttaataattgccattctgacttggcatgagatggtatctcattgtggtttttaatttgcatttctcaaatgatcagtgacgttgagcttttcttcatatgttcgttggctgcataaatgtcttcttttgagaagtatccattcatgtcgtttgcccatttttaatatttttttccttgtaaattggtttaggttccttgtagaccctggaaattacaccttcgtcaggtggaaagattgcaaaattttttccccattctgtaggttgtctgttcactctgatgatagtttgtattgctgtgcagaagctcttaagtttaattagatcccatttgtcagtttttgcttttgttgcaattgtttttggtatttttgtcatgaaatctttgcccatgcctatgtcctaaatggaattgcctagattttcttctagggttttcacagttttgggttttacatttcagtctttaattcatctggagttgatttttgtataaggtgtaaggaagggggttacaatttcccacatatagctagccagttctcccagcaccatttattaaatagggagtcctttccccattgcttgtttttgtcaggattgttgaagatcagatggttgtaggtgtgtggtcttatttctgagttctctattttgttccattggtctatgtgtttgtttttatactaataccatgctgttttggtcactgtggctctgtagtatagtttggagctgggtagcatgatgcctccagctttgttgcttctgttaggattgtcttcgctattcgggctattttgttttgttttgttttgttttttggttctgtatgaattttaaaatagtcttttctaattctttgaagaatgtcaatggtagtttaatgggaacagcattgaatctataaattactttgtgcagtatggtcattttcatgatattgattcttcttatctatgagcataaaatgtttttccatttgtttgtttcctctctgatttccttgagcagtggtttgtagttctccttacggaggtccttcacttcccttgttatctgtattcctaggtattttattctttttgtgtcaattgtgaatgggacttcatttatggtttggctctctgcttgcctgttgttggtataaaggaatgctagagatttttgtgcattgattttgtaagttgagactttgctgaagttgcttatcagcttaagaagcttttgggctgagatgatggggttttctaaatataggacatgtcatctgcaaacagggatagtttgccttcctctcttcctatttgaatactctttatttctttctcttgcctgattgtcctggccagaatttccaatactatgttgaataggagtggtgagagaaggcatccttgtcttggtacactttctttttacccataaatctaccttacttctttaacggctgcagaatatcccatgctatgaatgtaccattggtatcaacattaggacagtgactaggaatattttgaaaaaccaaaagttcatctttctcctcttacttactacctcttgtccctacccttgtcctccatatagagctgccttgaacccttcaccttatctctcttgactggttttactctatcccctttcccaaaggagtcatcccccaaaagcatggactttctgactccaacccaaaactcaccttctttcagagtggctggcctgacttattttattccaaaagaaagtaatttgattctaactaattattatatgaattaccaccaactccttaaccctcacatttagaaaggagatgttaactaagttgaactcatcattggaattccagagagcaacaactgatttaaaaaaaaaaacaaaaaaacagaagctgtcaagagcatacaattatgggttgggatcagccatattggctattatctcatgtcagaaaatctaggcacagagagcttcctctaactgatgatattctgggcaatttcttcatttcttctagctaaaagtccaattacttttcaaaagctctaaggttttccacaatactcttagtaaggggcctggaaagagcaggccagctgtctataggtataggccattcataaatgggtatccgtaacatatggacccaccgttctgagactggccacgagtcaattgagaaagagtatgccatcacttgcagatgcccacaggagaacttggacatacagaagagggataactgagttgagactggagttgtgcagaatatatgtgtgtgtgtgtgtgtgtgtgtgtgtgtgtgtatgtgtgtaactacataatatattaatatacgtacagacataattttaaaagagcacaaatggaaacacatacataacacaaacgcagttacattaagagtgggggccagagggtccttttatcacctactgtcagtgaagggatccaaaatggtcacaagagtcttctcctgccagtttccaggccctatcctgacggcaaacaccaggacggtgtctttaatcagagctggcccaaggcccatcaccctgtaatgtgaaagctgtctactttagccaaacttttcgatcaggacaggtactcttcttttgaaaatccaaggcggagaggaaaaacggctaggtctgaaccctcaggatgtgccagggcagtacaagtgtggatggcatcagatggtagggggcagagagagtaccaggccagggcggaactgcactgagggccattagggccttttgggggccaggtaagtggcctcagatggtgacagctacatggtcctgggtaagtctgttctggttggtttcatttggatctggagggtcctacagggcagccctgaagaacatcaaactggaggcacacagagtaccaggctccagggtctttgccataaacataagaagcagggaaaacaagaggctgactttgacaaactcttgtgcactcaaatgtaaagggcaggagaagaaaaccaggtcagtgggagacagttgaaccctgccacccccggtggatggatgatgcctgtcacctaaatagggcctagcttgtggggtgaggccagtcaccatggtggatgtgaatggcccatgtgcaatctggaggctacagagagagagccctaggcacaagtttctcaaacaacagaagaagaaatgacctggcatgtgaagtccgatgtatagatgccactatccaagcacctattcttactgtaaccttaagctattataaaagcatcagccatcttgcctttgagttcttatattttgtatgcctcatatacattaataaatctgcctgcctctccttgtattcatctgccttttgtgggttgattttcagcatcatttcacagggtgaagtggaagttggctcttggcccatgcaacacatctattcataaagaaatatagatatatttaattacatatatgtatttatacatatataaacaactatatgtacatataaaacaaacataaatcacaaacacaaacaaacacactgatgtaaatgcatttatgcaggggccactaggccctcttgccacctgctgacagggaagggaaatgcgaaagctacaggagtctttctctgccatatccacgtgaccttacagtgatggcaaacactggcccagcatgttttaaccagacccagcccaggtgccaccaccctccagtgcgaaagctgtccacatccctagaatctggcaatcaggataggtgctctccttctgaagaccttaagtaagcacatgcgtggagttccggttcaagtgggtagagaagaggctctccccagagagaaagaaaggtgaggtctgagacttcaggacgtgctgtgggacagtgtaaatatggctgaagtaagatggccagatgctggaaggacagcgaggctggggaaggcctgcactgaggaccatttataactttcaggaaccaggaaaatggcctcagacaatgaagccacccagtcctgagtaagcctgttctggccttttcatctggatctacagaaccctacagggcaggcctaaggaacacgtaagtgtcaaggagctgtttggggagctaagtctatgaggcttcttccatctgtataaaacatatagaaaacagggttctggccttctacactccaaaataggtggcaggtgaggaagaacaagccagagtaagtctttttcacactgccacccaggtggacagataatgcctgtcaccaaactaaaccctggcttgtgctgtgatgtggggctattgtggcagatgtgaatggtgcgtacacaagctgggaagctacagagagccttgaggccccaagctgggcatctggccttggtcagaagcattgctagcttctcagctgggctctgcattcaaaggctaggctgaggagtgtgtggccctagaaaaagccctgtgttttctgctcttaaaatctcatggaagtagagaccagataggacttgaatggaaggccacccgatattacctggttccataggcttttgtcatccccattctccccagtacagccagccaactctctctgctgtatcctagagcaccaggaggctaataatcagtgctggagtgggacacagaggataaaaccaagtctcagaggtaagtggctaggcaggcagtggctcttctgcctcattccctctgcatgaacattgtggggaggtggtctgggtgatagccaccctttggaatctccctcctcctcactgaggaatagcaagaccctgacatctgtgaggaccctaccaacatggcctctgtgagcagtcactcagcaacccaccacctctgctctggatctttggtacaaattttgatgatttctgggggtgctgtagggccatcacgtgccttcacagtaaatgtgcaggaaccaggtttttttttggcaggaagagaagtattaatagcaagaactcctcagcagcaaagcctcatcaagaaagaatgagttgtgctcaggtgttcccttcaaaagtgcttcctcgctgctgcttctgcacctcacttgagtggcgagaatcttctgtgaggcaagcctcagtcctgtctgcgtggacactcaccacccagctgtctccatcagaaagtctggcccaggccctttcctgggaaccagagacccctctgctcttctcctccagaccctgtggaatagcggggaagaggggaaggtggaacatgaactctcttcctgctcctccaggatgccaagccagcttccgctgcttttaccaacctcacactccacccccttcctctcctttataagcccctggggcccttcaagaaacaaaacaaaacattttttaaaatgtgcaggtccattttacttccaccctgccatgtcgcttccctgaagtaacactgcataagttcttccatcggcttgttggggaggaagtttcatctgcttgtggaaaagacaagacaaacaagggataccatttaatattttaaagacatactatttaaggaaacctatcataaagacaccgatttacaaagcccactattttggtataaatttgtcaacctaaaataatcaaaggacaagaatcccattttgaagagtttataccagtgaaatgctaggaatggcttcttagcctgtaaagtgtaagagtggaagaaatagtgcactgaattgagttcatcatctcagttcgtcattggaaatcacctctcatttttctctattttccaccgttttttacctcacttgaattttctaatttttccacataggtttttactgtcatgtgcttgatatatggccctggagatgtctttgaaagttacataacgctgtgctttctgtgcgcatcttttatttttatttttgagacaggatcatctcactttgtcacccaggctggaatgcagtggcacaatctcagttcactgcagcctcaacttcacaggctcaagtgatcctttcacctcagcccccaaaaagtagctgggactacaggcaggcgccaccaggcctggctaatttttctatttttagtagagacggggtttcaccatgctgccgaggctcatattacactcctggactcaagtggtacaccctcctcggtctcctgaagtgctgagattacaagtgtgagccgctgcacccggccatgtgcgtatcttttaaatatacgtaagttatttatgtctagatagccatctgcttcttagaatatgcttaatgtatttgcacatcattttaagcctaccaatggtgctttgtgagtatgtattgtgcacatatgtacataaatatatatttcatgtggaatatatagttcatatatgcatattacatcatgaatttgtttataatagctgttccatgtcttatgcatgaaatctccaagtaaagggcatctaaattcagtacaattagaagtagaataaactgttgcaaataagatctttgaaaatgtcctctgatagacttctgtggctgcttctcaggggaatatacccaggatgtgatggtcaggacgtaaagtatacacataataattttccctaagtactaagaaaataatctccaaaggagtctgcatccttgaagtaaaacatgaacatgcccatatcctcacattgtcactaatgtttggcgtaatccaaatttctaaagttaataaacaaatataaagtgttattttgtgtcacttattaggtcactaatatttctgagttgctgttcacatatttctaacccattaaagtttcctctactttgaattacctcttcatattgtgttcagagtctgcatttcccaagttttttctaggtaatataagagtaccttaaaaaggtattattactgttgtagaaggagtattatgtgtgtcaaaggatcctagtttctttttaatatttattgaatattaaataataaatatttaatatttattaaatcccattttcccttagaacgccacacagtcagctgagaacattatcatttacgtaaacactacgtttcttagcctcccttggaggtcattgcgaccatggaactaaatttgggaaagtgagatgaaggcacgattatttgcctgtgacttccagggtctttccttacaggagggtatcttttgtcctttctactcctctttcattactgcagcttggatgcacttacatttcctggagctccagcagctctatgtgactattagtaaatgagacatgccctaagtaaagctgggggagtgtggagtcccagtggctcatgaggcacagctgccacaccaaacccggatggccaagcctctgtctaattttgtgtgagcaagaagtatactaacttgtttaggtgactgctatttgggagctcttctgccaccttcaattgagcctcttttttcacaaaattattgtttattcaataagaacacatttatcttgaaatactttgtttttttttaaacttttattttaaattcaggggtacatgtgcaggatgtgcaggtttgttacataggtaaacgtgtcataggagttttttgtacatattatttcatcacccaggtattaaacctagtatccattagttatttttcctgatgctctccctcctcaccctccatcctctggtaggccccagtgtgcattgttcctttctttgcgtccatatgttctcatcatttagctcccacttataagtaagaacatttggtataatatttggatttctgttcctgcattactttgctaaggatagtggcctccagctccatccatgtccctgcaaaggtcgtgatcttattcttactttttataactgcatagtgtttcgtggtgtatatataccacattttctttatccagtctatcactgatgggcatttagattgattccacatctgtgctattgtgaatagtgctgcaatggacgtatgcatgcatgtgtctttataatagaatgatttacattcctttggttatatacccagtagtaagattgcttgggtgaatgttatttatttctctaggtctttgaggaatcatcacactgttttccacaatggttgaactaatttatattcccatcaacagtataaaagtgctcctttttctccataaccttgccagcacctgttatttttggactttttaataatcgccattctgactggtgtgagactgcatgtatgtcttcttttgaaaagtgtcttttcatgtcctttgcccactttttagtggggttgttttgaatttgtttaagtttcttttttattttactttattttatttattttttcttttcttttcttttcttttcttttttgagatagagtctcactcttttgcccaggctggagtgccgtggtgcagtctcggctcactgcaacctccgcctcctgggttcaagcaattcttctgcctcagcctcccgagtagctgggattacaggcatgcgccaccacgcccagctaatgtttatattttgactagagatgtggtttcatcatgttggccaggctggtcttgaacttctgacctcaggtgatcctcctgccttggcctcccacagtgctgtgattacaggtgtgagccaccatgcccagccaagtttcttacagatgctagatattagacctttgttagatgcatagtttgcaaaacttttctctcattctttaggttgtccgtttactctgctgttagtttcttttgctgtgcagaagctctttagtttaattggatcccatttgtcaattttggctttcgttgcaattgcttttggcatctttgtcatgaaatctttgcccatgtctatgttccgagtggtattgcctaggctttcttctaggatttttatagtctggggttttacatttaggtctttaattcatcttgagctgatttttatataaggtgtggggctggagtccagtttcaatttgcacatatggctagccagctttcccagcaccatttattagagaatcctttctccattgcttgtttttgtcgggtttgtgaaatatcagattgctgtaggggtgtagtcttatttctgggttctctattctgttccattggtctatgtgtcttttcttgcaccagtgccatgctgctttggttactgtagacctgtagtatagtttgaagttgaagagcatgatgcctccagatttttctttttgctgagaattgccttggctcttcaggctctctttgggttccacatgaattttaaaatatttttttttctatttctgtgaagaacttccatggtagtttaatgggaatagcattggatcaataaattattttgggcagtatggccgttttcataatattgattcttcctatacatgagcatggaatgtttttccatttgtatcctctctgattcctttgagcagtggtttgttgttctctttgtaaaggtccttcacttcacttgtaacctgaattactaggtaccttattcttcttgtagcaattgtgagtgggagctcactcatgatctggctctcagcttgattgttgttggtgtatagaaatgctataacaatttttgcacattaattttgtaacttgagactttgctgaagttgcttatcagcttaagaaactttgggggctgggcgcggtggctcatgcctgtaatcccagcactttgggaggccgaggtgggtggatcatgaggtcaggagaccaagaccatcctggctaacatagtggctaaccccgtctctactaaaaatagaaaaaattagccagacgtcgtggcacacacctgtagtagcagctactcaggaggctgaggcaggagaatcgcttgaacccgggaggcggaggttgcagtgagccaagattgtgccactgcactccagcctgagcgacacagcaagactccatcccaaaataaataaataaatagcttttgggctgagatgatggggtcaaacagggatagtctgacttcctctcttcctactcaaatacattttatttctttctcttgcctaattgccctggccacaacttccaatactatattgaataggagtggtgacagagggcatctttgtgtcagttttcaaggggaatgcttccagctttggcccattcagtatgatattggctgtgggtttgtcatatatggctctgattattttgaggtacgttccttcaatacatagtttattgagagtttttaacatgaaggttgttaaattttatcaaagccttttctgcatctattgacataatcctgtggcttttgtctttagttctgtttatgtgatgaatcacatttattgatttgtgtatgttgaaccaaccttgcatcccagggatgaagcctacttgatcacggtggataagctttttgatgtgctgctggattcggtttgccaatattttattgaggatttttgcatcaatgttcatcaagcatattggcctgaagttttcttttttttgttgtatctgtgcctggtttttggtatcaggatgatgttggcctcatacaatgttaggaaggagtccctccttttcaattgttttggaatattttcagcaggaatggtaccagctcttctttgtacatttggtagaattgagctgtgaatctgtgtggtactgggcttttgtttttttttttttctggttggtaggctatttattattgcctcaatttcagaactcattattggtctattcagggattcgatgattcaatcttggaagggtgtatgtgtccaggaatttatccatttcttctagattttctagtttatgtgcatagagatgtttataatattctcagatggttgtatttctgtggggtcagtggtaatatcacccttattatttctgattgtgtttatttgaatcttctctcttttcttccttattagtctagctagtggtcaatctattttattactttttttcaagaaaccagctcctcgattcattgatcttttgaatgtttgagtgtgtgtgtgtgtgtgtgtgtgtgtgtgtgtgtgtccctatcttcttcagttcaactcttattttggttgattcctgtcttctagatttgaggtttgtttgctcttggttctccagttcttttagttgtgatgttaggttgttaacttgagatttttctagcttttgaataaggtcatttagaggtataatttccctcttaacattgcctcaactgtgtcccagagattctggtacattgtctctttgttctcatcggtttcaaagaacttcttgatttctgccttaatttcattatttagccaggagtcattcaggagcaggctgttcaatttccatgtagttgtgggacacttctgagcttcatgagctcttgtaaagttggtctggtggtaacaaattttctcagcatttgcttgtctgaaaaggagcttatttctcctttgcttatgaagcttagtttggctggatatgaaactctggcctggagtttattttcacacattcactcatcacttccctgcgcaggcgaaggggttccccttggctctttgtcgcttctgggtgggctgtcaccctgcccggcttttttccattctccatgggtggagctgttttcctgatcagttccaatgtgagtacttggatatttcagttgaaggtgctgtgtttactcatccctctcattcttttctgtgagagccatgcaccatagctgcttctagttggccttcttggcccccttctggctgagcctaattctgtgtaatagaggttgtacatagatatgccctagaaacacagattatagagaaggatcatacaatatgatcatacaatatgatccttacatatgcacatacacgtgtaatatggctttgcatgtgtcatgcatcagtcaaaattattctgttttttacttcagggtattttgactatagtgtttcatatgtgtttctatttttctctgtatcaccattttagatcattgaatggactgctgggctagacctggaaaattcttctgccaagtgtactatatgtctaggttcatgtcactgtgtgatatcggtgtccttgtgacaactgtagggggatataagagcaacagtgaaataaagtcatctctcacagctggcatgtatattcctataaatttatgtgaacaggaaaatagacacaaattggaaccatggaattcaaaaaacggtctcttaaatgaagtcacagaaactacttggaaatttaatttaaaatgttgaactctgtcctcaattgtatgcacctctgcacaacaggtctatcttgtggaagggcaaggtatttcttctcacattttttttccttctgtcttctaaagagcttcatgtgaaagcagaagactcatgagaagacatctagagactagccctaaagtgcttttctccacaggaatgtcacccaggcactacatccaggagtctcaggtgccactgggttcccatcctcagtgaggcagagctgggagaaggcacgcagcattcaaatttccttcaagtcacttgcttaaggtatacattgaaggttcaaactaaatttgaaatcctttttttgttgttttttacaattagcacttttttgttatttttttatatattttttattatactttaagttctagggtacatgtgcacgacgtgcacgtttgttacatatgtatacatgtgccatgttggtgtgctgcacccattaactcgtcatttacattaggtatatctcctaatgctatccctcccccatacctccagcccacaacaggacccagtgtgtgatgttccccaccctgtgtccaagtgttctcattgttcaattcccacctatgagtgagaacatgtggtgtttggttttttttccttgtgatagtttgctgagaatgatggtttccagcttcatgcatgtccctaaataggacatgaacttatcattctttatggctgcatagtattccatggtgtatatgtgccacatcttcttaatccaatctatcattgatggacatttgggttggttccaagtctttgctattgtgaatagtgccacaataaacatacgtgtgcatgtgtctttatagcagcatgatttctaatcctttgggtatatacccagtaatgggatggctgggtcaaatggtatttctagtcctagatccttgaggaatcaccacactgtcttccacaatggttcaactagtttacagtcccaccaacagtgtaaaagtgatcctatttctccacatcctctccaacacctgttgtttcctgactttttaatgatcgtcattgtaactggtgtgagatggtatctcattgtcgttttgatttgcatttctctgatggccagtgatgatgagcattttttcatgtgtctgttggctgcataaatgtcttcttttgagaagtgtctgttcatatcctttgcccactttttgatggggttgtttgtttttttcttgtaaatttgtttgagctctttgtagattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtctctgcccatgcctatatactgaatgatattgcctaagttttcttcgagggtttttatggttttaggtctaacatttaagtctttagtccatcttgaattaatttttgtataaggtgtcaggaagggattcagtttcagctttctacatatggctagccagttttcccagcaccatttatttaatagggaatcctttccccatttcttgttcttgtcaggtttgtcaaagatcagatggttgtacatgtgtggtattatttctgagggctctgttctgttccattggtctatatctctgatgggacgtatctcaaaataataagagctatttatgacaaacccacagccaatatcatactgaatgggcaaaaactagaagcattccctttgaaaactggcataagacagggatgccctctctcgccactcctattcaacatagtgttggaagttctggccagggcaatcaggcaggagaaagaaataaagggtattcaattaggaaaagaggaagtcaaatagtccctgtttgcagatgacatgattgtatatctagaaaaccccattgtctcggcccaaaatctccttaagctgatcagcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaactcacaagagacgtaaaggacctcttcgaggagaactacaaaccactgctcaatgaaataaaagaggacacaaacaaatggaagaacattccatgctcatggatgggaagaatcaacattgtgaaaatggccatactgcccaaggtaatttatagattcaatgccatccccatcaagctaccaaagactttcttcacagaattgggaaaaactactttaaagttcatatggaaccaaaaaagagcccgcattgccaagtcaatcctaagccaaaagaacaaacctggaggcatcatgctacctgacttcaaactatactacaaggctacagtaaccaaaacagcatggtactggtaccaaaagagagataaattggaaatctaacagaagcattcagaactacatgtcaagcccaagtcacttttagatatttgagaatgtgtacaaaccatatgggtgtactttccccaaaagtgtgttttttgcagtagtggttaggagtattcttttgtgagatggtatttttcttaagcaaccaccatttagattcttagttctcttaacttttaggttaacaactcaatacatcttccaagtgtcctcgtatactttttccggtttgactattagtttaggtggtgcctatggcccatttaaactcggagactctgaggctctgatgtgtatccatctggttagagtatgtatgagtaaagccaaggtcagtcaatgacttgacctcactaccttttccaaaatttctagttctaacattggctagcaattttgaatgcttgtcagacaaatacctcagagtccttgccctgctaatgcagtcattattaagagtgaaaattacattgtgttgccttatttaatgatgtaatgctgagtaagcatttatagagcacctattctgggaaagattaaaaatatacaaagtgataataaatggtctcgtcttaagaagcttaagaggaaatatgacatattaacaagttgccatgaattaaggcatcatataataatacaataagagagtataaactattttaataaacatgttctacaaaatggagcatttggatcctgaaagggggctagaatttaaaagtatgagttgagagagaaagcattccagtcagaggtaccagcagaaaaagtagctctgagacaggcattggaattatcaaatatatttttcttcagattttatgaaagtatgcttatccatgaatgctgaagtgcttatctatgtcaacattttgttaaagagttactcaagctcagaaaatatagggaaattttatttatattttctcagaaaatatatttatttaatttaattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatatttatttctatattttctcagaaaatatagaaaatatagggaatttttagtttatattctttgattttaccatgaatctgaatttctgttatttaattgtttaaatagttactataatttttgtgttaaagataacacattatagaatatctaatttacttatcaccttcaggaaaatcaaataagcatttgtgaagtgtcaactattttctctgcagtggtgcttttcaaactacccagagtgaaagacttttattttttgtaaaatgtaaaatattgtggcaatgtcagattgctataaaaggttttcaaatctgtacttccaggtacttcaaaattagtttgcagattagtaccagtggtcttagtacaatttgagtagctacagtaagtaaggagttgatacaaaagaaatacagcatattgtcaccatcattggtataagaatgttgtggggaggactaggcttacctatgtaaccagtggaaaatgcagcatatggtacaattactaaagataaatatagacataaagaagagcgatgataaaactgttctggatcccagttaaaatctttggggttactgcttaactctctggactcacagccccgacccaccatccccaatgtgcagtttcactcatggaaaaaaagtgtctagaccagcagctgaggatgcatttactctatgttcagcccactcaaaatacagttctgtaatcagaatacaaaaacaaccaccaacaacaacatcagcccaactttctttactgtgtttcatttaatgctgaaatcagacaatgattagaacatgaaactttgtttgaaaaagtatattcaataaattttgtatttaaaacagagctcttgacctataaagtataaaaagtaattacaatgaaatattcttcagtaaatctgacactttgggattccaggcaaaaggatcgcttgggtgccaagagttcaagaccagcctggtcaacatagtgagattctatctctgaaaaaaaaaaagaacaaaaaacaaaagttaaacaaatcagtaaatctgagatgcactggtataattcactggcttgcccagttggtactctcttagccgtggctattcctgatgactaactggcagtaaaagccaggaaattatggaggtctactgaggagtcccctctcgaagtgaagttttcccattatttacacttaagaaaaaattaatgtgagattggattttaaacatccccattaaaaacagaagaatggagggaagaaggtgggtggggagggagagagagagctgaataaaacatttactttatcatttatcttttaaagtcacatggaatgccaattccaaaatcacttaatttttagaaccactgcaatctaaacactgtcatcagaaacatgccaagtgttggttctctgtggtaggtctcccatcttacttatattttcactgtattaaactttacccttgcatgggtttaccctccagcctctgagccttcattaactaggaccctatctacctgcatgttttgctctccactttctttgccattcactggccccttctttagtgtttggtcttcaggtcgccactttcccttttagctaattccattactctgattttctctgttcctttagctaccctatcctagaacaactctcccagggatgaaaatggggacttcagaattgagaaataaaagggaagatgttatgacaaccttcctatcttattttttggtaaatccactctttccctgtctctatctctctctcacacacacacacacacacactcacacacacacagaaatttacagggtaagagagattaggaagataattttggtggtagagtcaagaagaggttgaagaggtgctaatattaaaagagagatttgaataaaatgtttttagaattcataggcattatgatattctattgtaaaatgctattggttaaaattatctttgtatgggcaaactgagtctctgtctccagctgtctgtgaacaagctattcagttcactaaacctcagcacctcatctgtggaatgagcaccatagtagctcctgtcataaaggttaaatgattttgtaaaggacagattacaaagcatatataaagtatttgattttttgttattaaaatacttataatgtctgtaatatttttaaagtaaagaggtataatgatttatacttctgtttattctagaaactgattcttagttgagctcggaggtttttcaacttttctttcaaatattgagataaataacattgatctatctatttatctatctatctattttgagataggatcctactttgtcacccaggctgaagtgcagtggcctttgtcttccaggctcaggtaggatcctcctacctcatcctcccaaatatctgggactaccagtgtgtgacaccacccccagctaatgtttttgatttttttgtagagatgaggtctcactatgctgacaaagctggttttgaactcaagtagtcctcgtgtcttggcctcccaaaatgctgagattacaggcataagccactgtgcctgtacttttattttatgtagatcaccatcccttactgagtatcacataactgttattataaatcttgaataagagattacatgttttggccaggcacggtggctcatgcctgtaatcccagcaattttggaggccaaggtgggcagatcacctgaggtcaggaattcgagaccagcctggccaaaatggtgaaaccccatctctactcaaaatacaaaaaaaaaaaaaaaaaaaaaaaaaaaattagccaggtatggtggcacatgcctgtagtcccagctactggggaggctgaggcagaagaattgcttgaactcagaaggcagaagttgcagtgagctaagaccatcccactgcactccagcctgggcaaatgagtgagaatccatcttaaaaaaaaaaaaagactacatatttcatacagtattccaaaaccaaaaacaacactatgctttgcttttcgttaccatgaatctataagttattaagctttcagtactgcaaatattgtcacatattaacagtttgacttgaaaatacgtgtaatttctactaaaaatagaaaagaaaggccttgtctttagaagcttccaaggaacattataacagaagttatattttccacaatttgggttcaattaatcttatatattgcaattgacttaaataaaattttaatttttgaacactttaaggtttacagaaacatcgtgaaaatagtataatattcctggtaagtacccaaactctgctttctctattactaaaattttatattagtgtggtgcattcattacaattaaggcatcaatattgtcatattattattatctaaagaccatacttgttcagaattcctcagtttttatttagtttccattttctgttctagtgtacatcctagaatcttatattacatttagtcattgtgagacagactccaggtcagtaagtgctgaaacaggggatgttaaaaaagaaccaacatagattacaaaaggaagactcaaagcttccagaatgattttctttctatctaaaatcattttctatctttcatcctatcagcactcataaattacacacactcataacctgccacaatttactggcagattgtgaagcgggagcaggcatgtcacacagtgaaagcaggaacaagagagtgaggggggagataccacacacttttaaacaaccagatcttttgagagctcacctgctatcatgaggagtaccaaggagatagtactaaaccattcatgagaaatccaccctcctaatccagtcacctccctccagaccccacctaccacactggggattacagttcaacatgagatttgggtggggacacagatccaaactatatcacaggggtttccctatgttgcttaggctggtctcaaactcctggcctcaggtgatcttcctgcctcaaccttccaacgtgctggaattagaggtatcagccaccatgcccagccagaaatttctttctcaaggggcttttcatctcactggaaattttagtttagggatctcccaacttacaaagggtttgtgttccaaaattttgtttctaagtcaggtaggctcactttcctacagaaaatgagaagaagccagtcccaaagcaagcaataaaagcctgttgcctcacaagtgaactatgatgttgctaaatccatcaggagtagttttacttttgctctttgttgaatgggctactgtgggcctgtgggggcacctaaccaccatttatcttatttctttgaagcaggtcatgctgtcacgtgtggtcaaaagggaattagtgatgataatggagctttctctgcctctctccctcttgactgccaaggtccagggaagttcacatctcagtggtcacgggctggccaagtagatccccaccagttgctggataatgcctgtgaactactggctagcatctattctgaaaacctagcttctggtttgcttgtttattcaccagtatctcacataattttcttatgaccatctggcacctaatatagatcccaaaagagtttaagaggatttaccctttaggcaaaaaatactggcagtgtttataatcccctcaaaaagagagagggagaaaaaaagaaagaagaaatgtttttaaaggaagagatagcaccatgtaactataaataactctctatatcagactgaaaataaatttttgttttttctttattttggctcatttggtaagctaacaaactggaagaaaagaaccagttttaactaaacaactctaaaagatttcagaatttgaaaacttagagttatgaatagatttgattcacttagccccaaaactatcaaaagaagtatataaaatattaatagtcaccaaaaccattgagctatagaattccagatattgaaattctaaggaaatgttgttttagaatcaaatcatgtactaggctgaaattaaatcaaataccattactgagtattgttattaggataaacatctttccatactttggtgaaattggaaatactcttgcagaagtgttttcatctctcacccagaaaaagtaaataatgaccttcttccttcttccacttaatgtaaaatcctacatttacatatattgtgtcatcccttgttttgtgattatttgcttacagattttctctaggtgctctctaagcagagagaacagggtactggttaagattgtagatctaggggatcactgatctaggtcctattccaaatttgattcctcacctgctaagcttgcaagtgcaacttatttaaattctctgaaggttaaatgtttcatctaaatagggataataataaacacctatagcatagagttgtttgagattaaatgagataatacatgtaaaattatgtgcctggcatacagcaagattgttgttgttgttgatgatgatgatgatgatgataatatttttctatccccagtgcacaactgcttgaacctattagataatcaatacatgtttcttgaactgagatcaatttccccatgttgtctgactgatgaagccctacattttcttctagaggagatgacatttgagcaagatcttaaagaaaatcagatgccttcacctgaccactgcttggtgatcccatggcactttgtacatctctccattagctctcatctcaccagcccatcattattgtatgtgctgccttctgaagcttgcagctggctacatcaggtagaataaaatcatcctttcataaaatagtgacctccttttttatttgcatttccaaagccaagcacgtggtaggtagacaacaaatgcttgctcctgggctgcgctaaaggcatctataaccactaagcccaaagagtgtggtgtcccttcaaaaggaaggagccagtgtttatatcactttttcttgaccttcacggctccactcaaagcccacctccagcatgaggcactatccagtccaatccacagtgatcactccctttctgagtccttctaggaaatcagacacagtcatttgaggtgtgtgttagtaatctttcctcagatgccctgtgagctcttttgcacagtaccaaggcatgtaataggcaggaaacgtatttaattgcttggcttagttctagttttcaatgtgtacttctccagaattatccaattaaccctaacttgagaagataggcaaactggatttgcacacactggagtcaattcctgatatccccgggggtgtgaatgaacagaggtcttcttgctggcttctgtaacagtatctctctttggccagcacccaatttttggaaccattatgagcacacaaaaacagcattttacacaaatcaagaaatagctcccaaccatgtctttgtggcattgttaaacaacagtaaattgtactttgagttctatttcctctaattaaatgaaatgagaagtgggcccaagtcccccagaaagagactggagggaaccacgatgtttcctgtgattagatacaccactaaggaaatctgaccctgagcaactgaaagctgcctattctcattaagaagagctacagactgacccttttcaaagactagtaactggacacatttctttcacaaattatcttcttttcccttcttcataccaggaattctcagggattataatcctcatcaatataacaagcctccaaagtcatattttttaactttgtgaaatgccctcccacctaactaccccatttgacacctgcaaccatcctctagagaggcagacaagatcgaccgtctcactttacagaagtgcaaagagtagctggcctaatgccacagccaatgaacagatgaaggaggcctacaaccacctagtcttccctacttctcctcactcctcccctctgacctccttatgtcaccactgaccaatggatcactgtgtggccgttcagcatcttcctatgctgtgtcaggcaagagaaattctggaaagagagcatctcatgtttattaaggagactgggtgtccttgtagaaagtcctgccatgcacaaccccggtcttaactgatgtgtttcaccatactgaaggcaagttgccatctaacatagttgaaggcgagccagttgtggtgatctttgttcctgctgaaatatggaaagaaaatgaggaaatgagctcattttcaaagaaaatgaacattctttcacatgaaagaaataggagcaaagtgacaggagagaaacaaagcttagggttggtgtgagatacacagacagggtgttagccccacaaacagtgctgctgggccaagttaactccctgtttttccctatatatgtggtgtggaaaagctatttataaaatgtgtttaaatatttaggaccaaataaatcaacattgttgggaaacattgactctgaccagaactcatttcctcaccctagtccaatgtgaataacaaaatgaagaatatcaggatgattcgagaccaggaatactacagatgtccaacacttccacctggaatccccaaagaggcccgcttttagcctccacactggttggtgacctgacatgagagaaatgacagaaatctcagaagactggcctcatgaataatcttcagtttcaatgtaacaaagcaagccttctagaaattacctgcctctgcagttcactctgctgcttcagatgaaaattttcaggtctgtctgccactgtagtgaagcactgctttgggtagtgtctgtggagaaactttttaaaggacatagttgaaatattgtgctacaaaccaattcttgaacaccactcattttgtcctacctctctgtgaccgtgaaagacggctgtactcttggcaaaggtcatctctctgtcatgagtctggatctccttttcttctcctgattatctgtcactcagttatccccactctcttccacaactttaacttcagcttctctattctaagagactcttctcgcaggctcaaggctctcctaccctccatcattcctccctctaccccacacagccagcatgtgtccagctagtctatccttcagccaaacttccttagaaagaggacttacctcactgtccctacccctctactctctgactcacttcttagctccatgactgggttctggtttctttcccttgcctgttgtgacttcctatggacacagccaaaaatcatcacatagtcctgttgtatggcatccccaccatcttgaaatgtcctctccctcagttcctatgtgttaccacacacgcctgccttggcttctccctctagttgttccttctctgtcttctgtgggcttcttattgtctgctcactccttcttcagtgtcctctcatgggcttccttcccttctcagctgatgccatcacctggggaatcacagttactcagcagcactggggcctctctatctctatgctggtcatgcctatgtgtgagctgcagacccagtggaatttccatttgtgcatcccatgcccagcccaccctccaccagcctcgaatgcagctgttcagccctaccccagtcctcagaaaagttcctctccctggatcctctttttccttcatgagtgcccggttgcccaagtcaaaaacctgggagtgatataaactccccacacatccagtcagtcactcatcaactctattgattctgtctgctaaatatatctcaattgtattaacttaaacatatgcataatacatcttcttcttcactgcatttttgtgggctgcacttacctttcaggtaacaacaacactggcccctcttgcccttctagtcagaagtgccaaaatgatgagagctagccatgacaaacccacagccaacattacactgaatgtgcaaaactggaagggcatccaaacagaggagggaagagaggaatagacaggaagtcaaactgtctctgtttacagatgacatgtttctatatctagaaagccccatagtcttggccccaaagcttcttctgctgataaactttagcaaagtcttagcatacaaaatcaatgtgcaaaaattactagcagtcctatacatcaagtcaagcagagagtcaaatgaagaacacaatcccattcataattgctacacacagaaaaaataagatacctaggaatacagctaaccagggaggtgaaagatctctaggagatctctagaagaattacaaaacactgctcaaagaaatcagagaagacagaaacaaatggaaaaacatgtcatgctcatggataggaagaattaatgtcattaaaatggctatactgcccaaagtaatttacagatgcaagttatccctattaaattaccaacggcattcctcacagaactagagcaaactatttcaaaattcatatggaaccaaaaaaaagagccctaatagccaagcaatcctcagcaaaaagaacgaagctggaggcatcatgttacccaacttcaaaccatactacagggctacagtaaccaaaacagcatgatactgatacaaaaacagctcatcattttgagctatgtttcttcaatacccagattttttagagtttttaatatggagaggcattgaattttattgaaagccttttctgcttatattgagataaccacatggtttttatctttagttttgttcatgtgatgaatcagattaattgatatgtgtatgttgaggcaaccttgcatcctggggatgaagcatacttgatcatgatggattaactttttgatgtgctgctggatttggtttgccagtattttgttgaggatttttgcattgatgttcatcgagggtattggcctgaagattgtgtgtgtgtgtgtgtgtgtgtgtgtgtgtgtgtatctgccagattttggtatcaagatgatgttggcctcatagaatgagttggggaggagttcctcctcctcaatattttcaaatagttcctgtaaaaatggtaccagctcttctttgtatttctagtagaatatgactgggaatccatcatgttctgggctttttttggttggtaggttatttattactgattcaatttcggagcttgttattggtctgtttacagcaaatcaatttcttcctggctcagttgtgggagggtgtatttctccatgaatttatccatctctttgaagttttctagtttgtatgcatagaagtgtttgcagtagtttctgatggctgtttctatttctgtggggtcagtggtaacattccctttgtcatttctaattgtgtttctttcaatcatcctctgtattagtctgctagcagactttcttattaatattttcaagaaacctacccggaattcatagatcttttgaatttctttttttcatgtctcggtttctttcagttcagctcagattttcagttatttcttgtcttcctctagctttggggttttgtcttgcttctctagttctttcagttgtgatgttaggttattaatttgagttcttcctaactttttgatgtgggatttagtgctataaatttccctcctaacattgtcttagctgtgtccagaggctctagtatgttgtaactttgttctcattattttcaaagagcttcttgatttctgccttaatttcattatttattaaaaagtcattcaggagcatgttgattgatttccatgtaattgcatgattttcagcaattttcttagtcttctatttttactgcactgtgatctcagtatgtatttggtatgatttcagttgttttgcatttgctgaggattgctttatgtccaattatgtggttgattttagagtatgtggcatatgatgatgtgaggaatgcatattctgttgtttttgagtgcagagttctgtaaaggtctatcagatccatttgatccaatgttgagttcaggtcctgaatatctttgttcatttttttgcctcaatcatctgtctaatactgtcattggagtgtggaaatctcccactattactgtgaaacatactttgtaggtctctaagaactttacttatgaatctgggtgctcctgcattggatgaatatatatttaggatagttaggtcttctcgttgaattgaagcctttgccattatgtaatatccttctttgtcttttctattttattttaagttccaggatacatgtacaggatgtgcaggtttgttacatagttaaacatgtgccatggtggtttgctgcacctatcaacctatcacctaggtattaagccccacgtgcattagctatttatcgtgatgctctccttccccctaccttcccaacaggctccggtgtgtgttctgcccctccctgtgtccatgtgttctcattgttcggttcccacttatgagaacatgtggtgtttggtttcctgttcctgtgttaattagctgaagtttatggcttccagcttcatccatgtccctgcaaaagacatgatctcattcctttttatggctgcatagtattccatggtgtatatgtatcacattttctttatccagtctatcattgatggacatttgggctgattccatgtctttgctattgtgaatagtgctgcaataaacataagtgtgcatgtatctttaaaacagaatgatttatatttctttggatataaacctagtaatgggattgctgggtcaaatggtatttctgcttctagatcctccaggaattgccacactgtcttccacaatggttgaactagtttacattcccaccaacagtgtaaaagtgttcctgtttctccacagcctctctagcatctgttgtttcttgactttttaataattgccattctgactggcatgagatggtatctcattgtggttttgatttgcatttctctaataaacactagtgttgagctttttttttcatatgtttgtcggacgcataaatgtcttcttttcagaatgtctgttcgtgacctttgcccatgttttgatggggttgttattttcttgtaaatttgtttaagttccttgtagattctggatattagacctttgtcagattggtagattgcaaaaatattctcccattctgtaggttgcttgttcactctgatgatagtttctttccctgtgcagaagtgcttacgtttaattagatcccatttatcaatttttgcttttgttgcaattgctattgatgatttcatcgtaaaatctttgctcatgcctatgtcctgaatggaacttcctagattttcttctagggttttttacagttcggggtttcacatttaagtttttaatccatcttgagttaatttttgcataagatgtaaggatgaggtccagtttcagttttctgcatatggctagtcagttttcccagcaccatttaaatagggaatcctggccaagtgcagtggctcatgtctataatctcagcactttgggaggctgatgcaggtggatcttgaggtcaagagatcaagaccatcctggccaacatggtgaaaccccgtctcttctaaaaatacaaaaactagctgggcgtggtggctcgaacctgtagtcccagctactcaggaggctgaggcaggagaatcacttgaatccgggaggcagaggttgcagtgagctgagatcatgccgctgcactccagcctggtgacagagtgagactttgtctcaaaataaataaataaataaataaataggtattccttcccccattgcttgtttttgtcaggtttgtcaaagatcagatggttgtagatgtgtggtcttatttctgagatctctattctgctccattggtctgtgtgtctgttttggtaacagtaccatgctgttttgattagtgtggccttgtagtatagtttgaagtcatatagcatgatgcctccagctttgttcttttggcttaggattgtctcgactattcagtctcttttttggttgcatatgaaacttaaagtagttttttttttaattatgtgaagaatgtcaatggtagtttgatgtgaatagcactgaatctataaattaccttgggcagtatggccattttcatgagattgattcttcccacccatgagcatggaatatttttccatttgtttgtgtcctctcttatttccttgagcagtggcttgtagttctccttgaagaggttcttcacacccatcgttagctgtattcctaggtattttattctctttgtaacaattgtgaatgggagttcattcatgatttggctctcttgcctattgttggtgtataggaattgaagaatattgtctattgctggtgtataagaatgcttgtgatttttgcacattgattttgtatcttcagactttgctgaacttgcttatcagcttcaggagtttttgggctgtgacgatgtggttttctagatatagaatcacgttttctgcaaacacagacaatttgattttatctcttgctatttgaacatgttttatttctttctttttttttgaagggtttttcatgtctctgtctccttcagttccactttgatcttagtcatttttttttttctcttctgctaacttttggatttgtttgctcttgcttctctagttcttttagttgtgatgttagggtgtcaatttgagatatgtctagctttatgatgtgggcatttagtgctataaatttacctcttaacactgctttagttgcctcccagagattctggtacattgtctctttgttctcattggtttcaaagagcttcttgatttctgccttaattttattatttacccagaagtcactcaggagcacgttgttcaatatccatgtagttgtgtggttttgagtgagtttcttaatcttgagttctaatttgattgcactgtggtctgagagattgttatgatttcagttattttgcatttgctgaggagtgttttaattctaattttgtgatcaattttagagtgtcatatgccactaagaataatatatagtctgttgtttcgtgttggagagttctgtagatatctatgagattcacttgatccagagctgtgttcaagtcctttctggtcaattttctgcctagatgatccaatattgacaatggggtgttaatgtctcccactattgttgtgtggtagcctgagtctctttgtaggtctctaagaacttgttttgtgaatctgggttctcctgtattgggtgcatacatatttaggatagttagctcttcttgttgaattgattcctttatcattgtgatgttcttctttgtctttttttatctttgttgattcaaagtctgttttgtcagaaactaagattgcaacccctgcttttttctgctttccatttgcttggtaaattttcctccatcgctttgagcctatgtgtgtctttgcacatgagataggaaccctgaatacagcacacctgaatcttgactctttatatccaatttgctggtctgtgtcttttaattggtacatttagcccattgacacttaaggttaatatggttatgtgtgaatttgatcctgtcaccatgatgcttgctggttattttgctcactagttgatgcagtttcttcatagtgtcattggtctttgtacttcagtacatttttgcagtggctggtaccagtttttcctttccatctttagcacttccttcaggaggtcttgcaaggcaggcctggtggtgataaattccctcagcatttgcttgtctgaaaaggatttctccttcacttatgaaggttagtttggccagatatgaaattctaggttagaaattcttttctctaagaatgttgaccattggacccaactgtctcctggcttgtggggtttctgctgagaggcccactcttagtcagatgggcttcccgttgtaggtgacctgccctttgtctctgtctgcctttaacattttttccttcattttgatcttggagaatctgatgactatgtgtcttgagggttgatcttcttgtggagtatcttactggggttctctggatttcctgaatttgaatgttggcctgtcttgctaggttggggaagttcttctggatgatatcttgaagtgtgttttcccaacgtggctccattctccttgtctctttcaggtagtccaatcagtcataggtttggtcttttacatagttccacagttctttgaggttttgttcattccttttcattcttttttctctaatcttctctgcctgccttattttggcaagacagtcttcaagctctgatattcttttttctgcttgatcaattcagctgttgatacttgtgtttgcatcacaaagttccccttatgtgctttacagctggctctggtcatttatgttcctctctaaactggttattctagttagcatcttctgtaatcttttaacatggttcttagcttctttgctgacagaagtagggttcagaaggtgggtaataacaaatttcacagagctaaatgagcatgttctaacccaatgcattgatttctccacctccctttcagggatgccagtgatttgtagaattggcctctatatataaccccatacttattggaggttttcttccttccgttttattcttttttatttttgtctgtcttattttagagaaccaatctttaagttctgggattcgttccaatatgttgggttagagcgtactcctttagctcagtgaagtttgctactacccaccttctgaagcctacttctgtcaattcatccatctcaacctccacccaggactgtgcccttgctgtagaggtgttgtgatcatttggagtaaacaagtcactctggccttttgagttgttaggggtttttcattcctttctcatcttcatgagtttgtctcattttgatctttgaggctgctgacctttagatgaggttttcgtggggactttttggttgatgttgttgttgctttctgtttttctttcgacagtcaggtacctcttctgtagggctgctgtggtttgctggggattcacttcaagccctatttatctgggtccctcccacacctgaagatgtcaccagagggtgctggagaacagcaaagatgggaccccactccttcctctgggatctctgtccttgaggggcacccacctgatgccagtagaaatgctcctgtataaggtgtctggtgacccactggggtgtttcacccagttgaggggcacaggatccaggacttgcttaatgaagcactttgattgtccctttgggaagggggtatgctgtgccggggaaaatcccactcatctgggctgcctggaatcctcagagtgagcagggggaaagaacaagtcttccggtttgtggagacaacagccagccacccctcccactagggactcagacctagagagatcagagttctctccctaattccctggcttgagttgctggagttcctgcagggaggccccacccagtgaggagggatgggtcagggtcagcctaaagaggcagtctggccatgatctgccacagccagtatgctgcgctgtggggaatacctcttgggaccaagccgtccagtcttcctggcatcagcaaaggaaaaacagcagcctggatctgtagaaatggctgccgcccttcctccccaggagttcagtgtcttaggcagctagcagccacagtgatggctgctgtcccttcttagggagctcagtttcctcaggcagcaggcagctgcagtgatgatgactgcccctctcttgggaagctcagttgtcttaggcagccagcaaccacagtgatgattgctccccctcccccagggaactcagagggtttaggcagcaggcagccacagtgatgatgaccacccctccccaacttgggaactcggtagttttaggcagactccagctgagtggctgttgagaatctgcatggctctgtggttggcacccaaggccctcgtggtgtggtctcatgagtgggatcttctgatctgtggattgcaaagatccatggaaaaagcagtttcccaggctgggtagcatgctcactcactgcctcccttggctggctgagggtgacggctccccttgccccatgtggctcccaggtgggccaatccaccagcccatctttccttgttctctatgggtcacggcaaccacctagtcagtcctgatcatagaacctggatatgtcagttgctggtgcaggatttgcacactcttttagttcttctcagtgggagcctcaaactgcagctgcttctagtcggctatcttgcccctgcccccttgtccttttgaaaaattattgttcatttgaaatctgttttgtctgaaattaggattgcaacctctgctttttttctgttttctatttgtctggtagatttttctccatccttttagtttgagacgatgagtgtcattatgtgtgagatgggtctcttgaagacgacataccattgggtctcactttttttttttttaaatctagcttgccactctgtgccttttaagtggggcatttgcccatttacattcaaggctagtatcgatttgtgtagatttgatcttgtcattgtgctgttggctggttattatgttggcttttttgtgtggttgctttatagtgtcaccggtctgtgtgtttaagtatgtttttgcattagcgtgtagtggtctttcctttctatatttagtcctcctttctaaaatctcttgtaaggcagatgtggtggtaatgaattacctcagaatttgcttgtctgtaaatgatctcatttctccttcatttagaaagcttagtttagctgtatatgaaattcttggttgaagattttctttaataatgttaaatatagtcccccaatcccttctggcttgtaggatttcagctgagagatctgctgttagcctaatggggttccctttgtagatggcctgccctttctctctggctgcctttaacatattttccctcatttcgaccttggaaaacctgatgtttatgtgtcttgaggatggtcttgtgtagaatcttgtaggagttctttgtatttcctgaatttgactgttggcctttctagcaaggttagggaagctttcaaagatgatatcctgaactacgttttccaagttgtttgatttctccacctccctttcagagatgccagtgatttgtagaattggcctctttatataatcccatcctccttgaaggttttgttcattcttttttatttttgtccatcttattttagagaaccaatcttcaagttctgagattcgttcctcaggtttttttttctgctgttaatacttgtgattgcattgtggaattcttgtattgtgttcttcggcgctttcagatcggttaggttcttttttattataccagctactttatccttcagctcctgtaacactttactgttattcttattttccttggattgggttttgccattctcctgagtcttgatgattttttttcctatccatattctgaattatatttatgtaattccagacagttcatccaggttaagaactcttgttggagaactggtgtggttgttagaaggacatatgacacagaggccatttgagttactggagttcttgcattggtttcttctcatttccacctatgggttttcctttaattgcagtgtagattgagtacagtccgtagacttattttcggatgttttcaccaggctgaggctttgtgcagggtctttatttgaagctgacttctcatttctggtttcagaggggagtatattagtaaggtatttttgatgctgaagctttgggatgtgatccagtaggtggcacttgggcttactggtcagttggtagactcttgcttggtcatgtggctcccctatgtttccttacagttgcagccatgttccctctcaatgatctgaaaatgtgcttctctcccccttgagtgctggctgtaggtcatggcttggcactcctaggctgcccactgcagctctggggcaatctcagtgtttatatttctttcctaactttgaggcagaagaggaagggacattagtagtggttgtagccaagggtcttttgtttgtctcctcagagttccaccacccctggagaatacagcaactgtttactgcaatcagcaatcaggatggagaattcgtgctgtgggggccaatccaggggttccctgtcatgagcagtggggagtgtgtagaacccatgagagatgggctttggtcaattaaagcttgttgaaggtgtagataagggtgttagctccttcatcagtctgagggtagcaaggacagttccactgcagaagcagtggcagagaggctttcagttgcccctggaggctctctccagggagtggctgagttgctactggctcaacagttctggtagggggggttaggtagaggtccaggcctgcaagacttgcctagtgagaagatataggaatgggaacccaggtaacagtctggccacttttccatagggctgctgcagtatgcccagggcccgctccagtctctagtagcctcagattttccagtacctggagttatcatcagtgaagcctgtgaaacagcaaagatggcagcctaccgctccctttggaagctttgccctagggaggtatgaatgaacttgttgctggcccaaacacacctgtaggaggtggctggagaccccagtttggaggttttgcccagtgaggaggaatggcattgggaaagtgcttaaaaaagcagtctggcctcatttttatagagcagctgtgctatgctgagggtccacatcaccccctggtctccttggacactccaaagactgaaggttgaagtggctaagttgcaaaaacagcaaagatggtggcctgcccctccatcagggagctccagcccagaaaaaattgaaatcactgtcagcaggagaacaccagtgggggtggttggaggccccagttgggaagtcccaaacagtgaggaggaatgaatccgggacctacttaaagaagcagtctggctatgcttttgtacagcagctgtgctgtgctggggggccatatccgccctaagtcagctgggactccttaaagcccaaaggctggaatggctaagttgccaaaacatcaaatatggcggcccacgcctccctcagggcactccatctcagggagaattcaaatctctgtcagcctgagaataccagagtgggtagctagaggccctggttgggaggtcctgcccagtgaggaggaatgggattggggaccttcttaaagcagtagtccggccatattttggtagagtagcactgtgctgtgctaatggatccctctgtccctggtccgctgagactctccaaatcccgaaggctggagcagctaagttgcccaaacagcaaagatggtggcctaccccttctctcaggagctctgtctcagggaggctcaacactgttgctggtggctggctggaattccaagccagtggctcttatcctgtgaggtgctgtggaagtggggcctgcaggctgttgctgctcagctccctgaattcagcctcttccctagggatatgtatgagggtctcacctcccactttgccacagttgcagctacttttgcaggaaagcccaggtacctaaggctcccaggtctccatgtgtgcctgagtggctgctgtgccaagattccacgtagctctgtcagactgaaggccctggtaaagtgggttcatgagaactctcgacccaaggattgcaaagatccatggaaaaagcatgggtttccagggtcacacattcactcactgcttccctgggtgagagagctccccctggctctgtggtactcccaggtgggctgtcgttttgcctttcttttcttcattctccctgggtcaagttgtttccttggttagtcccaatgtgagtacctggatgtttcagttgaaggtgcagtattgactctccccttgtgttcctctctgtgagagccaaacacactagctgcttcaactcggccaccttggccagcccactgccccctcactgctatatttttacatataacatttacaactctataaagtacttcattgtactcattttacaggcgaagatagtttagacacacaaagactgaataagatctaagtcctttccttgtaagatgcaaaatctggaattgacaatgtacataactgctacgtgtctcaaacctaagatgtaattaggcatttctaaagctcacactttttaaatgtttaaatattttgttagagttttaaagaatgatttagttaaaaaatacgattatgggggtgtgtggccaagatgactgactagaagaagctagggtgcacggctctcatggagaggaatgaaaagggcaagtcaatacagcaccttcaactgaaacaaccaggtactcgcattactcacataatcaaggaaacaactccagccagccaccagcaacagtgttttacctacctgagactgacttcctaggggacagggcaggccaccatctttgttgtttgggtaacttagccattccagcctgttgggcttttgagaacccaaaccaactgagggcagaagggatcccccacgcagcacagctgctctaccaaaatgtggccagactgcctctttaagtggatccccaatccattcctcctcgctgggcgggacctcccaactggggcctgcagctactcctgcaggtgctctcaggctgacggagatttgaattctccctgggatgagttccctgggggagaagggggccgccatctttgctgtttgggtgactcagttattccagtctgtgggctttggagagtccaaagtgactagggtggaggggatccccagaacagcacaactgctctatcaaatcatggcaagattctttaagtagatccccgatccgttcctcactgggtgagacctcccaagtggggcttccaccccttagttctagagctgacagagatttacattctcccttggatagagttgtcaaggtcctaccaattaagaagaaatgggtcaggaacctgctaaaagaatctgcctgaccaagattttgtagagtagctgtgttgtgctgggagatcccttctgccccggtaggtatggattccacaaaaccctcaggctggagtggctaagttgcacaaacagcaaagatggcagctcatctttggccatttcatcccaagaattcaaatatctttgggcccgagaacaccagcaggagtgactggaggtcccagtgcggtgatccctcaccaggcaggactttgagaccgccatgccagggataattgaaatctctggcagcctgaggacactggaggagggggtggggtggtggctgggggcccgagttgaaaggaacttcactgggcaggaactggagacctccatgccagggagaactcgaatctctgtcagcatgagaacacaggtaggggtggccggagggcccagttaggagaaccctcactgggtgggacctcaagaactccatgctagggaaaattcaaatctctgtcagccccaggacactggcgggggtggctggaggccccatatgggaggtccctcactgggtcagacaccgagacctccgtgccagagagaattcacatctctgtcagccccagaacactaccggggtggttgcaggccctagttgggaggtcctcactgggcgggaccccgagacctccatgccagggagaattcaaatctctgtcagccccagaacactggcaggggtggccagagaccccagttgggaggtcgctcactgggccagaccccgagacctccatgccagggagaattcaaatctctgtcagtcccagaataaaggcgggggtggccggaggccccggttgggaggtccctcactgggcgataccccaagacctccatgccagggagaactcaaatctctgtcagcctgggaacaccagtgggggtggctggacaccgcagctaaaaggaccctcattgggtgggaccttgtgaattacatgccagggagaattcaaatctctgtcagcctgccttgtgaattacatgccagggagaattcaaatctctctcagcatgagaacaccagtggggttggctggaggccccgcttgggaggtccctcactgggcaggacctcaagacctccacactagggagaattcaaatctctgtcagccccagaacactggcgggggtggctgcaggcccccgttgggaggtccctcactgggcaggaccccgatacctcgatgccagggagaattgaaatctctgtcagccccagaatattggcgggggtggggggagttggctggaggcctgagttggaaggaccctcactgggcaggaaccggagacctccatgccaggaagaattcaaatctctttcagcatgagaacacaggtgtgagtggccagaggtctcagttaggagaaccctaactgggtgggacctcacaaactccatgcctgggagaattcaaatctctgtcagccccagaacaccagcgagggtggctgcaggccccggttgggggggttcctcactgggcaagaccccgagacctccatgccagggagaactcaaatcactgtcagcctgagaacaccagtgggattggctggagaccccagctaaaaggacactcattgggcgggaccttgagaactacgtgccagggagaattcagatctctgtcagcccgagaacaccggtgggggtggctggaggccacggttgagaggtccctcactgggcaggacctcaagacctccatgccagggagaattcaaatttctgtcagccccaaaacactggcaggggtggctggaggccgaagtccttcactgggccagacgctgagacctccataccagggagaattcaaatctctgtcatcccaagaacaccggtgggggtggctggagacccaattgggaggtcactcacttggcaggacctgaagacctccatgccagggagaattcaaatctctgtcagccccagaacactggcggggttagctggaggccccagttgggaggtccctcactgggccagaccctgagacctccattccagggagaattcaaacctctgtcagccccagaacactggcgagggtggctggaagccacggtagggaggtccctcactaagcaggacctaaagacctccatgccagggagaattcaaatctctgtcagccccagaacactggtggggttagctggaggccccagttgggaggtccctcactgggccagaccctgagacctccattccagggagaattcaaatctctgtcagccccagaacactggcaggggtggctgcaggccccagttgggaggtccctcactgggcgggaccccaaggccgccatgccagggagaactccaacctctgtcagccccagaacaccagtggggttggctggagaccccagctaaaaggaccctcattgggtaggacctcaagaactaagtgccagggagaattcgaatctctgtcagcctgagaacaccaggggtgggtggctggaggcctgaattgaaaagacccacagcggacaggaagtggagacctccatgtcaggaagagttcaaatctctgtcagcatgagaacacaggtgagggtggccggaggccccagttaggagaacccttactgggcgggacttcaagaaccaagaactgcatacctgggagaattcaaatctctgtcagccccagaacactggcgggggtggctggaggccccagttgggagatccctcactgggcaggacctaaagacctccatgccagggagaactcaaatcactgtcagcctgagaacaccggtgggattggctggagaccccagctaaaaggaccctcattgggcgggactttgagaactaggtgccagggagaattcagatatctgtcagcccaagaacaccggtgggggtggctggaggccacggttgagaggtccctcactgggcaggacctcaagacctccatgccagggagaattcaaatctctgtcagccccaaaacactggcaggggtggctggatgccgaggtccttcactgggccagaccctgagacatccataccagggagaattcaaatctctgtcagcccaagaacaccggcgggggtggctggaggcccgattgggaggtcactcacttggcaggacttaaagacctccatgccagggagaattcgaatctctgtcagtcccagaacactgacaggggtggttgcaggccccagttgggaggtccctcactgggtgggacctggagacctccattccagggagaattcaaatctctgtcagccccagaacactggtgggggtggctggaggccccagttgggaggcccctcactgggccacaccccaagacctccatgccagagagaattcaaatctctgtcagccccagaacactggagggggtggctggaggccccagttgggaggtccctcactgggcaagatcctgagacctccatgccagggagaactcaaatctctgtcagcctgagaacaccggagggggtggctggggaccccaggtaaaaggaccctcattgggcaggaccttgagaactacgtgccagggagaattcagatctctgtcagccctggaacaccagcgggggtggctggaggccatggttgggaggtccctcactgggccagaccctgaggccttcatggcagggagaattcaaatctctgtcagccccagaacactggcaggggttgctggaggcctcggttgggaggtccctctcttggcaggacctcaagacctccatgccagggagaatccaaatctgtcatcctgagaacactggcggggtgggcatagcaaggtgctctaccaaaatgtggccatactgggtctttaagaaggtctgtgatccattcctcctcactgggcgggacctcccaaccgggcctccagccacccccaccagtgttctcgggctggcagagatttgaattctccctggcatggaggtctggaggtcctgcccagtgaggcacctcccaaccggggcctccagccacccccaccagtgttctggggctgacagagatttgaattctccctggcatggagttctggaggtcctgcccagtgaggcacctcccaaccggggcctccagccacccccgccagcgttctggggctgacagagatttgaattctccccagcatggaggtctcgaggtcccgcccagtgagggacctcccaacaggggcctccagccacccccgctggtgttctcaggctgacagagatttgaattctctttgggatggaggtcttgaggttccattcagcgagggacctcccaataggggccttgagacactcccgccagtgttctggggctgacagagatttgaattctctctggcatggaggtcttggggtctggcgcagtgagggacctcccaactagggcctccagccacccctgccagtgttctgtggctgacagaggtttgaattccccctggtatggaggtcttgaggtcctgcttagtgagggacctccctaccgtggcttccagccaccctcgccagtgttctggggctgacagatatttgaattatctttgggatgcggttcttggggtcccttccagtgagggacctcccaaccggggcctccagccacccccaccagtgttctggggctgacagagatttgaattctctctggcatggaggtcttggggtctggcccagtgggggacctcccaactggggcctccagccacccccaccagtgttctggggctgacagagatttgagttctccctggcatggaggcctggaggtccagcccaatgagggtcctttcagctggggcctccagccacccacaccggtgttctcaggctgacagagatttgaattcctggaatgagttcccacgcgcaagagcaaggagccatctttgctgtttgtgcaacttagtcgttacagcccgcgggctctggagaatccatacctaccggggcagaagggatatatcatcagcacagcacagctactctacaaaatcttagaaggcagattcttttaccaggttcctgatccattcctccttactgggcaggacctcgacaactccttcccggggagaatgtaaatctctgtcagctcgagaacaccggtggggtggtggaggccccaggtgggaggtcccacccagagaggaggaaagaatcagggatctgtgtaaagaatctgcctggccactatttggtagagcagttgtgatgtgctgggggatcccttccacccccagtcatttgggactctccaaagctggccccatcctctcccccaggccccagttggaaggactcccactgggcaggaactccagaactccctcccagggagaattcaaattcctctcagccccagacaccagtggggtagctggaggccctggttgggaggaacagattgggaatccccttaaagattctgtctggggccggccacggtggctcatgcctgtaatccccatacttcgggaggcccagcagggtggatcacttgaggtcaggagttccagaccagcctggccaacatggtgaaaccccatctctactaaaaataaaaaaattcgctgtgcgtggtgatgggcacctgtagtcctagctacttgggaggctgaggcagaagaactgcttgaaccagggctgtgatgggtgctgtaagccgagatcatgccactgcactccagcctgggtgacagagcaagactccttctcaaaaaaaaaaaaaaaaaaaaaaaaaaaaaaaaggatctgggcacatgttgggagagcagctgtgctattctagggatcccttctaccccaccagtttgcactgtccaaagcccacaggctggaatggctgtgtcacccaaacagcaaagatggcggccagctcctcccctgggaaactcatcccagggagctccagcatccttggcacaagctggcaagtattggctgaaatgacaggtgccctggagaaatttgaaagggttatccacatccggctgctgattattttcacaattttcctgagatgtcgttatcattctttgactctcctttctatagtcagacatttggctctcagaggtgactttctggctgaagaatgtggattcgtcactgtcttgtgctcaatgtagagggggctcttaattccagaaatgtccatatctgatgaaagaaagcgaagaatgaaacaaaaagagatatgtaccgtattcataagtagattcaatgctcttaattccagaaatgtccatatctgatgaaagaaagcgaagaatgaaacaaaaagagatatgtaccgtattcataagtagattcaatgctattaagatgtcagttctttccaatgtatagattcaatgcaattctactctaaatgaaaatgtttatatggagaggcaaaagaccttgaatagctaacaccatattgaaggagaagaacaaacttggaggacagacactactcaatttcaagacttaccctaaagctacagtaatggagacagtgtggtattagtgaaagaacaaacggataaaatgagatagagagttcacaaatagaaacacattaatacattcgattaatttttgacaaaaaagtaaaggcattatgatgatgaaacagttttttcaggaagggctgctggaatacctggatatccacatgcaaaaaaaaaataaattgcagaccttacacccccaccaaaattaactcaaaatggatcagcaacataaatatacaaaaaactataaaatttatagaagataatatagaaggaaatacagattatcttgggtttaatgatgacctttagaaaaaacaccaaagttgaagtcaatagaagaaagaattgacaagctggacttgatgaaaatgtaacatttttacaccattaaagacactgaaagaaaagagaaaccacagatggaaaaaaatttgccaaaacgtatctgattaagaactattattcaaaacatattagtattcttaaagctgagcagtaaaagacatgagctaaagaccttaacaagtacctcaccaagtaaattatacaaatggaaaataagcatatgtaatgaggctacacataatatttcctcagagaaatgcaaccatgagatgccactgcacacgtattagaataaccaaaatctagaaccactgacaacatcaaacgctggcaaggatgtggagcaagaggaaacttcattcattgcttgtgggaatgcaaaatggtgcagtcacttcttgaaagttgtattctatgtacctcaacagcatggccttcactgttcatattcctattatcattttggtcgaccacttaaccaaggtctaattaagttccacaagtttcctcatcttcctgtcttctttgcctattacccagttccaaagcaaattctgcattatcaggtgtttttatagcaaaaccccactccttggtactaatttctgtgttagcaacacagaataacacagaaaagagcaacacggaaaaacacaaatttttgtgttgctataaaaaaatagctgagactaggtaataaggtataaggaacaggtataagactaggtataaggaacagaggtttgtttggctcacagttttgcaggctgtagaagaagaatggcagtggcatctgcacagcttctggtcagggacccagaaggcttttacttgtggctaaaggtgaagagacaacgggtatgacacacatggctagagaggtaggaagagaggggagaggtgccacactgttttaaacaaccacctttcgtgtaatgcagtgagaactcactcattagtgaaaaaagggcaaaaagctatccaggagagatcaaccaccatgacccaaacacctcccactaggtcccacctccaacattggggatcaaatctcgacacaatatttggagggtacaaatttgcaaacaatatcactctctttttgtctttaactttggacaatttgattatagtgtatcttgttgtgagtccctggattcaccttatttggtttcctttgggctttctggatcaggctttctgttttcttccccatgcttgataaattctctgtcattattcctttaaacacttttccgttcctttcttcctcacttctccttcaggcatgccaataatgtgtgagtggtcctgcttgatggtgtcccataactctctaaagttgtcttcactccgtttgcattatctttttttctgatcctcaggttagataatttccagtgaccagtctcaaagttcactgatagattctattaatggacacctctattaaattttttcagttcagttacagtacactttagatctatgatttgtttgacattattgtataacgtttttccttttcttgaagttctcaacttgttcttgcaaagctatcttgacctcagtgattattgttatgaccattatttggaaatctctgtcagataaattacatatctgcacttcactcaggtgctggagatttatcttgttttcttgctttgaatatatttccctgtttcttcatttttcctcgactctctctgttggttcccgtgcatttgataagactggcctcatgtaggaaaaggatctcaccaaactttccagccagagatcttcaggtacctctcaagtccttgtgtgctctagtattgactgtttttggtggctccctggaacttaggatgtgccacgccttgtcagtaaccagaaattggttaaggtaggagccagacaatccagatgtagctagaaagttagaaggctggaggagtgtttcagttctttctagctacatgatgaagattagtatggacatttatctcccactctctctccattaagcttggtagaggatctgtgacaaacacctatgcacactctggatgcagcctctgatcctgaggagatagcttctgaatgtgggcccattgtatgcttacttctttgttttctatggtctaaatacattcaaaaatacaaaatcctgtcgactcacagagcagagttcttaagaaaacagttccttgggcactaaccacggaggttgtagaatttcaatgcataatcaagctccttctgggagcttgattcaatgcataatcaagctccttccgggaagaatgggtaggcttggatttattactgggttgaacccgacataagactggtagtgtcaaactatggttccatctgccagatgaattatactttgtaagccacattagcccccatgatgccagtatttaaatacaaagctagaaatgattaatagggtgagaaaagcatgttgaaagctcagataggctgaaagctaggcaacttacatcaaacagtaaactaagctgtgaatgcaaaaaaaaaaaagttcttaaaggaaattaaacagactactccagtgaatgcacaaatgataagtacaatggtattattgctgatgtgaagacagttttagtggtctggatagaaaatcaaatgagccacaacatttcgctaagccaaagctgaatccagagctaagccttagtaacattctttaattctatgaagtctgacacaggtgaggaggctgcagaagacaagtttaaagctagcagaggttggttcatgaggtttaagaaaagaatcttcataacataaaagtgcaaggtaaagcagccagtgctgatagagaagctgcagcaagttatccagaagatctagctaagatcattgatgagggcagttatgctaaataacagattttcaatgtagacaaaacagcattatactggaagaagaggatacctaaaactttcacagctatagaggagaagtcaatgcctggcttctaatcttcagaggacaggctgactctttatgtactggctaatgcagctggttacattaaaacattaaaggcagtactcatttaccattctgctacatttttaagttcttctaaacctatgctacctatactctataaatgaaacaacaaagcctggatgaaaacacatcgtttacagtatggtttaccaaatatcttaagcacactgttgagacctattgtccagaaaacgtgtgtgtgtgtgtgtttgtgtgtgtgtatacgtgtatgtgtgtgtatgtatatatgtgtgtgtatatatatatatatatatatatatatcttttaaaatattactgctcattgacaatgcactcataacccaagagctctgatggagttgtacaaatagattaatgttgttttcatgcctgctaacacagcattcattctgaagcccatggatcaaggacattttattatttaagaatacattttgtaagcctatacctgccatagacaatgattcttctgtgtatctgcacaaggcaaattaaaaatcatctggatttttttagaaagcaatcactattctagatgaaattaaagatatttgtgattccttggaggaggtcaaaatatgaagtttggaagaaattgatttcagccctcatagatagcttgcagggtttcaagacttcagtggaggaagtaactgtgagtgtgatggaactagggagagaactaagagtaaaactggagcctgagcctgtgactgaatttctgcagtttcatgatcaaacttgaatgtactaaaagttgtttcttatagcccatccatctgagatggaatctattcctcgtgaagatactgtaaacactgttgaaatgacaaaaaaacacctatcttattatacaaactgagttgataaagcggtggcagcattagataggatcgactctcattttgaaaggtgttctactgtgaggtaaaatgctatccaacagcatggcacactacagataaacctttcatcaaaggagtcaagtgatgcagcaaactttactgttgttttattttaagaaatcgccacaaccacctcaatctgcagcaaccaccaccttaatcattcagcagccatcaacacagaggaaagactctttatcagcaaaaattaaaattcactgaaggctcagatgatcatttgcatttttagcaataaagtagtttttaaagtatgtaattgtagacataaggctattgcacactttatagactatggtatagtgtaaaaaacttttatatgcagtgtaaaaccaaaaattcaagttcttattacattgtggttgcctggaatcacacctgcaatatccctgaagtatgcctgtacaagaaatcatggataacatactaaaataaatttgggaaacaattcattaacagaatgatagttctgaagtagaaatagatatgataacaaaaaaacaaatagaaattctagatatagagaatacaacaaactaaaaatttaatacaatgcttcagcagctgattttattagcagaaaaaaagaatcagtgagcttaaagaaaaaacatttgaaatgattccatcggggaaaaacaacaacaaaaaagaataacaaatgcctatggcaattatgggactcaatcaaacaacccaactttcatataatatcagtttctgaaggagaagaaaaagaaaaaggcctagaaagcatatttaatgaaataatgactaaaaatttcccaaacatgaagaatgatgacaacattgaggtatgaaaactgcagaggtcatgaatccatttcaatccaagaggcatttatcaacacacatcacaatgaagttattaaaaatgaaaaacaaagaatactgaaaacagcaaaaaaacaagaaatacatcacattcaagggagcttcaatatggctttcagtggatttctctgcagaaaaccctacagtccacgagagagggatgatgtattcaaaatgctaaagcaaacaagcaagcaaacaaacaaaaatgccaatcaacaatactgttcccggttgggtgaactggctcatacctgtaatcacagcagtttgggaggccaaggcaggtggatcaggaggtcaggagttcaagaccagcctggccaacatgatgaaaccccatctctactaaaaatacaaaaattagctgggcatggtggcatgggcctgtaatcccaactactcgggaggctgaggcaggagaattgcttgaacctggtaggcagagatggcagtgagcaagcttgaacctgggaggcgagatcacaccgctgcactccaacctgggtgacagagcaagactccatcttgaaaaaaaaatgctgtgcctagcaaagctgtcctgtagaaatgagggagagggagatataaaaacctttctatacaaaaaaaaactaataaaatttataatcaatatccctgattgatcagaattactaaaggaagagccttgcattgaaataaaaggctaaatagtaagaaaaaacacataaaagtaaaaagcgtcaatgctatcagtaatacacagtcatgttccaaatgctctaatattctaagggtggtttgtaaagcaattttatccctactagtagggttagcagacaaaggtattgaaaataactgtagctacaataaattgctaaggtatataagtatgaactaaaagggtaagttttgacataaaattgtacaattgtaagggagagagaatgaaaatgtagacttttggatgcaattaaagagaagttgctatcagaagttgttagagtagtttgttataagaatatgatattttaggtaagtttcatgataaccacaaaacaaaacctatcataactgcacaaaataaaaaagtttattttgcaatttatccaaaattttaaagcataccaccacagaaagccatcaagctataaaatagttcagcaagagagaaaaagggaacaaagaactcataaaacaatcagaaaaaaaattacaaagtggcagtagcaagtccttccctataaataattaccttgatagtaagtgcattacattgtcaaataaaaggacatagagcatctcaatggatagaataaaaaacaagattcaatcatgtgctgcctacaagagactcactttaccagtcaagacatatataggctgaaactgaaaagatgaaaaaagatattccatgcaaatgcaaactaaaatagagcaggggagctatacttactattaaaagaaataaactaagtcaaaacctataaaagagatagggttcactgcataacgataaaggagttaattcatcatgaagacataatacatgtaaatatatatgcactcaaggtcacaagacctaaattcataaagcaattattaaataatctcatgagaaaaatatactgcaatactataatagtaggagacctcaatactccaatttcaaccatggaaagatcatttagaaagataataaattaagaaacattagatttgaatcacactttggagcaactggatctaacagatatacccagaacatcctatccaacagcagaagtgtacctgttcttctgaaatgtgggtggaacattctccagtatatgtcatatgttaggccacaaaacagatcttaacaaatattagagaattgaattatagaaagaaaatttttgcatcccaatggcataaagctagaaatccgtaacagaagaaatcttgaaaaatacataaaatagcaaaatttaacatattcataaatggcccatgagttacagaaaaaatttaaaaacatattttaagacacacaaaaatgaaaacacaacataccaaaacttacagaatgtagttaaatcaatcattatacctcaatgaactagatgagaaacaaagccaagaattagcagaaataagaaaatagcaaagattaaagtggaaataaataaaatagatatgagaaacccaatggaaagaattaatactgaacttctttttaaggcgataaacaaaatcaaccaatccgtatctagactaactagaaaaaggactattccaacaaataagatcagaaatgaaataggagaaattacaacttttaactctaaaatacaaaggattacaattgttcatataatgaacatttgtatgccaacaatttggataacatggaagaaataaaaacatttccacaaacatacaacttaccaagactgaatcaagaagaaacagaaaatctgaatggactaataaataataaggaaattgaagcagaatttttttttttttgaagcggagttttgcttttgttgcccagggtagagtgcaatggcacagtctcagctaactgcagcctccgcctcccaggttcaagcaattctcctacctcagccttccaagtagctggggttacaggcgcccaccaccacacccatctgattttttgtatttttagtagagacagggtttcactactttggctaggctggtctcgaactccagacctcaagcaatccacccacctcagcctcccaaagtgctaggattacaggtgtgagccaccaagcctggcctgaagcagaaattaaaagcctcccatgaaagaaaagcataggaccagaaggcttcactgctaaattctgacaaacctttaaagaactaatactaattactctcaaactctttcaaaaaagtgaaatagaggaaatacttccaaactcattttattagggtaccatcattccgataccaaagacagacaaggacactacaagagacgaaaatactaggccaatgtcagtaacgaaccctgattcaaaaatcttcaacaaaacattagcaaccaaatttaagaatatatgaatggaatcattcaccatgataaagtgggatttatcctttggatgcaagttggtttcaacatatgcatatgaatacatgtgataaaatgcatgaacaaagtcaaagacaaaaatcatacgattctctcaatacatgcagaaaaagcacatgacaaaatttaaaaccctttcatgatgaaagctctcaacaaattaagtgtagagaaaatgtatctcgacacaaaaaagaaccgtgtatgacaagctcttagctaacattattctcaacagtgaaaagtggaaagcttttcctccatgttcagagacaagacaaggatgaccagtctcaccacttcttttcatcgttaacagtggaattcctaggcagaacaattagacaagaaaagaaaagcatcctactcagaaaaaagtgaaattatctctaattgcagacaacatgatcctgtatacagaaaaccctaaatattccaccaaaaactgttagaactgatgcatgaattcgataaggtttcaggatacaaaataatctaacaaagatcagaagtgtttctgtatacaaataacaaactacctgaagaaattttttaaaaatcccaagtatgatagcaacagaaattaaatacttaggtgtaaatttaagcaaaaaattaaaggtcctgtatatgaaaaactataaaacaccaatgaacaaaaatttaaaaacacaagtaaatgaaaaaaaaattcatgcttgtggatgggatgaattaatattgtgaaaatgaacaaaataccaaaagcaacatatttgatgcaatcactatcaaaattccaatgccattcttttacagaaatggaaaaaaatcttgacatttgtattgaacagacctaaaatagacaaaataatcttgagcaaaaagaacaaagctagagacagcatgctacctaattttattacatactgtaaaacaattgtaatcatggtagtggcatataaatggacaaatttgctaaacaaaatggaaaacccagaaataaatccacacacgtcaacttatctttgacaaaggtgccaaggacatacaatggttaaaggatagtctgttctacaaatggtgttgagaaaactgaatatccacaggaaaaataaagttagtcccttaacttacaccacatactaatatcaactccaaatgaagatttaaatagaaggcctgaactgtaaaattactagaagaaaacatagagttaaagctccacaacactggtctcagcaatactgtttttgatgcaaccctgatagcagtcaacaaaagcagaaatagacaaatttcttgtggcttagttttgaatttctggtcatttactcaatctggtcattactttcccacacttcatggttacaagtaccagccaagacatggatccaccttcctactgcagtatctgaaaatcactgtctgttctatcctcggcctgaccctctctggcattctcgggatctacattttgatggaaatgtaatgctctggaaccctaggcatatatgaaccagaaacatgtatgcagactctacttaccgacagcaacatagttggaaatacagtaatcacagttggataggaacaaatattttatatctctttcttagagatctggattccactaaaacggattcatggatgtcagggcattaggggtgtggactgataacaaacctctcctttttcagtgccaaaccaacttagaaataaaaacaaaaggtcagatcaatatccaaatacattattcctcctaaagctgatttagaaactatggcttaatgttgaccaaaaaagacttctaatattgccccctagccttgactttagaacctgaacaaaaaaaagttcatctgaagaacagtcagttacccacccagtgcagggagggtcttcacctgccttccaagtctcctgttcagaatccagaggagaaagagagactagatgtactcattgatcactgagtaagtttgccttactaataggcaaacgtggaccaatggatttgatgggaccaatggataagatttcccatccaccaaataagtcacatcttctcctggctctgggaatgagccagataaaggtgaagagttggcagtgtttctactcaatatttgtgagaagaccgaaggtgttgtcaatgggtagatagaactggaatgaggtgggaaagttttactcgtttgaccaacttctttttattcaagttgtatatgctgaaggtagccgctagaagaattgacttctggaaagatgattcccctcacaattgcttgatcttgagtatttttatttttgtgttaaagaactgatgttggtttgtgtacactgaaataatggggggaagctctgtatggaaggaaaagaaagtttcctttcttttctagagccgtctgttcaggttatcggagtctccctattcatgggatgagtgtccacaacaaactccacaatcctgtgtctgctcattgaaggtatgtatcagagtgacacttggaagcatggtataaagaggaaatatgcatttgtcaaatgaaaaattaaaatataagaaaaagtttaaaaggaaaaacagaatgagaagggcaggggcttgattagagttttgtcaactgggacaaactttgcagttttagtcaaatattgccatctttctagtggaagactttgacatgtaagttctagattatactttcatttataaataactgtgtagcttaatgagatggcccctgttagtatcttaggccatctattgaaggtttactaaattcttccaaggcacgtgagtctgctcctcagcaaagcagtgacaaacctgcttttccctggtttccccaactatgtaaaaccttattaaagaattcctgaacaatataaagttccctcagcaagacggaacttcccaagctcttgtctcaggagagaatgtggattatagaaagattgtgggtgtgagtggagtgggaagttatttaggtagtaagattttcaggctcggtgcagtggctcacacctgtaatcccagcactttgggtggccgaggcgggcagatcacaaggtcaggagatggagaccatcctggctaacagggagaaactccatctctactaaaaatacaaaaaaaaactagctgggcacctgtagtcgcagctactcgggaggttgaggcaggagaaccgcgtgaacccagaaggcggagcttgcagtgagccaagatctcgccactgcactgcagcctgggtgacagagccagactccgtctcaaaaaaaaaataataaaaaaataaaaagttaaagaggccaagaaacatcatttaaaacacgatataaattttcatcagacataaaagataaaaaatattttcatttaataaatacttttgcatgtcacacatttaacgggaaacaaaatatcatgttaacagcctagtaatacaattttattgtcttagatttttttcgtcagcatgtattctttctgttttgttttgcatttgagatggagtcactctgttgctcaggctggagtgcagtggcacgatcttggctcactgaaacctctgcctcccgggttcaagtgattctcccacctcagcctcccgagtagctgagactacaggcatgcaccaccacacccagctaatttttgtatttttagtagagacaggatttcaccatattggccaggctggtcttgaactcctgacctcaagtgatccacctgcactggcctcccaaagtgctgagaatacaggcatgagccactgcagccagacagcacatattcttgttatgcttttaaaactagttattgatttaaattttactcattagtagattctagtgcagaagctatagagcagcagtccccagcctttttggcaccaggcagcagttttgtgaaagataatttttccacagatgggggtttgggggatggtttcaggatggtgattcaagcgtattacatctattgtgcactttattcctattatgactacattgtaatacataatgaaataattacacaactcatcataatggagaatcaatgggagtcctgagcttgtttttctgtaactagatggtcccatcgtgaagagataggagacaatgacatatcatcaggcattagagtctcataaggagcatgtgacctagatcccttgaacgagcagttcacagtaggattttcactcctgtgagaatctaatggctttgctgatctgacaggaggcagagctcaggtgataatgtgagcaacagggagtggctggaaatacagatgaagcttcactcgcttgcctgccactcacctcctgctgtgcagcctgcttcctaacaggtcatggaactgtgtgtggcctgggagttggggacccctgctatagaggattcagatttaaattcagaagttagaatgaaaaagaattatattctttatctaaatgatttcacagttaactaagagaaagtcagtatatgctgaaaagcttatcagtgttaataagaatgaaaaatatgtacaatatgcaattactattaaatataatttgcccatagttgcacaccgaattcattatcatggcagttaagtatcagagcttctggtttctcactcttcgttcatgtattcagcaaccatgtgctaaggtactaggacaagcactggaattacaagataaagatgatacggtccgcccctcaacaactgtatgctataatctgaaaaaacaaacaggcaattcccatacagagtcatacatacaatgacaagcataagacagcacttattggaagacatagaagggatactagcccaggtttgtgtcaatattgtaggctttttggtagaggcaattcataggttgatatctgaaggggaaggaaaacacatgtaggatagagggaagaagtaaatgcaaacagctggaggtgaagacgatcactgtggagctccatgtagtctagtttggctggatgctagaacaaaggtgtagagtatggtaagtggcgaaagataaggctgaataacttgacaagaaccacactgatgtgagagttttgattccatgctaaggaattttcaacttttcccaggggcaaaagtaaaccaatgacaaagtcaatgactagagatttaaaatgtcactggtcaagtgactgcttgtgacctgtaattgcttaactaattattatcacacgagtgtggggtctcttagccttaaatcactaccttaaccttgagaagttgataatgcctttgttttgtgagaacagtttcagtgtgcaggctgatagtctataggggtggcagaagaaaagtgtagggccagaaaaaaagggatacacagatttcttgcgatttttttaaagctatgaaacatgatgaattaacaaagcataagtacacccttcactatgaatgtttatgttttcacatctttcactagatgtgtgtaagaaaaaatatttaatgtagcatttattaaccaagcaattgagagggaataccgttcactacttagagtttatttcagaaatcaatgatttgaatttaattcataaattttggcaacataccttcatctagctctcaaacacctgcagcatctgaaataaatcaaatattacttataatgtttcagtcaaacaagagacattatcatgtaaacccactgtaagtcaaggagcatctgtactgtagattgatcatccctaatctaaaaatctgaaatccaaaatgctctacaatctgaaactttttgagcacggacatgacaccacaactgcaacgttccacacctgacctcatgtgacaggctctggggaaaacagtaaaaactttcttacctgcaaaaaattactgtaaaacattgtagagaattaccttcaggctatgtgcataaggtatatatgaaacacaaatgaatttcatgtttagactcaggtaccatccgcaagatatttcattaggtatatacaaatattccaaaatctgaaaaaaatctacttttggtcccaagcattttggacaagggatatttaacccatcctactggaaaaataaaattccttttcagtatgacagaaattaagagatcagcttaccaaacttgaatgctgcaggattttctcaagccgctcaatttggtcatcctgttttttaataatttttctcatcatcacatgttctacttcaagcctaaaatgtgcattttaaaataattactctcacacgtaattttttttaaatcatgtaaattctaaacaaacttctgaaggtataattacacaaattcttagcaatcacaaaagtagacgattgggctactgtgtcattttctacctgtgttttggtgataatatgcaaaatttaggaataatgtagaaaaatgatgtatttcgatatagcttacaaatgaaacttttttggcttcacaaagacatactaattatcataactgatacaattttcatactacagtgctcttttgctttataaatactcaagttattttgtgtgctgcttcaaattttacttttgtgtgtcgccttccatctccttagtacatcttatagtagctgtaagttgatcctgtatttcttgaaactgaaacaaagaattttaaaaaattacatttggaaatgacctaaatgtccatcagtagatgaatgaatcaacaaaatatatatgaaatattttagactatcacaatcttttttatttataaaaggtcataatctaggagaaatcatcccattacctgttttttgtaagtaattttagtgggacactgctacaccccttcagtctgcatattgttcatggctacttttgtgctgtaattgcagggccgagttattgcaacaaggatcttatggctcacaaagccttacataatactatctggccctttacagaaaagttcacagacccctgctctaggactaaaacacaacattcttcttgcttttgaattacattttatcaattaaatactcaaacttacaaactggtaaaatgtggaaagataaaggattacctcacgctaagcatttatattttgaattccaaacactaccacatcaactataattttattttttgtatgtatgcatttagttttattatagcaaagcaacttgcacatttttaaatatttaaaactaagcatcatctttcctttctagggaaacaacaagaaaatttaaaaacaagcaggaacaaaattaaaatcgacaaagtcagttccaaataagatcctacaggatcttattgactctcccattgaatagcaggactcaggtcatcattaggagagaagtaatttaaaagcgtcatcttaaactgcaaagatgtccattaaacatgccaaaggagaagccctgttgtctaaatgcccacttaaccaacccaaacatctcaaacccatcctttgctgaccttctataaccccctttttagtttagctttttctacaaataagagaaaatagatacatgttggcaaatgctaactgtccatattcatatagagacagagtgtgctctctgagcccaatacaaaggaagtaaggattttcatcgaaataaaaatttattcagtaaaatggcctttctgaacaagttaacctgaaatctaagaaatacgtatacacaggttctttatacattcagaaaagtagagactaaaaagaagataattttctgaaacattccattagacattatcctctgaattaacctggcttgcctcaccatgccaatagagaaatcattaaaaatagactgtttaacaggaaaaaaaaactctctcaacttctgtgagaaatgatgcataattctcaactttcctaaggttaaatatttaagaaaaaaatatatgtataaaaaatggcagaatgaaagccagagattaagatataggtgcattataataaaatcttaataaaattaataataaggaaaatacagaagaaagccatccactataaaattttaataacattaattatcataaaaatacaaaagaaagccatccactaaaattagtaccccaaaacactttatattagttaactagctacagattaacagttgttggtgtgcaaagttgcatacatacttgacttctcatctggtctaatttcttccttgaatcctgcatcccattttctaaataggtgcagtgacgcgatgaagcatccagcagagcttttgttgctgatcctttgtttaagacatcatctcgtttttgttgaagctgtctcacagctacctgataagatgttatttttgttactgattttacaaatcaccttattattaaaccattaataatatttaactctaaagcatactctttgaaaaatatcaccacacagaccgattcaccttcttttcctcatgtgtacacattcctgtgtattactgaatccagttaaggatacagaaggtgttatcttcctgccaaactggtattgttattcacacaacatattcagcccactagtcattcctcccttgatgaatctgcaatgcttaaaaaccttctgaagtctcaaaaagaaatgagtatgtgggtgagactgatggtagtaaattatacattgtggaatgatttccctctttttttaaattagaaactcaaatcaacctcagagttcctcacattaaatcatctgcttaaatccttccaatagatgtctatctcagaagaaaagtaaaattccagtggccttagatgctctaagtaacccgccctccacctcccgccctgactcagctgctatatctctcctccgtactcactccattcctactctacgtgaatcctgccactcctcgttagtctgaaatcctccttagtctgaaaatggggatccagtgtcaaactaataaatcacagatagctatgcctctctttgtcctggacaaagttatatccaaatgatagtaattgagccttgaaataaaaattatgaacaaattttttatttaaaaactgaaagtaaattataaatgccagtgggaagattaaatcaaacatgatttggctaaaatttactgcatttgccccatattataatagaagtaaaattagatgccttgaaagaatagaatggtcatatctatacataatttgagattgaaatagtttcagatttaagtcaaattgacatgaagaaaaacaaaattttaccaactaagacatatttaaagctactgaagaaaagtaattatgaaatagggaatacacttcagttcatctaggaaatctgaaattcactgtcaaagtaccccacttaattgaatcaatttcaaaataccattttaggtatgagcatttccatatacctgatttatcatggtcttaaaatgttgcaacataaatacattaaaattattacttcagcagtataagactacattattaatgttagtctatgttaacattttataacttaaaattttataagcgacacattgactttaatcagaggaaagcatctctcagttctaactttgacttgctggagacaaggaatgtttctaagcagatatatttatcatatgtatccttttttatattcaactagatccaacattcagctgtaaccaaatattactttaaattttacttcaggaagtttgaaaaatacttatttttcttgatacttacttctctttctgctttctctttttcatattggcattctttttctttcgaatgattcagttcattgaccaacattttattgtcttcttctagtaaaagacggtgctttctgcactcagcttgaaggttttgtactctagcatcacatctggcttgaatattaagtattgctttttcttgattgtcagctttgttgcgagcatcatccagttgctgttgaagcaacatattttgtttttttagttgacaaaatctttcctgtttttctatgcatttttccattgtattgtatccacttttgtacattttttcaatgtccttcatttgactctgtttttgctttagctcactttgcacgtgttcaaaaaccaaagccttttctttcagagcctctcctgtgtaatggagctcagttttgaggactctggacttactctcagctttagaaagttgcagagaaagaatcagaacatgagaattcaaattttcctgtaagtgacgacatttatctactgtgccctggaaagcaagctcttggtctctttttgatgagtgactttgatcatgatcacatcgagcagcattcagtctacaacggtatgattgcatttctgtttccagtctttgcctgctctctctttgcttctccagtttggaacggagcgttgtgttttcatctgtcagagcagcaagctgtccactataacaggctatcgtttttgctaatgtttccccattccgttttagagccttttgaaggtcttcatgctttcttttcacaatttcaaagtcttttaagtatttcttttccaggttttggttttttattgtgtctttttccagcctgagcctggcaatttcatcttgcatcaagcggttttcatgcagcaggtcttctttttcatcagtttcagaaacctaagtaaaacaaagcaaacttgtaactagtatccaataggataacatattgtgattgcttctgaaattaaataataacccgtacatttatacaatgagaggttgccataactggatatctaactgggaaaaaagaagttaagtcaaaacctcaaacctcatacagcataaattccccaaagttcaaaagtttatttgaagacagtgaatccatgaaagcaaaaaagaagccactagataatttttttaaatttcaggataaaaaaaggcttttactgaattacaacaaattgcaaggcataaagaattaataactatgaccacattaaaaaattgggtttacactctaacatctaaactatacctctccctatagtgagagccttagcttggcagatatttggacagatgaatgacattttccaaattctttaagttccctttttctaaaatattgtatagatattctacttttctaatattgttatggtcagttttaagaatgacatttattgataaatgataaagctaggcattatactaagcacttttacgtgcacaaatcaatgaactcatttagttataattctatagcaaaaggttaaaaatataagcaagctgcaggatttttcccagcttttctgactctattcctagtgctcttccaccaaatcagtaacttctgtgaggtagatatatacatacaaaaataatcttttatttcaagacaccaaaagtcaagaaaattagatctataaaactcttcttagaaaatcatgacattatttgctattgtgataacttttattccttttccataacatttgaaatgtaattaacatgaaataggggaaatatgctgaactatgtcactaggaacaaaatacttacaatatcattaagtatatattgtagaatagcattgttttcaaaaggcctttgaactaaaataaaatatttcaagatttattataaataattatagctataaatgccatgattcatttttaagatgaaataaaatttggggattgttcaggcctaaataatatatgttaaatgaaagagatggtataagtaatattaataagagtagaaatatgaagttttaccaaacattaatttacctgatttgaattatttcctcctgtcttcaattccacctctgctgatttgagagccggtttaattggttttgtcacatcagcttctatcctatattgctcttctgttattcttaacttttccctaactttttggtgcaactcttcaacatttcttcttttctttttttcttgctgtatggcaaatctgtaaatatacttatcttagaatttatcttatcagtgaggactaagctctaattttttatcttgcccaaattcctacctaaggggtccagggagtcgtgccctacaaaccatggattctcatcagatgggttttatttgaccctgtatattgtgacttgcttttcaatctgactctggcataaccttacgagacaaggaagaaaatatttaatccaaaatatatttccttgccatgccttgaaattgccctgcaaagtctcttgtgggaaaaatccacattctatagagaaccccctttcccctttgttttccttcctttctatgcagatccaggggatattcagctgagagccaggcacccttttgggtccgataagaaacattttacaatctgctctctctgaagtctgctgagagattcctctgcacagtaaaacttggtccccacaatcatttatcttaacctgaacatttctttccattaatcccaggtcttcaaataaactcaagcaattgtcaaccagaaaatgtttaaatttacctacagcctggaagccccagctttgagttggcctgcctttctgaaccaaatcaatgtatttcttacatgtatttgattgctgtctcatgcttctctaaaatgtataaaaccaagctgcaccccgaccacttcgggcacatgttctcaggacctcctgagggctgtgtcgggggccacggtcactcatatttggctcagaataaatgtcttcaaatatcttacagagtttgactctctttgttgatattagaaaataaaacattcatatgttggtttattatcctaataaagtttctatgttcttaaatactatttttctttctagttctcatgtttttaatttctcacctcaatctcatccaaagggcatgtataagttgaaatgtattgataaaagaacatcctgcataagtttctattactagtaactctagcaaatattatgaaaaaggacgttgaaaattattcagtaaagttacaagataaaaattatcttttcttcacagtaattactcctcaattaggatgaatcatttagagttaattaacataaagttactttttataaacaagttggtacattcactagaaatacattttcatcttcatgaaacattcattgcaagtatccctaaacataatttacattgcaagatagcattttcgatgtctttatgaaacatatatcagcagattactgtaatccaagactaggttaagaatgtaatatgttaccctacactttttaagattgttttttgggtaacactttcagtctatcctgctgattagtatgtactttataaccaattgtaaaatctgttttggaacaacacaagatctaatatttaattaaacaataaagaataatacatgtcttcagcataaaactgaattaattttatctacatagcagagagatgttgaataagctaatcagtaatcactttacattttactttttattccctgcatattaagaataaaactggatacatttttttttttttttttttgagagggagtctcctactatcactgggctggagtgcactggtgcaatctctgctcactgcaacctctgcctcccagtttcatgtgattctcctgcctcagcctcctgcgtagctgggattacaggtacaaccaccatacctggctaattttttgtatttttagtagagatagcatttcactgtgttgggcagactggtctcgaactcctgacctcgtgatctgcccacctcggcctaccaaagtgctgggattacaggcatgagccactgcacccggctgataatttttaaaataattattctgggtaaagaaaaatatctgttttatactctgttggttgaattataaattaatatgaacatccttaagaacaatttagaaatattgatcacagatctaaaacagatctaaaaaagtttctatactttaaccagaagaatttatccaatgtaaataattagaaatgtagaaaactatgtgtatataaaagatgttccttgtagcattattacaaaaactttttaaaacctgaaattcaattcatcaattaaataatgagatttccaaaaggtaaaattctatacagccattaaaactatgatttaaaagaatatgcatttaattattagagaagtattcacaattaagaacttgtgatattatatccaataatttcacactccataagattaagaagctttcttccctgttaaatcctagaaggaaagttcgcaattacaaaacttctccttatacgtctttaatataaaacaaacagttcaaacatttatttaaaactaggtcatacctcaaactacagagttctttttccaattcaagtatttcatgctttaactgcgattttatttcttctttttcagatattctcttttgtagtacactagccttatttttcagttttcgaatttttactctaagttgctcacagtggttatctttaagttttattaatcttttccataaacaaaatgtatttttaattttcaataggtgaacacaatctgtaaccaggaaaaaacaaactagagataaaatacatgagtagatttttggatataaaggactgtgcatttttaacatgtattcattcatacgttgaacaagtatgtacatattgagtgcctacaaggtggaagatattatagtaaggtctgcagataagacaacacctctgctattgttttagcttaaagtatagtgaagaaccaagataaaaaggtgacagttataaactcagataggtcctgtaaaaaaaaaaaaaaaaaaaaaacatagttatgtgattgcataagataatttgatctatacttcacccagggaagatttccctgaggaagagatgctacactgagaaatgaaggatgagaaagaagcagttaagcaaagaagaaagcaaagcactctggctagtttgcagcatgtgctgtgctgaagctctgctgcaatctgttactagctctgatggagtaacagatactgatttttcatcttatctgaatgaataaaaaacaaaacagacacaatacattaaactgattttcaacacagtggacttcaggcaatgaagatggtaggtgatcactgaaagacagaaaacaaatacagcaggccttacaaatatcccagctcttttgacagagttttgacggaggttcgaggccatcacaaagggagaaaatctgacatagagctggggtgatgacgctgagaggccagtaaaaccaaagcagatagagatcacaggacagaaaactggagagaaaaaagcagtacaggaaacaaatcctggagatgtgcagagattccctcttgggtatttagtggagtaatgaaaagtgcttgtgtactaggaaacttcctaagaacaatgaaaaataaaataaaaaaaaacaacagttaaagaacattagcagaaacgatgtctggggttcacacaatgactggaagagggtccattcccatgagccaggccaaaataccgcatacttcacaggacaatgaatactccgaaaggtcttgcctcaggagtgaggaattaccccaaatctaaaagcaagaatggaaagattataagtaaatctctgtactccaaataaaactcaagataataagtggaggcagggaaggtttttttttaaaaaaacacaaaccatacttgtagagacacaaattacattgtcataagtaaaaactatagtggatggaaataaacacaaattagagataacaaaggaaaaattcctaaatttgacacgataaactgcaagaaactttcaagcagctaatagataactcctcaaataaaaaagaagagacagaaaaaaaattaaagaaaaaatgaccaaaaatattctaaccttaacacaaaccataatcccacagattcaggaaggaagtgtctgggacagaaaaaaatgaaaatgtatcattgtcattttttataccatctaggatgtataatattactgaaggtgaactgtgataagttaaaattatatactaaaaatcctaaacactaagatagcaaaacagttatcgctaataaacccaaaaatatatataaaattgaatcataaaaaacagttgactaatctaaaggaaagcaggaaaagaaggggaacagagaacagttgggactaatagcaatcacacagctaccagacaaacataactatatcagtaatcacattacaaatgacacttgtctaagaacctcaactataatacagactgtcaggctcagcaagaaagcaagacccaactacaggctgcctataagaaatgcactttaaatgtaaagacacaaattggttgtaaggatggaaaaagatacatgctaacagttggcaaaggcagctgagcaggtgtggctgtattaataccaaagtagatttcatagcaaaaaaaaaaaaacattccagcaataaataacaaaggtcatgtcacaatagtaaaaggttcagttaatcaacaaaacataacaatcctcagtctttatgcccctaataacaaaccagcctcacaatatatgagaccaaagtggatagaactacaaaaagtgacagacaatttctaggtaatctgaggtttcaataccctttactcaataagtgatagaacaagaaggcagaaaatcagcgagaatagacttgaacaacactatgctttccaagtacccacggaacacttaccaaaatagaccatattttaggccatacaacaactctcaattaaaggattgagtcagaaggatttaactcatacaaagtatgtgccctgaccacaaatcaatcagattaaagaccgataacaaaaataactctgggaaatacacaaatatttggaaactaagtaacacacatctaaataaccctgggtcaaacaggtaatgaaaatagaaatagaaaatagaaaatattctgaactgaataaaaattcatcaaccagaatttgtggaatgcagctacagctgtacttgaatacaaatttttagcactgctgaatgtctacattagaagagtcttaaatcaatgactttgacttctaccttaagcaactagataaaagaagagtgacataaacccaaagcaagcagaggaaaggaaataataaacatctgctgtggtctgaatgtttgtcttccccaaaatttatatgctgaaagccaatcacagatgtgacggtattaggaggggggatttttacaggtagttggtcatgagagcgaagccctaatgaatgggattagtgcttagtgctctatacaacagaccccagatctccttcaccccttctgccaagtgagggcacagagaaaaagcattcatgaactaggacgtgttccctaaccatacaccaaacatgacagcatctggatcttggactttgctgaacccacaactgcgagaaatcaacttctgttgtttgaaccagtctatggtattttgttatactgttggttccagaagaaacaatagaaaaaaatcaacaacacaaaacaccttgaggagatcaataaatgtgataaagctccatttagccaggctgctcagaataaaagaaacaatacaaattactaatttcagaaataaacaatgtgacataattatagattctacagatactaaaaatataacaagatattataatttctatgtaagtaaacaggacaacttagataaaattaacaaattcctttaaaaatgaaaattagcaaatctcaatcaagaagcaatagataacgtgaattgccctatatctatagaagaaagttaagttatagttaaaaaccttcctaaaagaaaactccagacccagctggctatgctggtgattctacaaaacatttccggaagaaattaatacaattatacataaactctcccaaaagaaacagaaagaaggagtatatctcaactcagtctgtaatgttagctttaccctgaaccaaaaccagaaaatattaccaacaagaaaattccctcatgagcacgaatgtaaaaattcaaccaatttgtgatgcaacgaagacatcctcccatagtggagtgaataaactgtggttacacagccatacagtggaatatcactctacacataaagaaatgagcaatcaattcatgaaaatatgtgaaggaaccttaaatgcatattaccaagtgacataagctcatctgaaaaggctacttactgtatggttccaactatatgatcaggaagaggcaaaactatggataaagtaaaagggtgcctaagggtaagagacagcaggaaaagatacataggcagagcacagaggatttttagggaagtcaaaataatttatgtaacatggatacacatcattgtacatttgtccaaatccatacatgtaaagtaccaagagtgaaccccaatgcaaattatgggcttggggtgattgtgatgtgtcaatttaggctcatctatcatagcaactaccactatggtgaaggatactggtaatgaaggaggctaaacatgtattggattgggggtatacaaaaaaatatctgaacccccctctcaattttgacaggaacataaaactggtctaaaaaataaaagtctttataataaattctaaatgagactttagtaaactgtatccgacagtataatgaaaaggtaatacatcataaacaaatggggtttattccagaaatggaaggttggcttaacattgaaacatcatcattatttaccacaaaacaaactgaaagagaagacccataggatcatcccaacagacacaggcatctgataaaatttactcctgatgtctcaaagaagaaacactctcagtaacataagaatccaagggaagttcttcagcatgataaacaacgtctatgatgaacctacagctaacgtgcatcatagtgaaaaactgaatgcatttcccataagatgaggaagaacatgggaatgtctgctttcactacttgtttgtagcattgttctgaagattctagttaatgcagtcaggcaagaaaaagaaataagaggcatccaagtttaaaaaaaagaaataaaattgtctttatacacaaccatgaccataaaataggtatgggtaaaccccaacctgtgggccagcttcttgtccgataagcttttattggaacacagctgtgttcattaatttatggatgatctatggctgctctcatactaaaatggcagagtttatcagctgcaaaagagacccttttgccacaagcctaaaatattcactatccttagtaagagggtagtttgagaaagaaaggtttaacaacctttggtctatgaagaaaatctgatcaaatctaccaacaatgtgccagaactaataagtgagtttaacaagaatgaaggatacaaattcaatacagaaaaattaactgtatttctatatgctagcgataaacaatcaaatgaaaattttaaaactatcattttctatagttttataaaagtgtatatttggattagcaatgctcaacctgtataaagaaagtcaaatacatctacactaattaaactatcatttacaacttcatcaaaaatgaaatacagataaatctgataaaatatgaaaagacctataaactaaaaactacaaaatactactgagaaaattaaatattacctctataaaagcagacatacactttattgaggagtagattcgctattgttaagatgtcaattctccccaaattaatctataaatatgacccaatcccaacttaatttccaacaagcgagcagtctttattttattgataagctgattctaaagttcatgtgaaaatgcaaaggatctagcatagtcaaaacagaacaaagaacaaaattggaggattcatttcaagaattactataaatcaatagtaacaaaaacagtgtgccacaggtacaggctgaatatcccttattcaaaatgcttcagactagaagtttttcagattttggattttggaatatttgcatatacatgatgaaatatcttggggataggacccaagtctaaacacaaaatacatttgtttttcatatttaccttgtacacaaagactgaaggtaattttaaataatacttttaataatttggggcatgaaacaatgtttgtatacatgaggtcggatgtagaatttttccactgtgctgtctatgttggcaatcaaaaagtctggggttttagagcatttcagatttgggatatttaaatcagcaatgctcaacctgtataaagaaagtcaaattcagacaatccccaacttaaggtggtttgacttactgactttacagtgggtttactgaagtattaaattgcttttgactcaaacactgggtttcccacaatttggggagcacctgcaaattaataaaattcaacagacagtccagaaatagataacacataagcaaccagcttatgactgacaaaggcaggatggcaatgcagtggagaaaggatagccttttcaacatgcggtgttggaacaactggctgtccatatccataaagtgaacttgaatccatacctcacctcactccatagacaaaaggaaactcaaaatggagcacagatttaaatggaagatccaaatctataaaatttctagaacaaacacaggaaaaatctttgtgaccttgtgctaggcaaacatttttacatatgacacaaaatgcaaaatctgtaattcaacaattaaattggatttcattacaattaaaatcttctgctcttcaaaagatactacaaagcaagtgaaaagtcaacccaaaaactggcaaaaatacccttgtaaaaaagtagctaaaagtaatagtatccaaatacatacagaattattaaaattcaacacgtaagaaaacatcaacctacttttttatatgcaaaagatgtgaaaagacagttcaacaaagaagatgtacagatggcaaataaacacatggaaagatgctcaacattttagtcattaggatcatgtacattaaacccataagaatatacataatacacccatcagaataactaaaatttaaaaaaataaatacagcagtagtgtgacaacatagcaactggaatggtcatttactgctgatgagaatagaaaatagtacaaatattttggaaaaccatttagcagcttttaaaaacaggaatatgaagggccatgaggagacgttagtgggtgatggatatatgttgactatctcgatgatggtaatagtttcacatgtgtatacatctgttaaaacttatcaaatggtaccttttacatgtgtgcactgtatcgcatatcaattttaccacactaaagctactgattgtaggagcaaacacctaaggcactggctgtgacacagagaagggtatgcaatgatgcagtataaagctcgaggactgagatccatatcttatagcaataaatggcagctgggttttcagcaagcaggtaacatgatcaggtgtgattttttacaactatataattatgattgcagaacaggccatggttttggaaggtggaatagtaggaaagacagttagagggttatcacagtatttcaggtgggaggaaatggtaacatgaccatgggtaaatgggtaatggcatagaagagaagcagagtaaacaaacacactgtgtgtatcattcacactgagaaaagtacagtgaaatgatcatagctctttggctgagaaggtacaagatacagttgctttcattctattttaacataaggcatatttctgagatgaacattcttgtaacatatcagtactctatggtacagtgttaagcaatgtgtgcatacattgctataggatttttaaaaagccttatatttatgcattggtcctacctttacacttcatttcatgttgatcaatgagtaatatgacattcttacaattacagcaaagcgagtcaccgtcctctgagactgtttgagatgactgaattatgtcatcaaggtcatccctagaatgtatttggtttttcacctacaaaataaataacactgtttcaaaatgtccccaaaatatttatagcatatactaaatgtacagaagtgggaattgcccatctgtttctatgagcacaaacacaggtacctgttccatactttttttttaagcaatttcctttatgttgactctagttcagaagaccacatggtctatggataaattagtttcccagttcctatgctatttagaaaactgacagagagacttgggttaattaaggaacaaagattaagagaatgtcttcctgagcttgagttattttaattgcaaaaacaatctatttatacatacaattaggtatttagattaccccattttacacaagagattttcataagtaaaaaaattcaaatggatcaaataattggtgaagagaaaaaccagagtagcagcaagtgaccctctaagtcttttggaagttgaactttctccaaagccaggaactctactttacttgtaatatgcttacctcattcttaaatctttgcatatatcacttaattccacttctagacatactgctgatgttctgtcaccatgtggtggagaataatgcacattttctaattcaagttttatgctttcatatttatttgcactacagttgtcacataacggcttctggaacacattctgtattggttttgtactgttgtgtttgtaacaacagaaacaccatcatctttttttttttttttaaatcacatgcttcatttctttggagcaggtaagccacatacctaaaaggctttttgaatcactaaattgaggcatatgtccgatgtttaatttccagttagcggtgttttggttttttgtcatttgcctcacaacctatttgacttcttttatttcatccataactacttctgggtttcttgcttttgtactttcagtatcattataaaaattttccttgtctgagttaaaaacatgttcagtatctggtttgttgtcattttcacagtctactttatttctatttaaataaagctccgaaggtgactggcaagcatattctggagacccagagtatgaatgagaaagaaaggcatttttgagactgggttatttttgttcaggaaatatctggactactacagagacagacatgccagatgcatcactttcctaacaatcaggtgaatcatttgtcaaattagagggtatttacttaagtttgttcttcctgtagagttattatgtagttgctcttcctcaatacaagcagttttgtaattttcacaaatttcactgaaactctactttaacttatttgtgatgaattttaaagtttttttaccctaatttgtcttgtttgatccacattctctcatacttttgtgcacaagtaagtcctgaatatataaagaggtcctttctatcacaacactttttcactactagttgttgagacaatttttgcacatgcaaaagtggaagataaatttgctagttttctttctcagatgtcttttctgtcagagtacatgttttagaaataactctatctttaaataatcaagtgtaaaaagagaaaaattttaaaataattaaagtttaatatcaaacttcttaatctatgtttacctactgccaaatcactggattgtaactaagaagtgaaaaataatttgcattagcctaaaatcagtgaaaaacacaaatcatgaaactttaatttgccactgtttgtttgaactaaacttgactaattcattatgtgttaaatttcccaaaaatgaattaggagatgacttgtggtactataaaggcactgtcactttaaaagattttatcactatatgaacagtgtacacttgagtgctttttcctaatattactaactaatgattaggcaaactttaaattattaggagccaaaatcaccaccagtcagtaagaaaagcaaattctttgtctggcagccaagatggccaaataggaacagctctggtctacagctcccagtgtgagcgacgcagaagatgggtgatttctgcatttccatctgaggtaccaggttcatctcactagggagtgccagacagtgggtgcaggatagtgggtgcagtgcactgtgcatgacctgagggagggtgaggcattgcctcactcaggaagtggaaggggtcagggagttccctttcctagtcaaagaaaggggtgacagacagcacctggaaaattgggttactcccaccctaatactgcacttttccaatgggcttaaaaaatggcgcaccaggagattatatcctgcacctggctcagacagtcctatgcccattgagtctcactgattgctagcacagcagtctgagatcaaactgcaaggcagcagtgaggctgggggaggggcgcctgccattgcccaggcttgcttaggtaaacaaagcagctgggaatctcaaactgggtggaacccaccacagctcaaggaggccttcctgcctctgtaggctccacctctgggggcagggcacagagaaacaaaaagacagcagtaacctctgcagacttaaatgtccctgtctgacagctttgaagacagcagtggttcccccagcctgcagctggagatctgagaatgggcagactgcctcctcaagtgggtccctgaccactgaccccaagcagcctaactgggaggcaccccccagtaggggcagactgaacctcacatggctgggtactcctctgagacaaaactcccagaggaaagatcacacagcagcattcgctgttcatgaaaatccactgttctgcagccaccgctgctgatacccaggcagacagggtctggagtggacctctagcaaactccaacagacctgcagctgagggtcctgtctggtagaaggaaaactaacaaacagaaaggacatccacaccaaaaacccatctgtacatcaccatcatcaaagaccacaagtagataaaaccacaaagatggggaaaaaacagagcagaaaaactggaaactctaaaaagcagagtgcctctcctcttccaaaggaacacagttcctcaccagcaatggaacaaagctggacggagaatgactttgacaagttgagagaagaaggcttcagatgatcaaactactctgagctacaggaggaaattcaaaccaaaggcaaagaagttaaaaactttgaaaaaaatttagatgaatgtatacctagaataaccaatacagagaagtgcttaaaggagctgatggagctgaaagcggaggctcgagaactacgtgaagaatgcagaagcctcagaggccgatgcgatcaactggaagaaagggtatcagtgatggaacatgaaatgaatgaaatgaagcgagaagggaagttgagagaagaaagaataaaaagaaatgaacaaagtctccaaaaaatatgggactatgtgaaaagaccaaatctacatctgattggtgtacctgaaagtcacggggagaatggaaccaagttggaaaacactcttcaggatattatccaggagaacttccccaatctagcaaggcaggccaacattcagattcaggaaatacagacaacgccacaaagatacccctcgagaagagcaactccaagacacataattgtcagattcaccaaagttgaaatgaaggaaaaaatgttaagggcaaccagagagaaaggtcgggttacccacaaagggaagcccatcagactaacagtggatctctcggcagaaactctacaaaccagaagagagtgggggccaatattcaacattcttaaagaaaagaattttcaacccagaattttgtacccagccaaactaagcttcataagtgaaggagaaataaaatactttatagacaagcaaatgatgagagattttgtcaccatgaggcctgccctaaaagagctcctgaagaaagcactaaacatggaaaggaacaaccggtaccagccactgcaaaatcatgacaaaatataaagaccatcgagactaggaagaaactgcattaactaacgagcaaaataactagctaacatcataatgccaggatgaaattcacacataacaatattaactttaaatgtaaatggactaaatgctccaattaaaagacacagactggcaaattggataaagagtcaagacccatcagtgtgctgtattcaggaaacccatctcacatgcagagacacacataggttcaaaataaaaggatggaggaagatctaccaagcaaatggaaaacaaaaaaaggcaggggttgcaatcctatctctgataaaacagactttaaaccaacaaagatcaaagagacaaagaaggccattacataatggtaaagggatcaattcaaaaagaagagctaactatcctaaatatatatgcacccaatacaggagcacccagattcataaggcaagtcctgagtgacctacaaagagacttagactcccacacaataataatgggagactttaacatcccactgtcaacattagacagatcaacgagacacaaagttaacaaggagacccagaaattgaactcaactctgcaccaagtggacctaatagacatctacagaactctccaccccaaatcaacagaatatacatttttttcagcaccacaccacacctattccaaaattgaccacatagttggaagtaaagctctcctcagcaaatgtaaaagtacagaaagtataacaaactgtctgtcagaccacagtgcaatcaaactagaactcaggattaagaaactcactaaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtacagtgggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagccggttttttgaaaggatcaacaaaattgatagaccgctagcaagactaataaagaagaaaagagagaagaatcaaatagatgcaatacaaaatgataaagggggtatcaccaccaatcccacagaaatacaaactaccatcagagaatactacaaacacctctatgcaaataaactagaaaatctagaagaaatggataaattcctggacacatacaccctcccaagactaaaccaggaagaagttgaatctctgaatagaccaataacaggctctgaaattgtggcaataatcaatagcttaccaaccaaaaagagtccaggaccagatggattcacagtcgcattctaccagaggtacaaggaggaactggtaccattccttctgaaactattccaatcaatagaaaagagggaatcctccctaactcattttatgaggccagcatcatcctgataccaaagctgggcagagacacaaccaaaaaagagaattttagaccaatatccttagtgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcttataaacagaaccaaagacaaaaaccacatgattatctcaatagatgcagaaaaggcctttgataaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccaggcccattaggcaggagaaggaaataaagggtattcaattaggaaaagaggaagtcaaaatgtccctgtttgcagacgacatgattgtatatctagaaaaccccattgtctcagcccaaaatctccttaagctgatcagcaacttcagcaaagtctcaggatacaaaatcaatgtacaaaaatcacaagcattcttatacaacaataacagacaaacagagagccaaatcatgagtgaattcccattcacaattgcttcaaagagaataaaatacctaggaatccaacttacaagggacgtgaaggacctcttcaaggagaactacaaatcactgctcaaggaaataaaagaggatacaaacaaatggaagaacattccatgctcatgggtaggaagaatcagtatcgttaaaatggccatactgcccgaggtaatttatagaatcagtgccatccccatcaagctcccaatgactttcttcactgaattggaaaaaactactttaaagttcatatggaaccaaaaaagagcccgcatcaccacatcaatcctaagccaaaagaacaaagctggaggcatcacactacctgacttcaaactatactacaaggctacagtaaccaaaacagcatggtactggtaccaaaacagagatatagaccaatggaacagaacagagccatcagaaataatgccacatatctacaactatctgatctttgacaaccctgagaaaaacaagcaacggggaaaggattccctatttaataaatggtgctgggaaaactggctagccatatgtagaacgctgcaactggatcccttccttacaccttatacaaaaattaattcaagatggattaaaggcttaaacgttagacctaaaaccataaaaaccctagaagaaaacctaggcattaccattcaggacataggcatgggcaaggacttcatgtctaaaacaccaaaagcaatggcaacaaaagccaaaattgacagatgggatctaattaagctaaagagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaacaaacaaccccatcaaaaagtgggcaaaggatatcaacagacacttctcaaaagaagacatttatgcagccaaaaaacacatgaaaaaatgctcatcatcactggccatcagagaaatgcaaatcaaaaccacaatgagataccatcccacaccagttaggatggcaatcattaaaaagtcaggaaacaacagatgctggagaggatgtggagaaatagcaacacttttacactgttggtgggactgtaaactagttcaaccattgtggaagtcagtgtggtgattcctcagggatctagaactagaaataccatttgaccctgccatcccattactgggtatatacccaaaggactataaatcatgctgctataaagacacatgcacacgtatgtttattgtggcactattcacaatagcaaagacttggaaccaacccaaatgtccaacaatgatagcctggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacactgcatgctctcactcataggtgggaattgaacaacgagaacacgtggacacaggaaggggaacatcacactctggggactgttgtggggtggggggaggggggagggatagcattaggaggtatacctaatgctaaatgacgagttaatgggtgcagcgtaccagcatggcacatatatacatatgtaactaacctgcacattgtgcacatgttccctaaaatttaaagtacaataataataaaataaaaaaagaaaagcaaattcttacattttaatgcaaattacatattgtaatatgattgacagtgttatatatttatatagattataggcttaagttctaaggtctactaatgacagtggatttaataaatttaacaatatttagagattttctatattgaaattcattaggcagttattgtttgtacactaataccaaaggtgccattttgcaaggtataattctcttgatagccagttgggttgattttatgacccattctctccctcaacatagaaactgaagtcagagatcaaaagggaaaataaattcttaaccttggtattagtgactggcaataaaaaaactgcaaagtttgaaccactagcaataattactcctttaatctgaatccagtacggtggtcatcactgttaaattgttcataatttctattgcttaaaattgtaattcaatatttgatgttaccttctttattataataggaagttataaaaatagaagtgcaaacaatatcaggaactttttaactcaattccaagagtaaagattagatacaagttgctatagattccaacactattttaagttttataactaaatgtttttaaaatgaaatattaaattataatcaactgatactaaaaggcaaatccaaaggtaaattcatttcaaatatgctgtattaccaaagctaggaaaacaagattaaaccagaaatttgattttaaatttttacatacctgtggctggttattttcatattcttcaagcctcttttgctctccctctgatgccatttctaagtcttgttctgctaaaaaaattatatatttagttaaaatgagctacacagaacagttagataaaagccatggtcagcggtggctcacgcctgtaatcccagcactttgggaggctgaggcgggtggatcacgaggtcaggagatagagaccatcctggctaacaaggtgaaacctcgtctctactaaaaaatacaaaaaattaactgggcgtggtggcaggtgcctgtagtcccagctagtcgggaggctggggcaggagaatggcgtcagcccgggaggtggagcttgcagtgagctgaagatctcaccactgcacctccagcctgggtggcagagcgagactgtgtctcaaaaaaaaaaaaaaaaagccatattctttctaaaaccagaaaataaaagtgtttcaacgaagcttaatctttagtataatatgtacttctttaagaaaggcttttaatcctccaaaacttcagcaaaccacttggggaggcactagatgtcaccaggttcaagccatgcaaacgtggtcaaagattcactcacaaattcatccacccaacatcaatgaacaaaaccatcagaaataagacaaaatgtaaaaatccaatagaaacagaaaaagtaacagcacactgttctttacttcacaatagtacctttagaacagcacattgagcctgctgttcattattaatcatttccaaaatgactgctactgtttacactttcatcaatgtacagtctcttctttatatctaaaatattttcctcaactattctgacagatttctttcataatttaagactcagacagctatgtgaagtcttccttgattccggctatctttcctcagataaatgattttatttaatacaggttttataacatatgtagttaaggtttcaaaagtgagattatgtctcaactaactataactgaaatagaagagtgtatctatttcaatgtaaacatgttgactgataatgagaaaaatgatccttataaagaatagcaaatcatgatcctaagacagtaagtgtcaaagctgatgggaggatgctatggcctatctttaatgcaatacttcagattcaattacaccattatactacaagcatttatcatgtccaactatttttcctattatttaggaagtacaaagttgtgaggacacttccaataaatatacaatttatttctcatcagagaaactgtttaaaattaatcagcttagatagacagttgtagaataaaaattaataaaactattcatttttttcattcctaggtaggctactgctatgtctacattgcttgtatcctgcagtttggccctgtcaagaactttctgaatccactcatgcaagaagatatgtaaaccacatcaaaaatagtgtataggctgggtgtggtggctcacgcctgtaatcacagcactttgggaggctgaagtgggtggattacaaggtcaggaggtcgagaccagcctgactaacatggtgaaaccccatctctactcaaaatacaaaaattagccaggcatggtgtcatgtgcctgtaatcccagctactcaggaggctgaggcaggagaatcgctttaacccgggaggtagaggttgcaatgagccgagattgtgccattgcactccaggctgggagacagagcgagactccatctcaaaaaaaaaaaaaaaagtgtataataagctttcaatatgtaaataattgtcaaaaatgaaaaaattaaatttccacagacattaataacattttatacttcaaaatcagtacaacgttcactgattattttggttttgttattcaaagaatgaatgctataactttttgtttctaaaattagttcgatttgatataccatgctaatctctaaggcactttcatggaactgtgatcttattaaaaaaataggtttcttagtaaaatcagtcaaagtttcttagttcaaataaatttcatttgattaactaatatcaacacttctatatagctcttataaattattcccaccacaaatgaagaggaaagcctcttaatttagcagtagtaccttacatgtataatttctatttcctaaatttgtgttcctttccctctggctagaaacatgctcagaaatagtagcaaaatgacactgttatgtttcaaactgctatcagatggcaaacaggtatacggaaaggtgctcgacatcactgatcatcacagaaatgcaaatcaaagctacaatgaggtatcatctcacctcagttaaaatggcttttatccaaatggcaggcattaagaaatgctggtgaggatgtggagaaagcagaaccctcgtacaccattggtggcattgtgaattagtacagtcactatggagaacactatagagtcctcaaaaaattaaaaatacagctacccacatgatccagcaatcccattgctaggtaacgattcaaaagcaagaaaatcagtattataaaagagaaatctgtcctgacatgtttattgcagcacttttcacaatagccatgatttggaatcaacctaaatgtacatcaacagaaaaatgggttctaaaaatgtgatacatatacggctcagccatgtgaaagaataagatcctctcattcgcaatgacatggatggaacaggaggacattatgtcaagtaaaataatccaggcaaagaaaggaagccttcacatgttgtcagtcctttgtgggtgtgagaaatttaaaaaatagagctcatggagatgaagagaaaaatcaccattaccacagtctaggaagggtgtgggggtggtaggaaaagaggatgcttaataagtacaaactatagttagaaacaatgaataaaatgtagcattttatagcacaaaaacatgactacagtcagaaataacttgttgtacattttaggattactgaggaagtacaaatgaaaagatagcacaaagaaatggttaatgcttgaggtgatggataacccattaaccatgatgtcattattacacattgtatgcctgtatcaaactatctcatctactccataaacataaacacctacaatttactcattaaaattaaaaacaaaaaaataaaacacacacacacacacacacacacacagtgtgctaatcagaacatccgattggcttaatataataagtgtaacaaaattgaccagaaccaataaaagttaaaacaaaatatgttacaaaataaaacatttcattagctaaaagccataattttaattgacttttaaagcaaaacaaatattttacagtatcaaaattgatctctttaattcgctaaaaactattgaattccaaattggaaacttcagagtatcaaaatgtaaaagtagaaacatctgaataaaaccttatatttttaggccaggcatggtggttcacacctgtaatcccagcactttgggagggcgaggcgggaggatcacctgaggtcgagagctcaagaccagcctgaccaacatggagaaagcctgtctctactaaaaatacaaaattagccgggcatggtggggcatacctgtaatcccagctactcgggaggctgaggcaggagaattgcttgaaccaggaaggtggaggttgtggtgagctacaattgagccattgcactccagcctgggcaacaagagcaaagctctgtctccaaaaacaaaaaacaaaacaaaaaaaaaaaccttatgttttaaaaatgtattttccttatgcatgtaaatctcatttttgaaaatataaataaaaatgataacagctgcattatttagatgaaatcctgaaataaaatataaaaagtgaaataattgagaatagaaagactatgagcattacaaacagattaatgtacttctttccagagttaaatctacaatgcaaagtttacctggtgtggatgtttgtacctccttcattttggtggctgtattcagaacagaatctttattttcaattgtagcctgaatgggttttaaaacaaagtgattagcacatgatgtatattggtataggttatgcagttaataattaaaaatataaatgtaagagtaattaccttcaaggtgcgcagattctcaggatactctaacaagcaagagaaatatataatcatatgtaaatatggtaaggccaaccatacattcgtggagtgttagcatcaaactgaatactcttgcctgtattagtgtagggtttcatgtttttctagtttgtttctttgggacagtaacatgatagaaatgcaataaagaaaataggaatacaagcttcaaaaacatacagttacaagttaaaaagtgagattatgcaccacatctattgctaaaaaaaagtgttaatatcaatgtggatatactgattaacaaggagaaatgtgatctaaaatcagaggagcaagtcataaccctagaaataagtgtaaaagctggtgctaactgcgactacatgactttcatacaagacatcagaaggctttataccagtataacataaacattcatcatgctctttagcttgtctgataactgagaaggtacacaattacaatgacacttcagttgaacgtacacttcacgtatcttcagtgtaagtgtcctgaattgatctgcttggatatatgtttggtgaatcctagtagttaatattcattatttatcatgcccatgtggtgtaatagtctgcctacatttcttatatcctctagtttagccttcagaaagtttcttcatccactaatggcaagaaggtctaatatataaaccccatcgaaaagtataataaattatacatatttatacaaaatggaattgctccaggcattagatattaataaacttacacatttggaaatcagtccaatattcattgaaaataatcactttaagattcaattaatgcattcaacattatttttgtctgtaaaattagtctgctctggaatatcactttactataaagaattttcattaaatagctattttaacaagacagccagcactttggaaaaaactaaatattcatattaaatttcaactcatttgaataactaataaagaatatatgtctgatgtctgatactaataaacatgaataatgaggcactgtgatttatcccaattctagcactccttcctgattacagtagtcattggagcagccagaaatcagatcttctggtatgcaaatattctaaatgcatgtgaagtgagttcactcaggcttcctcagcagaaaccccaaaattacctaaataacttcttccttcccctctttcttgccttgcaatccctctcttgatgaaaataattactacatcagtggtcaccttgctcctcattctccagtgtttatgggttattatgacaacttcctccctctggtttaagcagtaccatctgacatctataatttctattacttttttctctttctccttcccctttccatagaaacatgctctgaaataagagcaaaattatgctgtccccggatcctcttatctcttatgtcttgaactgttttccaacggttcttctacacaatttcaatgtagggaagtctataagcttgttactaagatcatggccaaggaccagcagcatcaacaacacctgacaactcagtagaaatgcacaatctcaggcctgctgaatcagaaagtgcattttcaatgagccccctgctgatctattcaggggtgggacgttgtcttctatcttgagtgcacatgacattaaatgtatattgccaaattacctgttccagatttcccaccgcccgttattcttgtggcaatattcaaaagagaaactttctttttaaatataacctgaatggaaagagaaacaaaatagtcaatacataatatatatttcataggctatgcaataaataattcaaaatataaatgaaagagtaactaccttctgggccgattgtttctgaggagacactgaaaagtaaaagaaatatataatccatcatatgtaaatatgataaagttatccacacattcatgcagtgttagcatcaagctgtatcctcctgcctgtactagtgtaggatttgatgttttacagtttgtgtctttgggacaggaacatgaggaaatatgctgaagaaaataggaatacacgcttccagaaaatattcagtcagaaattacaaagaggtattttgcgtcatgtgtgtattactgaaataaaaagtgtcaatatcaatgtggatatgctgaatgatgaaaagaaatgtgatctaaaatcagaggagcaactcatacacccaggaaccaatgtcaaagaaggtactaaatgctactgcatgtttttcatgcaagacatcagaaggatttataccactgtactgcaagtattcatcatgctctttaacttgcctggtaattgagcaggtacacaatgacaatgacactttaatagaatgtacacttcacaagtcctcagtggaagtgtcgcagcttcatcagcttggatataggttgggataatcctgtatacaatattctttatttctcaaacccatgtggtgtaataatgtgcctacatttgttgtgtcctctagtttaggctacagaaaggttcttcatccactcatggcaacaaagtataatatataaaccatatcaaaaagtataataaatgatcaaatgacaaacttatacaaaataaagttgctacaagcattagatatgaataaccttttacatttggaaatcactacaatattcattgaaaataacaattttaaaagtcaattaatgaattcaaattaattttgtttctaaaatagtctggtttgaagtatcatgttactctctaaagcattttcattaaattgctattttatccaaagttagctaattgaaaagccaatatatgcatattcatgtttatttcatttgaataactaatatcaacaaaacatatatctctgacacccaagagtaacaaagaggagcaatgagtcactgtggtttatcccaattctaggagtccttcctgcttccactggttcctaaagcagtcaaaatcaaatcttcttttaggaaaatattcgaatatgcatctgaacacaagtttcctcagaagaaacaacaaaattacctaaataacttcttattttccctcctttctgcctgacaatccctcttccttgaggaaagtaattgctacatcagcggtctcgttagttctcattctacagtgtttatgggttattgtgatcacttttccatctgtttttaggaacgcgatgtgatatctgtaaaatctatacttcatctctatctcctaccacccttggtgaaaacatgctgtagaattaaagcaaaattatgctgtcccctgagccccttatgtcttgacatggtctccaatgtttcttcttcccaatttcaatgtggggaagtctataatcttacttcgaagatcacgtccaagaccagcagcatcagcgtcacccgagaacttattacaaatgaagaatctcaggtctgcagaatcggaatgtgcagctgcgacgaacccccccgctgatttatttggggaagagaagttcttttctatctggactgaacatgacattaaatgtgttttgtaaaattacctgtcccagatttttctccatcctttatttctctggctatattcgaaacagaatctttctcatcacctgtagtctgaatggaatttgaaacaaaataataaataaataaagtatgtttcatagactatacaattactagttcacaatataaataagagtttaattaccttcaaggctggtcgtctctgagaagacactgaaaagcaaaagggatacataatcacccacatgcacgtatgataaagttattcatacattcatgcagtgttagcatcaagctgtatccttctgcctgtactagggtaggatttgatgtttcctactttgtgtctggggattggaacatgacagaaatacactgaaaaaaagtaatacagccttcatgaaaaatatacttacaatttcaagcatggtatgatttgtcatatgtctaaaactaaaataaaaccgtgtcaatatcaacgtggatatgctgagtgatgaggacaaatgtgatctaaaatcagaggatcaactcatacacctgagaatcaatgtcaaagtaggtggtacttgatcccacaggtctttcatgcaagaaatcaaaaggatttacaccattatactacagacattcatcatgctctttaacttgcccgataacagagaaggtacacaattacaatgacacttcagttgaatgtacacttcacgtctcttcagtagaagtgtcctaaattgatcaccttggatatctgtttgctgaaactgagtagataatatttattattcctcaaacccacgtggtgtaataatttgcctaagtttcttgtatccactcgtttagctttccaaaagtttcttcatccattcatggcaccaaaggataatatattagcctcaataaaaatatcatcaattatcaattttgacatacttctacaaagtaaaactgctacaagcgttagatattaatatgttttacattcacaaatcactccaatattcattgaaaatgaccactttaggagttaattagaattccacatactttttgtttctaaaatagtcttgttgggagtatcatgctattctctaaagaagtttcatccaatagctattttacccaagagttagctccttgaacaacgaagccaatgtattcatattcaagtttatctcatttttataactaaaatcaacaaaacatgtatctctgatgcctaatagtagcaaagaagagtaatgagtcagtgtgctttatcccaattctagcattgtttcctgcttccagtagttcttggagaagccaaaatttagtgttcttttatgcaaatattccaaatttatctgaagtgagttcactcagctttcctcaacagaaaccccaaaattacataaataacttcttcttttctctccttcctgcctcacaatccctcttccttgtggaaaataattgctacttcagtgatcttgttcgttctcattctatgctgtttttgaggtattaggatgacgtttccctctgtttataacaatataatctgacgcctataatatctattacttcatctctttctccttcccctcttgatggaaacttgctgtagaattaaagcaaaatgatgctgtcccctgaggctgttatgtgctaaaccactctcctatggttattcttcctaatttcaatgtagggaagtctacaatcttactactcagatcatggtcaaggaccagcaccatcagggtcacccgaggacttattacaaatgaagaatctcaggcatgctgaatccaaacataaagcttcaatgaaacccccgctgatttatttggggaagtgaatttctcttctatttgatcgaacattacattaaaggtgtattccaaaatacctgtcccacgtatttgtccatcctttatttctgtggctatattcgaaacagaatctttcttgacacttgtagcctgaatgggatttgaaacaaaataatcaatacataaagtatatattcatagactatacagttaatagttcaaaatatatatgagtgtttaattaccttccaggccggttgtttctgagaagacactgaaaagcaaaacagatacataatcactcatatgtgcatatgataaagttattcaaacattcatgcagtgttagcatcaagctgcatctgtctgcagttattagtgtaggctttgatgctttatactttgtgttttgggatgggaacatgacagaaatacactgaagaaaacaggaatacaggtttcaagaaatatacactaagcatttcaaacgtagtatgatttgtcatatgactaaaactaaaataaaagtgtcaatttcaataaggatatgccgagtgatgaggacaaatgtggtctaaaatcacagaagaaactaatcacctgggaatcaatgtcaaagcaggtggtacatgcacccgcatgactttcatgcaagatatccgaatgattaaaccattatactgcaaacattcaacatgctctttaacttgcccaataactgagaaggtacacaattacaatgacacttcacttgaacgtacacttcacatctcttaagtggaagggacctaaatcgatcaacgtggatgtatgtttcctgaatccaagtaaataattcattatttctcacacccatgtgctgtaataatttgcctaagcttcttgtattctctagtttagccttttgaacatttcttcatccactcgtggcaacaaagtataatatataacctcaataaaaagcatcatcaattatcaattttgacataattctactaaataaaactgctacaagtattggatattaataagcttttacacttggaaatcactccaatattcattgaaaattaccattttaggagtcagttgttgaattcaacattatttttgtttctaaaatagtcttgttaggagtatcatgctattctctaaagaatattcattaaatacctattttatccaagagtcagctctttgatcaatgaagccaatgtattcatattcaagtttatctaatttctataactaaaatcaacaaaacgtgtaagtctgatacctaacagtaacaaagaagagtaattagtaaatgaagtttatcccaattctagcattatctcctgcacccagtagttccagcagctgccaaaatcaaatcttctttatgcaaatatgctaaatgcctctgaagtgagtccactcaggtttcctcagcagaaaccccaaaattacataaataacttcttcttttccctccttcctgcctcacaatccctcttccttgggaaaaatcattgctatatcagtggtctccttagttctcattctacagtgtctacaggttattaggatcactattctgtcttttttatagcagtatgatgtgacatctgtaaaatatatacttcatgtctttctccttctacccttattgaaaacatgctgtagaattaaagcaaaattatgctgttcccctgagccccttatgtcttgaactgctctccatatttcttcttcccaatttcaatgtggggaagtctatataatcttactgcaaagatcatgtccaagaccagcagcatcagcgtcacccaagaacttattaaaaatgaagaatgtcaggcctgctgaatcagaatgtgcagttttgatgagccccacactgatttgttcggggaagagaagtacttttctatctggactgaacatgacattaaatgtgttttgcaaaattacctgttccagattgttgtccatcctttatttctgtgggtatattcgaaacagaatctttcttgtcacttgtagcctgaatggaatttgaaacaaaataatcaatacataaactatgtttcatagaccacacagttaatagttcacaatataaatgagagtttaattaccttcaaggctggttgtttctgacaagacactgaaaagcaaaagggatacataatcactcatatgtaaatatgataaagttatccatacattcctgcactgttggcatcaagatgtatcttcctgcctgtattagtataggctttgatgttttctactttgtgactcgggactggaatatgacagaaatacactgaaaaaggtgaatacaggcttcacaaaatatacttacaatttcaaacatggcatgatttgtcatatgtctaaaactaaaataaaaccgtgtcaatatcaatgtggatatgccaagtgatgaggacaaatgtgatctaaaatcagaggagcaactcatacaattgagaatcaatgtcaaagcaggttctacatgatgccacatgtctttcatgcaagaaatcacaaggatttacaccattatagtacaaacattcatcatgctctttaacttgcccaataactgagaaggcacacaattacaatgacacttcagttgaacgtacacttcacgtctcttcagtggaagtgtcctaaattgatcagcttggattatgtttgctgaaacctagtagctaatattcattatttctcacacccctgtggtgtaataatttgcctaagtttcttgtatccactcatttagccttctgaaagtttcttcatccactcatggcaccaaaggataatatattagcctcaataaaaatatcatcaattaccaatgttgacgtacttctacaaagtaaaactgctacaagcattagatattaataagtttaacattcagaaatcaatcaaatattcattgaaaggaccactttaggagttaattagaattcaacataatttttgtttctaaaaagtcttttttggagtatcatgctattctctaaagaagtttcattcaatagctattttatccaagacttagctccttgaactttgaagccaatgtattcatattcatttatctcagttttataactaaaatcaacaaaacatgtatctctgatgcctaatagtaaattactcctaaagaggagtaatgagtcactgtggtttatcccaattctagcatagtttcctgcttccagtagtgcctggagctgccaaaatcaagtcttcttttatgcaaatgttccaaatgtattgaagtgagttcactgaggtttcctcagcagaaatcccaaattacataaataacttcttcttttctctccttcctgactcacaatccctattccttgaggaaaataattgctacatcactggtcttgttacttgtcattctacagtgtttttgtggtattaggatcacttttccctctgtttatcccaatacaatctgacacctctaatatctattatttcatctctttctctttcccctcttgatggaaacatgctgtagaattaaagcaaaatgatgctgtcccctgagcctgttatgtgttgaattgctgtcagatggttctttttcccaatttcaaagtacagacatctaaaatcttagtactttcagcatggacaaggaccacagcatcagggtcacccgagaacttattacaaatgaataatctcaggaatactaaatcagaacatgaagatttgacgaaccccccgctgctttatttggtgaagagaagatctcttctatcttgaacgaacatcatattaaatgtgtttgcaaaattacctgtcccagatatttgttcatcctttgtttctgtggccatattcggaacagaatcttccttgtcacttgtagcctgaatggaatttgaaacagaacagtcaataaataaagtatatttcatagactatacagttaatagttcaaaatacaaaagagagtttaattaccttcaaggatggttgtttatgagaagacactgaaaagcaaaagggatacataatcactcatacataaatatgataaagttatccatacattcatacagtgttagcatcaacctctgtcctcctgcctgtaatagtgtaggctttgatggcttctactttgtgtctggggacaagaacatgacagaaatacactgaaaaaagggaatacaggctccatgaaatatatccttacaatttcaaacatggtatgatttgtcatatgtcgaaaactaaaataaagccctgtcaatatcaatgtcgatatgccgagtgatgaggacaaagtgatctaaaatcagaggagcaactcatacacgtgagaatcaatgtcaaagcaggtgctacatgatcccacatgtctttcatgtaagaaatcaaaaggatttacaccattatactacaaacattcatcatgctctttaatttgcccgataactgagaaggcacagaattacgacgacatttcagttgaacgtacacttcacatcccttcagtggaagtgtcctaaattgatcaccttggatatctgcttgctgatacctagtagataacattcattatctctcacacgcacgtggtgcaataatttgcctaagtttcttgtatccactagtttagacttctgaaaatttcttcatccactcttggcaccaaaggataatatattagcctcaataaagatatcatcaattatcaactatgacatatttcttcaaagtaaaactgctacaagcattagatattaatcagtttttcattcagaaatcactgcaatattcattgaaaattataattttaggagttagttagaattcaacatcatttttgtttctaaaatagactttttgggaggaccatgttattctcgaaagaagtttcatgaaatagctatttcatccaagaggtagccccttgaacaaggaagcaaatttattcatattcaagattatcgcatttttataactataatcaacaaaatatgtatctctgatgcctcctagtaacaaagaggagtaatgagtcagtgtggtgtattccaattacaccattgtttcctgcttccagtagttcctggagcagccaaaatcaaataacttttatgaaaatattccaaatgcatctgaagtgagttcactcaggtttcctcagaagaaaccagaaaattatataaaagaattcctctttttcagccttcctgcctcacaatccatcttctttaggaaaatagttgctacaccaggggtctccttagttctcctacagtgtctacgggttgttacaacaagctttctgtcttttcttggcagtatgatctgaagtgtgtaaattctatacttcctctctttctccttccacccttactgaaaacaagctggagaattaaagcaaaattatgttgttccccagagccccttatgccttgaactgctcaccatatttcttcttcccaatttcaatgtggggaagtgtataaccttactgcgaagatcatgttccagaccagcagcaacactatcacccacgaacttatttgaaatgaagaatctcaggactgctgaatcagaatgtgcagcttcaacgagccccccgcagatttattcagggaagagaatttcttatctacccggactgaacatgacattaaatctcttttcaaaattacctctcctagttttttctccatctttttttcctctggctatattcaaaagagaatctttctcgtctcttgtagcctgaatggaatttgaaatgaaataataaattaataaagtatgtttcatagactatacatttactagttcacaatataaatgacagtttcattaccttcaagcctggtggttgctcaaaagacactgaaaagtaaaagggattcataatcactcatatgtaaaaatgacaaaattatccacacattcacgcagtgttagcatcaacctctgtcttcctgcctgtattagcataggctttgatggcttctactttgtgtctggggactagaacatgacagaaatacgctgagaaaagggaatacaggctccatgaaaaatactcttataatttcaaacagggtatgatttgttatatgccaaaaactaaaataaaaccgtgtcaatatcaacgtggatatgctgagtgatgaggacaaagtgatctaaaatcagaggagaaactcatacacctgagaatcaacgtgaaagcaggtgctacatgatcccacatgtctttcatgcaacaaatcaaaaggatttacaccattatactacaaacattcatcatgctctttaaattgcccaataactgagaaggcacacaattgcaatgatacttcagttaaacttacacttcacatctcttcagtggaagagtcctgaattgatcaccttggacacctgtttgctgataccaagtagataatattcattatctctcacacccatatggtgtaataatctgcctaagtttcttgtatccactagtttagccttccaaaagtttcttcatccagtcgtggcaccaaaggataatatattagcctcaataaaaatatcatcaattatcaattttgacatacctatacaaagtaaaactgctacaagcattagatactgatcagtttctctttcagaaatcactgcaatattcattgaaaatgaccattttaggagttaattagaatccagcataatttttgtttctaaaatagctttgttgggagtatcatgttgttctctaaagaagtttcatgaaatagctattgtatccaagaggtagctccttcaacaaggaagccaatgtgttcatattcaagtttgtctcatttctataactaaaatcaacaaaacatgtatctctgatgcctaatagtaacaaagaggagtaatgactcagtgtgtttttatgccaattctaggattgtttccttcttccagcagttcctgcagcagccaaaatcaagtattttttattaaaatattccaaatgcatctgaagtgagttcactcaggtttcctcagcacaaaccccaaaattatataaatgacttcctcttttcacaccttcctgcctcacaatccgtcttccttgggaaaatgattgctacaccaggggtctccttagttctcctacagtgtgtacgggttattacaacaagtttgctgtctgtttttagcagtatgatgtgatgtctgtaaaatcgatacttcctctctttctccttccacccttactgaaaacaagctgtagaattaaagcaaaactatgctcttccccagagccccttatgtcttcaactgctctccatatatcttcttcccaacttcaatgtggggaagtgtataatcttacagcgaaggtcatgttccagaccagcagcatcagcatcagcatcagcatcactcaagaacttactacaaatgaagaatctctggcctgctgaatcagaaagtgcagcttcgacgagccccccgctgatttatttggggaagagaacttcttatctatctggactgaacatgacattaaatctgttttcaaaattacctgtcctagatttttctccatcctttttttctctggctatattcaaaacagaatcttccttgacacttgtagcctgaatggaatttgaaatgaaataataaataaataaagtatgtttcatagaccatacattaactagttcacaatataaatgagagtttcattaccttcaaggctggtggtttctgagaagacactgaaaagcaaaagggattcataatcactcatatgtaaatatgacaaagatatccacacattcatgcagtgttagcatcaaactctgtcctcctgcctgtattagcgtaggctttgatggcttctactttgtgtctgcggactagaacgtgacagaaatgcactgagaaaagggaatacaggctccatgaaatatacccttacaatttcaaacatggtatgatttctcatatgtcaaaaactaaactaaaaccgtgtcaatatcaatgtgcataggccaagtgatgagaacaaatgtgatctaaaatcagaggagcaactcacactcctgagaatcaatgtcaaagcaggtgctacatgatcccacatgtctttcatgcaacaaatcaaaaggatttacaccattatactacaaacattcatcatgctctttaaattgcccaataactgagaaggcacacaattgcaatgatacttcagttaaacttacacttcacatctcttcagtggaagagtcctgaattgatcaccttggacacctgtttgctgataccaagtagataatattcattatctctcacacccatatggtgtaataatctgcctaagtttcttgtatccactagtttagccttccaaatgtttcttcatccagtcgtggcaccaaaggataatatattagcctcaataaaaatatcatcaattatcaattttgacatatttctacaaagtaaaactgctacaagcattagatattgatgttttacattcagaaatcattccaatattctttgacaatgatcactctaggacttaattagaatgcaacataatttatgcctctaaaatagctttgttgggagtatcatgttattttctaaagaagtttcattaaacagctattttatacaagaggtagctccttgaacaaggaagccaatgtgttcatattcaagtttatctcatttctataactaaaatcaacaaaacatgtatctctgatgcctaatagtaacaaagaggagtaatgagtcattgtgtttttatgccaattcaagcactgtttcctgcttccagcacttgctggagttgccaaaatcaaatattgtttatgaaaatgttccaaatgcatctgaagtgagttcactcaggtttcctcagcagtaaccccaaaattatataaatgacttcctcttttcccacattcctgcctcacaatccgtcttcattcagaaaataattgctacatcaggggtctcctcagttctccttctacagtgtctatgggttattatgaacagttttctgtctgtttttagcactacgatgtgacgtctgtaaaatctgtacttcctctctttctccttacacccttaatgaaaagatgctacagaattaaagcaaaattatgctgtgccccagagccccttatgtcttcaactgctctctatatttcttcctcccagttgcaatgtggggatgtgtataatcttacagccaagatcatattccagaccagcagtatcagcataacccaagaacttattagaaatgaagaatctcaggcctgctgagtcagaatgtgcagcttcgaccagccccccactgatttattcggggaagagaacttcttatctggactgaacatgacattaaatgtgtttcgcaaaattacctgtcctagatatttctccatcctttttttctctggttatattcgaaaaagaatctttctcatcacttgtggcctgaatggaatttgaaacaaaataataaataaggtatgtttcataggctatacgtttactagctcacaatataaatgagagtttcattaccttcaaggctggttttttctgagaagacactgaaaagcaaaagggatacataatcactcatatgtaactatgacaaagttatccatacattcatgcagtgtttgtatcaacctctgtcctcctgcctgtattagcgtaggttttgatggcttctactttgtgtctggggattagaacatgacagaaatacactgagaaaaggaaacacaggctccgtgaaatatacccctgcaatttcaaacatggtatgatttctcatacgtcgaaaactaaaatcaaaggttgtcaacatcaatgtccatatgccgagtgatgaggacaaatgtgatctaaaatcagaggagaaactcatacacctgagaatgaatgtcaaagcaggtgctacatgatcccacatgtctttcatgcaacaaatcaaaaggatttacaccattataatacaaacatgcatcatgctctttaacttgcccaatatctaagaaagcacacaattatgatgacacttcagttgaacgtacacttcacatctcttcactggtaatgtcctaaattaatcaccttggatatctggttgctgatacctagtagataatattcattatctctcacacccatgtggtgtaataatttgcctaagtatcttgtatccactagtttatccctctgaaaatttcttcatccagtcgtgacaccaaaggataatatactagcctcaataaaaatatcatctattatcaattttgacatacttctacaaataaatctgctacaagcattagatattaatcactttttcattcagaaatcactgcaatattcattgaaaatgaccattttaggagttagttagaattcaacataatttttgtttctaaaatagccttcttgggagtatcatgttagtctgtaaagatgtttcgtgaaatagctattttatccaagaggtagctccttcaacaaggaagccaatgtattcatattcaagtttatctcatttctataactaaaatcaacaaaacatgtatctctgatgcctaatagtaacaaaaaggagtaatgagtcagtgtgctttatcccaattctagcattgtttcctgcttccaatagttcctggagctgccaaaatctaatattttttaaggacatattccaaatgcatgtgaagtgagttcactcagatttcctcagcagaaaaccctaaattatataaataacttctcttccctccttcctgcctgacaatccctcgtccttgggaaaataattgctacatcaggggtctccttagttctcattctacagtgtttatgggttattactatcagttttctgtcttttcttcgcagtacgatgtgacgtctgtaaaatctatacttcctctctttctccttccacccttagtgaaaccatgctgtagaattaaagcaaaactatgctgctccccagagccccttatgtcttgaacctctctccaatatttcttcttcccaatttcaatgtggggaagtgtataatcttactgcgaagatcacgttccaagccagcagcattagcgtcacccaataatttattacaaatgaagactctcagacctgctggatcagaatgtgcagcttcagcgagccccccacccgccctgcgctgatttattaggggtagagaagttcgtttctatctggattgaacatgacattgaatgtgttttgcaaaattacctgtcccagatttttctccatcctttatttctgtggctatattagaaacagaaccttcctcgtcagttgtagcctgaatggaatttgaaagaaaataataaataaataaataaatgaagtatgtttcatagactatagatttactagttcacaacataaatgagagttcaattaccttcaaggcttgttgtttctgagaagacactgaaaagcaaaagggatacataatcactcatatgtaaatatgatacattttccatacattcatgcggtgttagcatcaagctgtatccgcctgcctgtattagtgtaggctttgatgttttctactttatgtcttaagccaggagcatgacacaaatatactaaagaaaacagaaatagatgtgtcacgatacattcctaactatttcaaacataatatgatttctcgtatatctaaaagaaaaataaatcagtgtcaatatcaaaaagggtatgccaagtgatcatgacaaatgcgatcaaaaatcagagaggaaactcaatcacctgggaaaatgtcaaagcaggtggcacatgcacccacatgtcttttatgcaagatatccaaatgatttacaccattatactgcaaacattcatcatcttcattaacttgcccagtaactgagaaggtacacaattacagtgacacttcagttgaatgtacacgtcatgtctctgtctcttcagtgaagtgtcctaaattgatcagcttggatatatgtttcctgaatccgagtaaataatattcattatttctcatatccatgtggtgcaacaatttgcctaagtttcctgtattctctagtttagccttcccggacatttcttcatccactcatggcaacaaagtataatatataaacctcaataaaaagcatcatcaattatcaattttgacatacttctactaaataaaactgctaaaagcattggatattaataagcttttatatttggaaatcactccaatattcattgaaaatgaccattttaagagtcagttgatgaactcaacattatatttgtttttaaaattgtcttgttaggaggatcatactattctctaaataatattcattaaatagctattttatccatgagatagctctttgatgaaagaagccaatgtattgatattcaagtttatctaatttttataacaaaaatcaacaaaagatatatatcttatgcctaatagtagcaaagagaagtaatttgtcaatgtggtttatcccaattctagctttctttgcttcatccagtagttcctggagctgccaaaatcaaatcttttttgtgtaaatatgctaaatgcatccgaagtgagttcactcaggtctcctcagcagaaaccccaaaattacataaataacttcatcttttccctccttcctgcctcacaaccctcttccttgaggaaaataattgctacatcagtggtctcgttagttctcgttctacaatttttactggttattacgatcagttttccgtctgtttttatcaatacgatgtgacgtttgtaaaatctatacttcaactcattctccttccacccttggtgaaaacatgctgtagaattaaagcaaaattatgctgtcccctgagccccttatgtcttgatctgctctccaatgtttcttcttcccaatttcaatgtggggaagtctataatcttactgtgaagatcatgtccaagaccagcagcatcagcatcacccgagaacttattacagatgaagaatctctggcctgctgaatcagaatgtgcagctttgatgagcccccccactgatttatttggggaagagaagttcttttctatctggactgaacatgacattaaatgtgttttgcaaaattacctgtcccacattgtagtccatcctttatttctgtagctgtattcaaagcagaatctgtcttgtcacttgcagtctgaaagtaatttgaagcaaattatcaataaagaaagtatgtttcatggactatacagttactaatacaaaatataaatgagaatttaattacctttgaggctggttgtttctgagaagacactgaaaagcaaaagggatacataatcactcatatgtaaatatgataaagttatccatacattcatgaaatgttagcatcaagctgtatcttcctgcctgtattagtataggctttgatttttgtgtctggggactggaacatgacagaaatacactgaaaaaaaagaaatacaggtttcacaaaacaaacccttacaatgtcaatcatggtatgatttttcatatgtctaaaactaaaatgaaacagtgttagtatcaatgtgaatatgccgaatgatgaggacaaatgtgatctaaaatcagaggagcaactcatacacctgagaatcaatgtcaaagcaggtgctacatgatcctccatgtctttcatgcaaggtatcaaaaggatttacactagtatactacaaacattcatcatgctctttagcttgcctgataactgagaaagtacacaattacaatgacacttcagatgaatgtacacttcacgtctcttaagtggaagggacctaaattgatcagcttggatatatggttggtgaatcctagtagatagtattcattatttataatacccatgtggtgtaataatctgcctacatttcttgtatcctctagtttagccttcagaaattttcttcatccactaatggcaggaaggtataatatataaacctcatctaaaagtacaataaattacacatatttatacaaaatgcaatggctcctggcattagatattaataagcttttacatttggctatcagtccaatattcattgaaaataaccattttaggattcaattaatacatttaacattatttttgtctgcaaaattagtctactctggaatatcattgtattataaagaattttcactaaatagctattttaatgaaaaagcattcggaaaatgctttggaaaaaagctttggaaaaaagctaatatagtcatattaaattttaactcatttgaataactaataaaaaatatatgtctgatgtctgatactaataaacaggaatgaggcactgtggtttatcccaactctagcactccttcctgattccggtagtcatcggagcagtcagaaatcaaatcttctggtatgcaaacattctaaatgcatctgaggtgagttcactcaggtttcctcagcagaaaccccaaaattacagaaataacttcttccttcccctctttcttgccttgcaatccctctttcttgatgaaaatagttactacatcagtggtcactttgtttctcattctccagtgtctacgggttattatgacaacttcctccctctggttttagcagtaccatctgacatctataatttctgttacttcttctctttctccttcccctctccatagaaacatgctctgaaataagagaaaaattatgctgtcccctgatcctcttatgtcttcaactgttttccaatggttcttctatccaatttcaatgtagggaactctataagcttgttactaagatcatgaccaaggaccagcagcatcagcaccacctgacaacttactagaaatgcacaatctcaggcctgctgaatcagaaagtgcattttcaatgacaccccactgatctattcaggggtgggacgttctcttctgtcttgagtgcacatgacattaaatgtgtattgccaaattacctgttccagatttcccaccgcccattattcttgtggcaatattcaaaagagaaactttctttttaaatataacctgaatggaaagagaaacaaaatagtcaatacataatatatatttcataggctatgcaataaataattcaaaatataaatgaaagagtaactaccttctgggccgattgtttctgaggagacactgaaaagtaaaagaaatatataattcatcatatgtaaatatgacaaagtcgtccatacattcatgcagtgttagcatcaagctgtatcctcccgcctgcactagtgtaggatttgatgttttacagtttgtgtctttgggacgggaacatgaggaaatacactgaagaaaataggaatacacgcttccagaaaatatacagtcagaaattacaaagaggtattatgcatcatgtgtgtattactgaaataaaaagtgtcaatatcaatgtggatatgctgaatgatgaaaagaaatgtgatctaaaatcagaggagcaactcatacacccaggaatcaatgtcaaagaaggtactaaatgctactgcatgtttttcatgcaagacatcagagggatttataccattatgctgcaagtattcatcacgctctttaacttgcctggtaattgagcaggtacacaatgacaatgacactttagtagaatgtacacttcacaagtcctcggtggaagtggcccagcttcaacagcttggatataggttgggataatcctgtatataatattctttatttctcaaacccatgtggtgtaataatgtgcctacatttgttgtgtcctctagtttaggctacagaaaggttcttcatccactcgtggcaacaaatataatacataaaccttatcaaaaagtataataaatgatcaaatttgacatacttatacaaaataaagttgctacaagcattagatatgaataacctttgacatttggaaatccctccaatattcattgaaaataagaattttaaaagtcaattaatgaattcaccattatttttttttctaaaatagtctggtataaaatatcatgttattctctaaagcattttcattaaattgctatttttatccaaaagttagctaattgaaaagcaaagccaatatacgcatattcatgtttatctcatttgaataactaatatcaacaaaacgtatatctctgatgcccaacagtaacaaagaggagtaatgagtcactgtggtttatcccagttctagtactccttcctgcttccactgtttcctaaagcagccaaaatcaaagcttcttttacaaaaatgttcgaatatgcaactgaactcaggtttcctcagaagaaaccccaaaattacataaataacttcttattttccctccttcctgcctgataatcctcttccttgaggaaagtcattgctacatcagtggtctccttagctctcgttctacagtgtttatgggctattaccataatttctccatctgtttttagcaatacgatgtgatgtctgtaaaatctatacttcatctctttctccttcctcccttggtgaaaacatgctgtagaattaatgcaaaattatgctgtcccctgactccttatgtctttaatggctctccaacgtttcttcttcccaatttcaatgtgaggaagtctataatcttactgcaaagatcatgtcgaagaccagcagcatcagtgtcacctgagaactgaggaatctcaggcctgctgaatcagaatgtgcagcttcaatgaatcccccgctgatttattcggggaagagaagtacttttctatcttgactgaacatgacattaaatgtgttttgcaaaattacctgtcccagattgttgtccctcctttatttctgtggctatatttgaaacagaatctttctcgtcacttgtagcctgaatgggatttgaaacaaaataatcaatatgtaaagtaggtttcatagactatacggttaatagttcaacatataaatgagactttaattaccttctcagctggttgtttctgagaagacactgaaaagcaaaagggaaacataatcactcacatgtacatatgataaatttatccatacattccatgcagtgttagcatcaagctgtatcttcctgcctgtactagtgtaggctttgatgttttctactttttgtctggagactggaacatgacagaaatacactgaaaaaaaaggaatacaggcttcacaaaatatacccttacaatttcaaacatggtatgattcgtgatacatctaaaactaaaataaaaccgtgtcaatatcaatgtggatatgccgagtgatgaggacaaatcagaggagtaactcacacacctgagaatcaatgtcaaagcaggtggtacatgatccctcatgtctttcttgcaagaaatcagaaggatttacaccattatactacagatgttcattatgccctttaacttgcccaataactagaaggtacacaattacgatgacaattcagttaaatgtacacttcacgtctcttcggtggaaatgtcctaaattgatcaccttggatatatgtttcctgagatctagtagataatattcattatttctcacacccatgtggtataataatttgcctaagtttcttgtatccactagtttagctttctgaaagtttcttcatccactcatggcaacaaacgataatgtattagcctcaataaaaatatcaattaccaatgttaacatacttctacaaagtaaaactgctacaagcattagatattaataagttttacattcagaaatcactccaatattcattgaaaatcaccactttaggagttaattagaattcaacatcatttttgtttctaaaatagccttgctgggagtatcatgttagtctctaaggaagtttcattaagtagctattttatccaagagtaagctccttgaacaaggaagccaatgtattcatatgcaagtttatctcatttttataagtaaagtcaacaaaacatgtatctctgatgcctaatagtaacaaagaggagtaatgagtcactgtggtttatcccaattctagcactgtttcctgcttccagtagttctcagagcagccaaaatcaaatcttcttttatgcaaatattccaaatgcatctgaaatgagttcactcaggtttcctcagcagaaaacccaaaattacataaataccttcttctttttcctccttcctgcctcacaatccctcttccttgaggaaaataattgctgcatcagtggtcttcttagctctcattctacagtgtttatggagttattaggatcacttttccctctgttgataacaatatgatatgatgcctataatatctattacttcatctcattctctttcccctcttgatggaaacatgctgtaaaattaaagtaaaattatgctgctcccttagcctggtatgtgttgaactgctctccaatgtttcttcttcccaatttcaatgtaaggaagcctacaatcttactactcagatcatgaccaaggaccagcagtatcagagtcacctgagaactcactacaaatgaagaatctcaggtgtactgaatcagaacgtgcagcttatatgaactccccactgatttatttggggaagggaatttctcttctatcttgattgaacatgacattagatgtgttttgcaaaattacctgtcccagatataggtccctcctttatttctgtggctatatttgaaacagaatctttgtcgtcacttgtagcctgaatgggatttgaaacaaaataatcaatatgtaaagtaggtttcatagactatacagttaatagttcaacatataaatgagactttaattaccttctcagctcgttgtttctgaggagacactgaaaagcaaaagggatacataatcaatcatatgtaaatatgataatgttatccatacattaatgcatggatagcatgttagcatcaagttttgtactcctgcctgtattactgtaggctttgatattttatactttgtttcttgggactaaacatgaaggaaatacactgaagaaaataggaatacaggcttcaagaaatatacactgacaatttcaaatgtgatatgactttctccatatgtctaaaactaaaataaaaccatgtcaatatcaatgtggatatgctgagtgatgaggacaaatgtgatctaaaatcagagtccaactcatacacctgggaatcagcgtcaaagcaggtgatacatgcacccacatgtctttcatgcaagatatcagaatgatttggaatattttactgcaaacattcatcatgctttttaacttgattgatcagtgagaaggtacacaattataatgacactttagttgaaatctcttcagtggaagtgtcctaacttaatcagcttggatatatgtttggtgaattctagtatgtaatattcattatttctcacacccatatggtgtaataatgtgcctacatctcttgtatcttctagtttagccttccaaaagttccttcatccactcattgcaacaaggtataatatataaacttcatcaaaaagtgtaataaattaccaaatttgacatacttttacaaaataaagtttctacaagcattagatatgaataagcttttacatctggaaatcactccaatattccttgaaaataaccatttgggagtcaagtaatgaattcaacattattttcacttctaaaatagtctggttaaagtatcatgttattctctagagaatttttattaagttgctattttatccaatagctccttgaaaaacaaagccaatgtatgcatattcacatttatctcatttgaataaccaatatcaacaaaacatatacctctggtgcccaatggtaacaaagaggagcaatgagtcactgtggcttatcccaattctatcactctttcctgcttccagtagttcctggagcagccaaaaatcaaatcatccctcatgcaaatattctaaatgcatctgaagtgagttcacttaatctaagagttataatttaaaaaatcattttatttatactcatgaagactcctgatgtttttacatttcctggattcagcagttctaccttctcactgtctcttcgtccacttttgcaaaaacatacacatcaatgaaatactgtgtaatcagattcctatgaaaataaactaaacaaagtttctaaatcactagagacttcttttcttataaataaccaaccaatatgacataatacatatatatacatatgtcatgattgtcatgattattggcagttatctgtttagtactctaaaaatgcattctttgattccttttttttaaaatctagtttcacatgatataccatcagggtctctcaggttcttttacaaaataactacctcagcaaacacagctttccaaaaacaaaaacaaaaaacaaaaatctgatgtgaacgaagcatgtatcattgatgtccaaaacttctagggagaagaaatgagaccctgtgggttaccctcatccttgtaacttctgcttctgctttccattaagtgacttcccacaagtctcctcatcagaaacttccaaattacctcactagctgctttctttgtttacacctgcccaatttgacatacatttttttcgttcataaatctaatatccatattggtggacttgattctttgacctccacattcatttcttcattattttcaccaccactgtatgtgacatctgtacagtcccattctgacacatgtgaagataaggttttgctttattaaaatgttaaatgtgtcagacacttgactaatgtgtacaaattccttcttcacaaaagcagccccatggcctcctctctcccatagacactctttcacagctgttcttcactcacatcggtttgagtatctatcatctcttattttgtcgctatgctttcacctcatattatgagttattatcataggctcagcagcctatcttacctgttttcctctccagcagacagtactgagcaataaactaggattttccaggatatgaacacttttatgtacacaacactttgtggagctattttatgtttaactacccatagcaccactatgtttatgctttccagagaaataagctctgaaattttattgaatataacctatttaaaaacttatttaactacaatgacagtctctccttgatgcaccaaaatcttcagaaataacttgtgaagacttgaaaacatgtcagtaattgacatgaaaaatgaagcactgacataattttttgcaggtataaaaaagacaagctgagatccttactagatccaagaagagcaaagtacgttagacaggaaataaatatggaacacaaatattttcacttgtaatgaaaattcctctatttacagttttcagaagagaaaaaaatacacacacacacacacacacacattcacacacaaaaaccagagcaatatggctttacggggtgtttcttcatcaaagtcctatttgccatttgacatctgggaacactctatagggatcaacaaaggggttctaaattgtgatctgagtagtttagagtttaacattcatgaaggggagccaagaggacaagtaacactttgaccatcggccatttcctctccttactgtcattctctgaaaagcacacactggattttctcagggtcatgacatgtcaaaaagacatgctttaagggggaaacagttgcaatcaacatagccatgggagagatgcagctatgcttgctaggatttccaatacttctgtttcatttctaatataatacaaatcaataaaagcaaccacataagcatatccatgctggtatgtcaccatatttatgtccatatggtatcaacatgaagagagcataattaaatatgctgccatcatcacatggcatatcattagatcatacaataaatcaaatacctcactgggtcaacatggatagatctgaaatatatatcactgattttacaaagaccaagttgcagtcattttgtgcactgtctgaacttttctacaaggttttaatacacaaaatcaagttctacatgttatctaggaatatgcacatatgttgtaagaggtttttaatgtgcatttgggtgatttcttttgctttttttaaaaaaaaatttaattcaagttcttggttacatgtcgtcaataagttttagtagtatagagaaccctaagaccataacagctcagaatgactgtcttaaaggctatgtctaccaaagagtcaggatagcatgactacttactttcttcatttttaaaactcagaggtaccccacacacactcccaaataaaactgcacacaagttctttagtttaattagatcccatttgtcaattttggcttttgttgacattgcttttggtgttttagtcatgaagtatttgcccatgcctatgtcctgaatggtactgcctaggttttcatccagggtttttatacattgagaacttaattttaagtctttaatgcaccttgagttaatttttgtataaagtgtaaggaaggggtccagtctcagtttcctgcataaggctagccagttttcccaacaccatttattaaatagggaatcctttccccattgcttttgtcaggtttgtcaaagatcagatggtgtaggtgtatggcattatttctgaggcctctgttctgttccattggtctatatatctcttttggtaccagtaccatgctgttttcattactgtagccttgtagtatagtttgaatcaggtagcatgatgcctccagctttgttctttttgcttaggattgtcttggctatatgggctctttttttggttccatatgaaatttaaagtagttttttctaattctgtgaagaaagtcaatggtagcttgatgggtatagcattgaacctacaaattactttgggcagtatggccattttcaagatattgattcttcctaaccatgagcatggaatgtttttccatttgtttgtctcttatttccttgagtggtggtttgtagttctccttaaagaggtccttcaaatcccttgtgagttgtattccttgttattttattctctttgtagcaattgtgtatcggatttcactcatgatttagcactctattactggtgtataggaatgcttgtgaattttgcacattgactttgtatcctgagactatgaggaagttgcttatcagctgaaggagatttggggctgagacaatttggttttctaaatatacaattatgtcatctgcaaacagagacaatttgacttcctttcttcctatttgaataccgtttatttctttctcttgcctgattaccctggccagaacttccaatactatgatcagagtgaacaggcaacctacagaatgggaggaaatgtttgcaatctgtccacctgaaaaaggcctaatatctagaatctacaaggaacttaaataaatttacaagaaaagaacaaacaatctcatcaaaaagtgggcaaaggatatgaacagacacttctcaaaagaatacatttatgcagccaacaaacatctgaaaaaaagctcatcatcactgatcattagagaaatgcaaatcaaaaccacaatgagataacatctcatgccatttagaaaggcaatcgttaaaaggtcaggaaacaacagatgctggagcagatgtggagaaataggaatgcttttacactgttggtgggagtgtcaattagttcaaccattgtggaagacagtgtggtgattcctcaaggatctagaaccggaaataccatttgagccagtaatctcattactgggcatatactcggggtgtgtgtgtgtgtgtgtgtgtgtgtatatatatatatgtacagtggcttgttcctataatctcagctactcagaaggctgaggcagaagtatcacttgagaagcccaggagtttgagaacagactgggcaacatagcaagactctttattaaaaaaaaatcatacaggctgggcacagtggctcatggctgtgatctcagcattttgggaggccaaggcgggtggatcacacgaggtcaaaagtttgagaccagcctggccaaacatggtgaaaccccatctcaacaaaaatacaaaaaaaaaaaattagctgagtgcggtggcacacgtatgtaatcccagctactcgggaggctgagacaggagaatcgctcaaactcaggaggcagaggttgcagtgagccgagattgtgccattccactccagcctgggtgacaaagtgagacttcatctcaaaagaaaaaaaaatcatgaacttttgtacatgccttagaccttataggaaaaaaagtataagactttgatgctttattacagagactctcatgatttgttacaaagcagttctttagaaacatacttggaggctatactaaaattattatttatactatttgtaggcaactaatgaattaagaactcttatttcctttcttacgtgcttagcatgtacttatcaaatgcaaagaagaatatattatcaaaatttggtttatcttacatgtgaattgcagtataaaatagtcataattctaacagaattatatcagactgacagaaaatggcatcattagtagaatcaatataatgagtaggcattgtcaaagaacatgatttctggacaaatgaaccaggtgcagctagaacagcagtcccccttatctgctgtatgtgtagaaaacacatattcaacatgatgttcctcttctctcacaccgcaacaacaatcatcagcacagaagatttctgtgaccaaatatgtatttttccccagcaacaagcaaacaatcaattcctatgggtgccctgtaattctggcactatctacttggggattgtgtcagatcccacaggttgagggctcagtaccacaggctattcccccacagcagttacaagtctgggcctccagaacttctaatcaacttccagttggacttcaagttgggtttcccaggaccccctctttggtttgattaatttactagagtggctcagagaactcatggaaacacatttaccagttttttataaagaatattaaaggatacagataaagagatgcatagtgcaagatacggggggaaagtaacatgcttccatgtcctcccagggcactcaccctctgggaacatccatgtattctccatatgccttcatgtattggagagcatccaggtagctgaatacagctacctggatgctctccaaatccaatccttttgggattttatgaaagcttcattacataggcatgactgattaattgaacattcagcccctctcacatcccaggaggtgaggggtggggctggaagtcccaaccctctaatcacaccctgatcactatgatgatgagccccaccctgaagccatctggaggctgcctgtcataagtcaatcattagcatacaaatgatatcatgttggaaattctgaggattttaggagttgtatgacagaaaatggggttgaagaccaaatatatatttcataatatgacattggtggttttattgactgcagattcagttacccatggtcaaccatggtccataaataaaatttatgtatacacatcataaggtttaaattgcctaagattctgagtagtatgacaaaatttgagcccttacatcccagtctgcccaagatgtgaatcgtccctttgtcaagtgcatacacattatatatgatatctgctcactagtcattgacataaatctgtacctaacatccaaccaacaatatcatcatggttcacggatccaagatcacgtgaagcagatgatcttctttctgatatatagtcaaatagaaggtcaatagtagcctaagactacatggcaatgcctactgcatttgcctcacttatcacatagccattttatcatctcacatcagtgcagaaagtagggtgactatagtacatgatattttgtgagctcacattcacataacttttattacagtatattgttacaattgatctactttaccattagatattattaatctcttattgtgcctaatttatgcattaaattttattatagatatatatgtatttttaaaaattattgtacacatagagttcagcactattcatgttttcaggcattcactaagggtcttgaaatgtatcccccatgtgtaagaggaaattactgtacttattttgttgaaacacaacagtttctccacctcttcagtttaaactatttaggataaagcactctaattcaaaaaatctaggtctatgaaaactgtactctattctatggcaaaacacaggatacagagtagggtcaaggatccctgcaaagacttttcagctgccaatgcagaagagcctaagagagatcagtgtccttactctcactaatcctctcctagggaagattctggtaagtttgcttagttctagctattcattcaccctatgtaaggtacaaacaatccttaaattcagctttcatttttagctccttcaaaaaaacacaaacagagaaaatatcactcccttaacagcttatccaatctgagtgttgtttccttgtcagagagaagcttataaagaaatactgggaatggtatggcaagttgccagggagtactttctaatatataaaatatatataaaggaaccataaactcactggagctaccaagatgtgccaacagttgtctcactacctagtgggaaaaacaacaacaacaacaacaaatctttgtcactatatgtaaacaaaaatagtatgactctcttggcatttttcatgatggagaacctagttataagtgagtcatgttataataatatagactgttttcaaagtgatcgctcaaagaaagaaggtgaataagaaacatatttgtatgcctatagtattcactagctggtctatttccaactgcaaggtaaataggaaagactttctgactccagttttataaagtacaacctcttgagattgtccctttccactgctagtctatctggacccatctcacagaaaaggatgatccagttagtgctgtgtagtacacagcatgaagtcattttcctcaaccctccccattatgtggcaaatgtctatataaattatgctttttcaacatgtaaagcatatgccattaaatcctacattaataaactaaaagcaaaaaagcacaatggatagcttaattgaatacattcaattatcttggaaattatgttttgtaatattgaaaaagatatccactatgttatccttaatatatgactatgctggacatatcaaaactatggggacagcaaaaatattagtagttgacaggggttaattgtgagggaggaataaaaaaagagacaaatttcagggcagtgtaagtattctaatggcgggtacatttattatacatttgtccagctttatagaaggtacaataccaagagggaacttaaatataaactatggactttggatgattatgatgcatcaatgtaagcttctcagttgtaacaaatgtaccactcaggtgggagatgttgaaaatggggggagctatgaacgtgaggggggatggcgtatgtgaaaaatctctttaggttcttttcaatattgctgagaatattaaactgctcttaaaataaagttgttaattttttaaaaagattttcactgaatcttctattactaatatattgctatattatattaccatatattatagcaagacgtactcaatttgaaacacaatataaatattctctccagaattatagtatataaaagcacataaagcaaataacttaactgtattaacaggcaagaaaataactgataaatgattgatttttttaatttcataattataaacagaaatttaacaaaatataaaacaaaactgaaccatctacataattaaaatgaaacaaattttttatttcaattttaaatgagaaatcattacttattttatctaaccattttactgaaaggttaatcgaataagaacagattataattacctaatattgccatagtaacttctgtacagagacctgttaaatattcaccaaaattccaaaatctaacagcacagaaacttagtatttcatattaagttgcaactgactcaaatgaaataagcaccatgctatgttatattaccatgttattcactatcaaatagaatttttaagacacctaaaattaagttggggctgtaactgctgtgaagaaaataattcatataacagtcataagactgtcattcttagaaaggcctacatgcaaaactggccatttgctggtgtttggaaatttgcattttaaaggtttgtcaccatttcctgagaaaagtagctcactgtacctaaactgtttgcataaacaatgtggttgactctgaacagctgcttttcttctggaagtgtggaatttttgtatatgtgtgagacagcatgcctatgtaactagcttccataagaaccttggatactgtgtaagtctctagtcagactcatactggtagacaatattgcccatgtgctgtcaaaatttgaagctacaggaattcagcacatcctggtaactccacaggagagggctcccggaagcttgtgcttggcttccccaagacttgccacatgcccctttgccctgagccaattttactttgtattctttcactgtaacaaatcaaagcccagagtaggactgtttgctgagtccttccaagtgaatcaccaaacacagaggtggtcttggaaactctgacatagtggcattatatgaaattagttttctttaaggtgatgtgacctgtgactacgatcagaaggctgtttataaaacacctttccctcatctgttttccttaacagttgcctttgagattcctgtatttctgcatgaataaatccataagggaacagaaataattatgccaaaaaatgatgaaaaacaagcagcaatcctattttaaccagaataaaaatttgagaatatggatgattaaaaatatatcccatagtatgaaagcttctagaagagaaacaaaaagatcacagccaattgtcttcaactcaccaaggtttcttttataataattggggatcaggccaggtgcaatgacacgcacctgtagtcccaactactccaacggctgaggcaggaagattgcttgagatcaaaagtttgaggctgcagtggagattgtgcctgtgaacaaccattgcactccagcctgggaaacagagtgagaccctgtctctaaaatgcattagtaggctgggggcggtgccttacacctataatccaaacactttgggaggctggggcgggcggatcacaaggtcaggagatggagaccatcctggctaacacagtgaaaccgcatctctactaaaaatataaaaattagctgggcgtggtggtgcatgcctgtagtcccagctacctgggaggctgaggcaggagaagcgtttgaacccaggaggcagagtttgcagtgagccgagattgcgccactgcactccagcctgggcaacagagcgagactcagtctcaaaaaaaaatctattaataaaaacataagtaaaataatttgcatcattcaggtcattgtgataattatagaaatatatgtagccattggatataatacttactatcaatcatagagctcatttaatttgtttctaatcttttttcttaagttcttataaaactaaaaatatctataaaaactaaaaatcatctgttaagggccgttcttcatagaacaggtcaaaaagtcaaaaactgcatttaaaatgtaggatgagttatccacttctcctcccaaacagtgggtttttcttattaagggccaataggactttaaactccctttggagaataaaggaagttatagaccagcacgatggctcatgaccataattccagcactttgggaggctgaggcaggaggatcacttgaagccaaaagtttgagactggcctgggcaaaagagagagacctttgtctttaaaaaataaaaaataaaaaagttagcttggtatggtggcatatacttgtagcagtctcaatgacttaggaggccgaggtaggaggaccacctgaacccagaagtttgaggctgcagtgagctatgatcacactattgtactccagcctgggaaacagcaaaagactcaatctcaaaaaaaaaaaaaaatcaagaaacttatatatagatggttaaaggtgtggtaatccaactgaccaaatattccagctaagtaacagattaccaatatttgaagaaatataataccagaaaagtgttttacattaaaactatgtcgtttgaaaatttagaatttaaaatttaaaatttaaaaaaatttaaaagacaccttaagtgtcttaacttaatttgaaaatttaaaagacatttaaagtttgaaaatttaaaagaaacttaaaatcttaaaggagcagcatcacttacactgtcactgtgctaaagatataaagaagtttagcattaaagattaatagaataccagatatactttagaataggtagctaattctcttaaaagaaaatcctatatagttgtcaaaaatacctgtgttagaaatgtgttctaataatattttctttagggacgaaattaaaaaaaaaaacagtaaaagcagagatattacaagaggtcatgaaaagggaattgcactaaaacaaagtgtcccagaacacagagacttggtatacttagcatgtcaccttatatttttctccatgacattatataaaagacgtcagcttctccaaactgctcgtctgtaggctacttctttttttttttttttatacttttagagtacatgtgcacaaagtgcaggtttgttacatatgtatacatgtgccatattggtgtgctgcacccattaactcatcatttagcattaggtagatctcctaatgctatccctccccactccccccaccccacaacagtccccggtgggtgatgttccccttcctgtgtccatgtgttctcattgttcaattcccagctatgagtgacaacatgcggtgtttcgttttttgtccttgccataatttgctgagaatgatggtttccagcttcatccatgtccctacaaaggacatgaactcatcatttcttatggctgcatagtattccatggtgtatatgtgccacattttcttaatccagtctatcattgttggacatttgggttggttccatgtctttgctattgtgaatagctacaaaccactgctcaatgaaataaaagaggatacaaacaaatggaagaacattccatgctcatggataggaagaatcaatatcatgaaaatggccatactgcccaaggtaatttatagattcaatgccatccccatcaagctatcaatgactttcttcacagaattggaaaaaactactttaaagttcatatggaaccaaaaaagagcccacatcaccaagtcaatcctaagccaaaagaataaagctggaggcatcacgctacctgacttcaaactatactacaaggctagagtaaccaaaacagcatggtactggtaccgaaatggagatatagaccaatggaacagaacagagccatcagaaataatgctgcatgtctacaactatcgatctttgacaaacctgagaaaaacaagcaatggggaaaggattccctatttaataaatggtgctgggaaaactggctagccatatgtagaaagctgaaactggatcccttccttacatcttatacaaaaattaattcaagatggattaaagacttacatgttagacctaaaaccataaaaaccctaaaagaaaacctaggcaataccattcaggacataggcatgggcaaggacttcatgtctaaaacaccaaaagcaatggcaacaaaagccaaaattgacacatgggatctaattaaactaaagagcttctgcacagcaaaagaaactaccatcagagtgaacaggcaacctacggaatgggagaaaatttttgcaacttactcatctgacaaagggctaatatccagaatctacaaagagctcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacagtgagataccatctcacaccagttagaatggcaatcattaaaacgtcaggaaacaacaggtgctggagaggatgtggagaaataggaacacttttacactgttggtgggactgtaaactagttcaaccattgtggaagtcagtgtggcgattcctcagggatctagaactagaaatagcatttgacccagccatcccgttactgggtatacacccaaaggattataaatcatgctgctataaagacacatgcacatgtctgtagactacttctgattgaaacttgaaactctcgaaatgcggctgtgttatgattccatgttggagagagtcgggatgtatgtgctttggacaaggtggttccagttactgctgccagacttttgtttcagaatgcatccagaagaacttatcagggatttcagtacaaactaagtatttccacaaggagcagataagaagaccacagtttttctcacacattacccttaggttttgacaattctgtaaaagtgtgggcacatgtactcagaagtcaagaccattttccctgaccctgtgcacgtagcttctgcagttacaaaagggttacgcaggatcttggtagatttgttcctccatatttggacaacagacataccaatcacatcaatagcccacattacacctcaaaaatggttcttttgaaaagggtaccgccaaagagcttttaaaagttaaatctaattggcttttgagtaatcttacttgttagaattcatactccctccttaaaattctcactttttttatttttgcaacatcacttcctctgactcctctcctacttttctctagccactgctcattctccttcaccaactctttttttcctgggggtggggagggaaagttgacattcccagggttttgtcacaggatagcttctcattctacatctgcatcatggacagctcattgagatcgatgactttgcctaataattataataacatcattctacgtctgcatctccaacctcagatttggagggaagggaagttattcttccctgttgaccagctgtacttctccattcagtgaacacgtcctactcctttcttgtgtgcagtataaaggccagtacacaacctggaaacctatgaatgatccaagatttctctctccccactaatgttttacattcaatgttcactaaatcatattaactgtacctcttttctgcttctgctttatatttctactgccaccaaataaatatgtttatatttcctagatcaacatggcctcttcactgatggttttcacaggaaaagatccctatcaactattattgtttttttataaataaaaaattaagtaaaacaaataaagaaggcatacaggcaagaaaaagaccaacattttaaaatgagtaaatggagtaaatttactttattttaccgtggatgggtgaacaccttacactagattgatagtagttcaagcatcgaactacaaggaaactacagctttaactactgcaaaatcttcctttctctagcttactttcttgtactcagaatacaatatataatatatataacataccaaatatgtattttcaacagcatggggattggcagcactaaatcccatgttgttcaagggccaactgtaattattgattcatttagtaattgcaaagaatttattttacaaattaaatagaagttctaattatataaaaagtctaattcattatcatgtgactattaaaaaaatacaacataataacttaaaaatttgttttcttatttacacaaaaaggtcatctagaatactaggaacgataattaaataataatttttttcaaacaatactgagattataaattacctacaattaactttttaaataattataaaatctagactactaagtattttttaaatgtgtacaatttaaagtgatttttttaaactgcttttttgtaatcaaaacatctttattcttttttatctatggtagtaccatcaagagtaattcactatcagaaatctcacctggattgctatttataggaagatcttcatatctctttcttttgtattcataaattagatcaaaaatgctatgcataaaaataaatgaaattaatattttaatactattatcaaaaacatttaccaaatatactaaattattagagtatcttgaacaatatcaggatgttaattatcctatacacttctcttttgtaagctctacaaacttcttagtacctttctaattaaataataaaaacaggtgaagtactcatgaagtgaaggcagtatagctcagcaaactatctcacatcagcttgacataatggaaagtcaccttcctggctcttactggaaggtcctggctctatagccaacaggtatttgctcttaaacaagttgcttctcttaggcacaatgtcttcttctagattttactaccttctttcactaggttgttatataggtttaatgaagcagcatttttaacattcacagagaaatagtaaagcagtggagcttgttcttgaactttatcgctgaaactattttgaaatcccaaatcaaacccaatgtgtattttttcataggttctaatattcaaatgcttcagtttaagaaaaatgttaagtcctaattttgcttattgttctattatttctggcttataattcagtgtatctcaactatttcataattcataaataaattaatttatgaatatattatttcattaaaataggtaacacgattgttaactattattgagctcatcaattccaagggcagaaaactaacagatgtcaagatctggcttgggctaccactattacttctctacagactctaactgaatgagcagatgtttgctagaatgatggttcatctccatcagtgatgttatctccaactgacatggaagacaaaaccctactttcattttttttaagttccatgaagtagatgcaagttgacattttctcatttccaagatacatactaacaaaatatttacacaacaccccatgtgttacttatctccattctcagtttatagatcaccttacacaaatgtttttgtagtgaaaaatcacaattctaatataaggggccacccattttgttttgattcaaactatgacttagctagccagcaaacagtcaaatgaccttcccgtgactgcaaaatatgaaatgcttcaccatgctaattttctccgtattgttccaattttagtatttgtgctgccaaagcaagcacaaagccttacttttacatataactgctgataagtcatggatgagggttagctctgttaaatctaactaacaaacttgagactcagataattccaatgaatggcttcctgtgaaatagaatccgaaaatattttataaacttgagatactgatgcaagcagcttgagagatcttcattattatagataacagatcacttgaggggccaaccacaagttgatgcctactactctaaggaaggatggcatagaagcttccactacctgagaaaagctcttacgctgtttatataaaaagtctcagggtacagatctggtagcaataaagaagaacactgtgatctctttctacaacattatttgaatatctctgacagtttagaactatcctaactaatatttgctttaaagagaaaaaaaagggactcaaaaaataactcaccatgaaggtctagaagcccaggttaaaatgtgggctttacatcaggttttgagtgtgggtgaaagtgtcaatttgctccgtatgtgtgttgataaagttagaatatccagctaacagagcaaggttctgctgttttggaaacaatggctgagcatataagtatgtgcaactgaactaaaaaaaacagttgtaactttgaagcctttttatggatcaacatgaagattgagggatctcaaacagaaagggcatgctggtagcaaaggttaatcactaccagactgcaagagtactttcaatggtaagaaagcagcaacagaatcaatgaaaacaaagcaatgattagaatgtcctttccccttctccttctgacttgtagacactgattgtcttccttggacttagggaaccccttaggttcttgaaaaattccatgatcaggctatagtagatggtccccagtacacaactcaaggttttttgataaactggacattttgagacccaaataactaattagaaaaatcaaagatgtgaaactactttaccctatgcataggggttatactggaaataaaatggacaacattggaatccctaaggagaaaagtcctgaaagtttcaatatcaagaatcttgcacctactgctacttatctagcctttttcttgatttctggctgatgaagttgcacaactctcgaaaacttaaaaacttgaaaatttgtcacttgaaaactacttgaaccaaactatgcaatctcacctgatatataagatgcaattgttacaattattttaaacttcaatttagtgttcattagcctttttacgtaaagacttacactctattctcagcctcactggcataatcttctgcaagctttccatacacatctcgagaaaacacatcaatattgtgctgcagaagaagaatgactatatctttttctccaagagtaacagcaagtatgagggctgatctaaaataacagagaggtaattaaaaactttaatgacattttaaaagctaagtttatatactttatcaacttaacatgttgcctgtccatgtagaattaacccaattacatgtactaagaaacaagcatcttgggtgctcaagggtttatctttgcaagttaccacaaaggttaaaagcaaggaacaaaaaggaagcctcttgtcccactgtggtatgacataaagttgctaacttaaagtcctttgatgggcaagaaatatgctcaggccacctatctacagtaggcaaatttaagtgaaaaattattcatttcttccctagtctgatactatacattataatgcaaaatcagctgaagggtcagataagagctatctgcaggcttaaaacaataatattaataggaatgctaatagtagtagtcatagcttcagttaatgatgctcataagcatgtgctaggcatttaattaaacactatatatatatatatatggaggataataatatatccttcaagggtggttgtgtataagtaatatcacatatatataaaatatatatagtatattatatataatctataaaatatataatatatagtatattatatattatctataaatatatattgtatatattatatattatatatgatgttagttacattatattcttacatacatatgtgtgtatatatattatatgcacatacttatatgctcagccattgtttccaaaacatcagcaccttgctctgttagctggacattctaacattatatatatataatgttacttacacacaaccacccttgaaggatatattattaccctccttttcacagaagaaaacatacttggtaagtaatgttaccaaggtcacacatctagcaagtgggaaagctagggattaaacccagtcctgtgtgaacctaaagcttgtcttcattgaagtaaagttttatccatctaaagctatcttttttccccctccccatatcaattaaaaacaacatcaaaacacagtagaaatgaaaaactaacatgaaacccctttagctaatgtaagatcatacaatcaaaagcatcacattattacattgtaaataacaccacatcatcttacaaataacaaacatctatcaatatacagagctttctatatatagaagccttttatgtgtataatgtctatagagagagatgaatcctgctatacactgttctttatgttactcagtccaaataattgtttttctacctaagtgatgatctgtgttgatatttctcactatatcccagtaattaaaagttagtcttcttactaatgtaatatttgtgacttgagtgactgctaccactctaaaatgacactcaggtttaaaaacaacacaataagaactaaggtctgtacctgccaagataatcaatggcatttacatttgcttttttctttaataaaaattccaccattttcacttttcttcgactcacagcaagtaacagtggctgatattcattctgtaaaataacagcaacaatttataatcacaaaattacatatttatcaactgaaatgaaaaccttatgtaagatcctgtgagcttcaatatatacaattgaaaggtcgtaagaggtagtccctttcttttccctcctcggtgcttttctatgttctgctccttcccctggaaacaacctcctctgcctcaccacaagaactctggtcatctccaaaactcacttcaaacatttcccagttccaagaatctttgcttctgtcccagcatttagcatggcatgtttcaaggatttaattgtttcccacctgaaccaagagcttcttgagggcagcagctgtatttttttctctatgtcctcaaactctaagacacagtaataaatgtttcaggtatttttattaatgatctaaattattatctatagagcggtgtttcttaaactattaatatattccaaaggatatttactttaccagaatttgaacattataccccaaaagagagactccatgatcacccatgtttgaaaaatgttacaaaactgtgcattatgtgtctagtatttgagaaatcttttgaacttcacctaatccctatttgtaaatacttattttggagaatgttaacatttgagaaatgagagtttcagggatacagttgtgagagcttaccagtaaaggtagaggtttcctctgggtgatacacacttgcctcattctcttctatcgatggtgtgagaatctcaggtgacaatgtcaggagctcctgagcacctgagcacctgacattgtcatctgagattctgacacgattgacagttcatttgaagcctatctctttttaattcggagagccgggctctgaattaatagagataggcttcgagtgaactttcactgcttattattaaatagtccatgggttttctctagtaatatttttatcttagctgtcagaaagctctgtatgaaatgttattctcaattacaatcttaggaccctgatgcaaatatttatgtaattataatcttaggaccctggtacataactcctttaaaaatctatttgtattctagtttccaattcattcttacctaacttattttattttaggtaaaatatcaatcagaaataaaaatacaatggcttatcaattaaagctctaataatgacctatatgaattatttatagcataatgaaaaccactaaattatttgcatcatttatttatttatttatttatttatttgagatggagtctcgctctgtcacccaggctggagtgcagtggtgccatctcggctcactgcaacctccgcctcccggattcaagcacgagaaattctcctgcctcagcctcccgagtagctgggactacaggcgtgtgccaccacacccagctaattttttgtatttgtagtagagagggggtttcaccgtgttagccaggatggtctcaatcttctgacctcgtgatctacctgcctctgcctcccaaagtgctaggattacaggcgtgagccactgcgctcggccaattacttgcatttttaggaggcaatgctgaagagaaaaatataatgttgtctgcaatatgcataacctatgcaactataccatgattcaccttaaaaagcttacatgcattctaatgggaagatgattatttatggtatgtataaatagtttataaaacaccaccatctaaattcaaaagttcaacccgattaccaaaggatttatataaaatatagactctacatttaaataaatataaaatgtcttgaaaaccttgaaatatttactaaaatatattataaaacagggcttgtaaagtcatccctacagaggcaagggagatgacctgaggaagtgaagtacctaggtaggcacagtagcaaaatggagaccacatgcctcatagaaaggggcaacctctgcacagcatccaaaacctgagataggctcaagggacaccagattggattcttgaagagaagcttggaatccagatctgtgcacgagtctcctaaaccttccatgttgagacaatttgtagacgcaaactaaacacatgtatgggacacatttggactatataccttgtatttttatatttgctatggatatgtctccaagcgattgtatgtaaagcaagtattttcatgtaaaatacttcctttctttagtttcagattttttttccaaaataggcccaagaatgcaataaaaattgttactaagagtcataatacccactttgagcacttttacaacattcattcatttataatttatgtttaattttcccagattgttcaccaaatggataattagttcataggactgctgcaactaaattattaaaataatattaaattataattctagtttctatattgtaacctaattttttttattttaggtaaaatataaatcagaaataaaaatacaatggcttatcaattaaagctctaataatgacctatatgtattctttgtattcttactaacttcatggttttcagtgtttaaaactgctatcctgattatgccacagttctatgtacttaactgacatactgaggcagtccataatagagcttcagctttaaaaaaaggtttagaattttttgctattgtaattgagagaaccccgcttttaataatgatgtattgacctaatcaccagaatgataacaaagagactcagagtcctgaaagagtcagtctctacttattaaaagagtccacaatagcaaatttctaatgaccctatgaatggcagtgaataagtgatggtggcaaagaaaaggtgttattcttatgctgatagatactgcaaataatagtcctttccacttcccaaccacagaggtagagacaggtaaaagtcaggccaatattattggaaaggagaaatttaaaggaagcagcacctatctccagctcttctagagattttttgtgtgtttgagatatgggaatttatattacacttatctattcagtggttcttaaccagcagcgtatcagtgtcccaagaaatgttttattgttgttgttgttgttgtgttgttgctgttagaggcagtgtcttaatctgttgctctggctagaggcaccaccatgcccagcttcaaggaaatattttaaaacatacatgcccagtaatatttaatagtaaatattagatttactatattaaaatcttcaggggatatcctagacttagagatttgcttttaatttccccaggttactgccatgcacaattctaactgcgaaccagcacagttgataatcacttcagtctcatttctcacccacgtggcaaattccctttatcgtttgggatttggccgaaaagaggaaagagcaaaagatagagccattcactgaagacttcatttacttttcctgggtaggggtagggaagagactagtaagctcaaaatccaacttgattttactatttataagctccgtatctcccacctgcccatcaagacattctggacttgagagtagagtttagatgcttatctgagtggctgtttctgccagaattgaataatgtccattaattatgtgttcttctctctgctgaactgtgtgccgcttcatcaccactattcactgccaacctggtttcctcagagtcttaccaaaattgatccctgggcaatttcacaactcacaaactctttcccaaagtaagaataatcatccccaaaactgaagcgatctttgtctaaacatataaattgaaaacaaacaacaaaacacacaaaaaccctctccacagtattttccctcattacctaatttccaaattagcttgtgcatttctgattgctctccttttcttcatttttccctcttaagcctttccacagaggaatcactttcaaatgaaatcaccttcacatacaacacttgtcaacagcaacaacatgtacatttattgtgaaattctttaattttctttgacatttaaaataaagcctatttataagggacaattttactttcctgtgtcacttcacactgattagaaaaaaagtaatttagtggaaaaacacttaactattacctttcccaaattcagttgtcatgaattataaatttattgtaattcatttgtttttatagttatttaccataagtgcatgaaaaaaggctgttccctataatgcttctttaaaagttccaatatttaaagtaaaatcttagacagttaaggcatttcaaaatattttcattcaaggaatgtttgagcttccaaatatgaaaaattgacccttacatgtgtcaatgttaaaataaatgcatttcagatagtttgaaaataacattggttgacctataccttgctgcattcttcaatatttgtaccatgtgaaagaagtttttctatcatggatgtatcttcattatacacagcgtagtgcagagcagtccttccaaagacatccgtaatatttggatcggcgccattttgcagcagaagagttgcacaagcctcctgcctcagttgtacagcctgtcagtattagaccgagaaacatgcaaatactgaaaaaatcaaaataaacactccgtaggatttcctactagttatatggtggtattccaatgagataaattcattttatcctatgtacttcaaccaaatccatctcatgctcaaagagtcagctactatgtaccttgatcagaggtgtcctgtcttcacggtcgcagaggttaagctcacatcttctggacaccaggagatgtaccatttccggttggccagtggcacaggccaaatgtagggcagtcctgtgagagtgacaggactttttaaaacatgtaactgtaagcattaattagcatgttatttctctgtcttcaaaacaaatatgtaattttcttgtgaagaaagtacaacatttgttagcgcttattactcaccacattaatgaaagagcaggctatttaatagaaaaggcttggcttttggattcagtttaattggggcttaaaatttactgtaagctctgtcacttagctgttatttagcctttctttgcttcaatttccttatcaataaaatatgtaagagaatagtagctagcccacagaacactgctgtgatgcttacataagaatctatgcacagcatttagaacactttctaacacaaataacagctcaataatttttagatatcactacttacaaagacaaagacattttaattaagtaaaatgatacaatcatatctacattgaggtatctattaaagattagatgtatcattgtatttcagtcattctcagatgctcattttctcactattctcttatataagctactattctcttatatattaacatctcctgacattggaaaactgtttacaattcattatttattacatttataactggcaacattttaaacattatcttatcgatatataaagtaatgtggcatcacccaatccgtgatgccttacattaagtgggatacagttcatagaacaggcagttctattcatataattggcacctaaatgaagtactgtggaaaaagaaggcaaaaataaaaaaacaaatttttaaaacaaagtaattcttacttcaactttcaaaaaaaaataatccaaagaaaactcaggattcaaatgaataggtatggctcatttttttcaatacttacagaatgttatgtaaattaggtatttgcaatgattaatagtagtatttgagactgtcataagtttttgaaatggcagttaaaggttatctttcactattttctaacttcagaattgcttttgtttaaaaaaaaaaaaaggaataaaagatccaactgggattcagtcctaatgcttccattttaaatctcagcttgctcaggctgggcaggtaaacatgaagttgttaagggtggaagagtcctgagagatggtggaatgtgtctgctacataataggtattcaggttatgcttgatgaataactggattgaaagaatgcatacatacagttgggaagtttattgtgaaaaaaactataaattaaagcagtgcttttggaatagtgataatcacttatatttgctcattttcattttcatgaggacactgataaactaaaataattaatttaaaattgtttccttatatgtaataaaactataataaaaacttatgtatatactaaaatctatgcataataaaataatcaagcacaaataaaaatattccctctgcctctgaagaggctaaaagttcacagaagataccaataaacaaaaaaataaaaataaggccaggcacagtggctcacacctgtaatcccagaactttgggaggccgaggcggggggatcacctgaggtcaggagtttgagaccagcctggtcaacatggtgaaaccccgtctttactaaaatatacaaaaattagctgggcatggtggcgcacacctgtaatcccagctactcaggaggctgaggtgggagaatcacttgaacctgagaggcagattgcagtgagctgagatcatgccactgcactgcaggctgggcgacagggtgagactccatctcaaaaataaacaaacaaacgaagaaattaataataaaatagaaactgagaattttttttctttgcaagatttatatttcttcttttcccaaggataatttcattaataaaaaacatttactagaagttttaaacatgctgatcatttatacatcacagataagaaaaaatatcacaatacacctgccagaaaagaagaaatgttatattttgtacacatatttggcttactaacaccatagattgtttgtgtgtatgtataatcaaaccaactttttttcagagtacatcttcacacctcaacatacatctgtatctactgacatctgcaaaggtcccatattgtcccatcctatggatgcactgaaatttattgataaatttataaaatttataaaatccactataaggggttttccaaatacactgctattttaagcagtgctgagaaaaacaaattgcatgtatctctatttcctagagatattttagtataacggaattgatgggtgaagggcacatacatttttacagtgtgatacttaccaacaaattgtctatttgaaaagtcatcagaaatgtaaactttcaacagcagtatatgtactgctaccctttaccctcacaaacttgtggatagaaaacagtatttcattctttttttaacttaaataccttctcctcccaggaacactaaatattttttcccatgtgcataggttgcttgaatatctgaaaaataaatgctttgctctattttaaatgagagttcttgtttatttgaagaattctctgtaaaatgaaaatcacttttttatctaatatgtatacacacatattgtcttttgttaattttttcttataaactggattttttttattttgctaaatcgaccttcagaatgtgtgcttgtgatatttgtaggaatataaacatgcatcaatataagtaggcatttgtgtttttttctgttatctttcttattttgtgcatttaaaatttttaatctacattccataacgaacttatttctgtgacatgaaaatctagccagatttctccaaatagttagcaggcacttcatttatgagtaattcatcttttcctactaatatgaaatgtcaccattatccaattctattagattggtgcaaaggcaattgcggttttcgccattacttgtaattgcggcaaaaaccgcaattgcttttgcaccaacctaatatattcttacacatattggtgtgttcctggattttctaacctgttccattcactgatttgttgtttcagctgttagtaaataacttgtggaaattaacagcacattttcatatctagaaaggcaagtcttttttgactccatttcaaaagttttcttaatgtcgtcacaatagtaaaagacagcatgagtaattcaaaaatgttaacactttgataactttatttggattatgtaaaatttataaacacagaaagagctcagaactttagaaaaatgtgtctttctattcaagaacacagaccatcttcccacttcaaagtttccctctaaggtccctcagtgaaaaccaaattgacataggtgtccattgatatcaaataaatattggatttttatccaaagaatttttagccaggaagttgatatattatggaaatgatttctctcattatgcacctttccataatgtatgtaacattatgctttaaaatgtgcacgttaaaaataaaacgctgtacatgctgaattttattagtgaaatcactttaaaatgatttataaagaagcagcatggtgagtgattggaaaccagctgaagttttgtttttgttttgctgcttgtgaaaatgacctgggtgctcgcccccgccaaggtttccacatcccaggtgcggctgagcctgccaggaaagaaagtccagcccctttggtgacaggactcgcccccctcacctctgcacccctttcccccaccccattcacccccacacctcacccccacctccagtcctctatcccattgaaccctcaccccatctccccaccccacaccatccacgcccctaccccccaagccttcattccatccacctcagcccattcacgcccccaccccatgcaccccctactccccactcccatcccccaactcactccacaccccgccaccccatataccgccactccccaggccccgctccactcactcccaccccagccaggcaccccctagcccccgtccataccccgagccccggaccatccgccccgcagccctcagcctgcaaaggggtacttctccacatccacaggcctcctcccgcagccccggctcccggcccccattacctttccttcctgtctctcttattggcgtcataatacgtgagcagaaggtacttcagtttctccagattaccacgtaagacagctctgtggatcctcttcagatgatacggtttaatgtagtaatggggaaatgcgaagccatccgagcacaagcgctccatgagggtgggccacctctcccgctcgtcgtcttccttaatcgtcggctgcaaattgtagcctgcagccgtatttcagctcgccttcggggatcgccgcctccgaagagcaacaacaggcaaagcagtctgtgcacggacctccgcgcagactctcagcgcctcccgcctctccgcagaaacgcccaacagaagggttagaaccagcgagcacgcgcaccttagccggccctgcccaacaggcccgaggcagagaaaccgccctagcagctctcgcgcgcccggtgcaggcggcggttgctgcggaggtgccgcgggagggcggggctccctggagcgcgaggcgcgccctgccccagggcctgtttaactgtcgcccgcgcgctcttctcttccacaggctcccgacgctcggagccccccgcgctgggccctctgcagcccagggatggggttgagtggtgcttctccgcctagtgccaccgctgggcccacagcccgacatcgccactgcgtcgcccccggggtccgcgctgatgggtgcgaggcgggaggacggtatccggggttgccacagctgcagccagcgcaccacttgcaggcggcactgcagctcgggctccggcgggggctggcggggctcccgtgggatggcctcctgagccctgagtgcgccgccatccggccggagggtgcgcgcctcctgcacccccggccgaagcccatgcccggcgctcctgccgcagactgcctgacttgccgcggccaggctggccccggggtccgcgcggctggaggcgcaggcctggtcggggattcccaatcctcggggacccctgctccatgtgctggtggcggctgcagctgcagcgcccgtgggctgacgtggcttcccggagctgcggccggccgcgcccaaaggccccataggctgcgctgcccttgccagctgctcctgacccacgcccagagcgcaggacctggcgcttggcactccgcagccaccgggatgaggctgagcgccggttttcggcctcgtggcgccgctggggccacagcctgacttcaccaccccgtcgcccaagtcctgtgatgggcaggtgtgaggaggggcaatcggggttcccaaggctgctgctgcctgcatgccactccgtgaggaagttgaaatacgtgatctctaagagtcctcccagttcttcacctaagacaaatataaatcaagtaacattcgctattgtgattagaaaagctgcatttacagacgttagccactagatggggacgtgcgattgttacagggctgaaggcctatttattttttatttggccgctagagggcacgcctgcactgcacttaaagttgactacttttaaggaaagacaaaagaattcttggatttctccattttcctcatcacctgtgcttatcagagaattccaggggcaagctaccctttccaattcatcactaatttataaacaaaattctaaggagtaaggaatgcttcttacttcctataacatatgtaagaatgaacgctcaaaataaaagtaatttatttaaaacttgtgttgagtaattataactgcaaaatttttgcccatgtttttcatatgctgttcatttgcaaattattagaaatctacatattctgttcatctcagcattatttataacagggaaaaattagacactagccaaaaatctaaaaacagggaacagtaaggaaaaagcaaatggttctttaatcatcatcactaaaagtggttgtgacttaaaataatgacataaaagatgcttctccgctgttgagtaaaacatcaggataaatttaaaattctatttcaagcttaactatattcatttaaaaagagaaaagaaattttagagagtttatcttgttggattatcagatgttatttttctctttttaatgccatatacttttcaaattttcagtgggctgctattacttttgtatttaaaaaagaaaaatataaggaaaaagaaacctgtcacacactttctagtggattttactgatcagtcatctctgtatttctggcatcacaaactgagccagaaactcagtgcctcccatttcttttttttttttttttttagacggagtcttgctctgtcgcccaggctagagtgcagtggctcaaacttggctcgctgcaacctctgcctcccaggttcaagtgattcttctgcctcagcctcccaaatagctgggattacaggtgcccgccaccacacccggctaatttttgtattttggtagaaacagggtttcaccatcttgaccaggctggtctcgactcctgaccttgtgattcaccggcctcggcctcccaaagtgctgggattaacagacctgagccaccgcgccaggccaagtgcctcccatttcttgtattcacctttaaaactcctgcaatgaaggactccctcctccctcatctaacctattatgtgtgtggtgagttctgactatgatatcattcctgatgtgaaaccgaagtctctctcttctaagtccatccattggttcagttctgccttctgacagagtccacgccagacttcacatttctcccaatcttctttgtcctacaagggctttctattcttcaagctaaagagataccagtgattccattcgttcattcagttaacatttaggggccacatcttgtgctatgtcctgagatttgccaatgagcagagctcagagtattgaaaagacaaacacatacaccaggcattttactatgctgtgttgtgtgtatgacaggagcacacagggcatccaggcaccagtgagaagggcctttcaccagacttgagaggtcagcaaaggtgctctgaggaaacaccttctaaactgagagctggaaagagtgaggcaggaaagcagtaagaggtagcgttctgaggaggaaatctccgaggtgggacagggatgcgtatggagagaatgcccttcccatccccactcttcatgaaatctctactctgtcagggtctctctgccctgtgagctgcttgaggacaaagactgttttataaaaatttttatttcctccctctgtcttccttaaacacctagcccagtgcctggaacataagaagccataatgaatttttgttagatgagtgaagagtgctgagtagagcagaaatgtcacatgcctcagtttaaatatgggtcatcagttttctttcttttttaacatagaagtcaagacttgatctcttacagcttcgagataccgttaaagatataatcatcctcatgtatttgagctttgttttcacccattatgttatgactgctgtccattgttccatgacacaattctccatctttcttcattttcttccatttcaattaactcatttatttacatgtgggaatggaacatataacgtaaaatccacaagtaagacttcccagatcctcagcttctttctctggcattagccactgtttctactttcatgagcatctgctatggtttgaatgtatcccctccagaaatcaaatattacaaatgtgatagtattaagaggtggggccttttgggaggtgattaggctatgagggctctgccttcatgaataggattagatatgcttagaaaaaggaatgatggaggaagttagactccttttgcccttcagtctcctgccatgtgaggacacagcactcctcctctctggaagatgcagccttcaaggcgacatcttggaaacagagaccagacactcacctgacaatgaatctaatggcccctggattttggacttcccagcctccagaactgtggaaaaaacaaatttctgttctttataaattactcagtctatggtattcttttatagcagcccaaaacagacaagactctaggaaatcaatttgtattcagcacatcaacaaaattctttacaaatgggaccccccaataggtgggtgtcactaaagagaggtgcccataagcatgagacaatgaccacgtggcatgagcaacgaactacgatgaatgagcacatgttaccaccactaaagaaaaaacttacatgactagatgacaacaaaataatttcttataatgaatttctcattgtattttttcttaaccttccctccatttagtcaggaatctggctctgactcacacctgaaggacagacaaggacttttgtttccaaaagcataaactgaaaggagaactcgcagagtctacagaaaagagaaaagacatttgtcaacagggagtgtttatttatcttttttaactggagggaaagagcagggatgaggagaggagatgccttcggtattggagaaaaacaatattgtagagttttccatcctggtactaataaaattataaaggccaataagaaatgactgatagcaataaaacaaggaaaggggcatagcctaatacagtaaagaaactggtgactcaaagagagaaaggaaaagaacattctggagcaaaatagagagggacagcatttagctcctaagttcctcttccgtcctccagccccaccctccacatccacctccaaatccggtgattttgagcatagtgaagcacactgacactgaagggtgtccttatacgatcctccccttgctggtgactggtggaaacagatgctggggagaaacaggagaaacaaggtggagggacatcagggtgcacttcctctaagagaagtcaaggctacacatggaatgaggaaagcaatccaatgcccaggggagtcctcatggtactgaaacaggaagagccatctgttgcccaagcattctaaccaatgctcagagccctcagctgccctttccctctactgcctccccattcccttgggctaccaggaaaagtggagatgttaatgggctccaatcaaaggccaccatgaacacacctgtagttgaagaagtgagttattactggttaagtgagggagaatacaaactacagggaacggtggggtgtctcactaagaggacaacagaaaggacttagaagatttggggttgtgttaggcaataatctgggagaagggtttaaggaaatggggcttcgttctgaattgggtgttgtcacgaagtgggggtaattctagcatagtagggtatcttaataaatcttatgtggaaagatgtaaacctgcattaaagccttaatgggttaaggctataattggtaaagaacgttaaagctgtagttggtgaagaaacagtagttactcatcttagctagaatagagacacattggtcatttgtgtgatatgaacaatgctcatgctttgctcatgctcagacatgattatgaagaggtcttgtttttgtcttaagtattggcacaaaatgatatggtctgaagcagatgttctatggaattgtttatgctcacaagagaacatcaacatccatctgtgggtgccaggcagctcacagcatcgccaatgcccagcagataggaccaggtcaactcctggctgccagacacacctcttctctttctcagaggaacacaaagtacccaatgctcattctgtagctcaacaggaaaacacattctcaggtgagctggaaagaaagtcgctcatctaataatgacacaattttaaaagactggtcaattcaactacatcaaagacaaacaaaacaaaattttttgcatggcaagaaaagactaccaccacagtcagaaaacaaatgaaagagtgggaaaataggtttgcaacttatatcatagacaaaggggtgctatctctaatatacaaatagttcttacaaatttaggggaaatagaccaacaatatattgaaaaaattaaaaagatacacagagagatttcataggaaaataattggaagttgatcttaaacatgtgaaaagttacgcaacatggctcataagaagataagtgtaaattaaacatatttctatgctctgttgttaggtgcatacacacatgcaggattgtcatgtcttcttggagaattgactcctttttcttaggtaatgtccttctttatctatggtaacttttattgctctttaaggctgctctgcctgaaattaatagagatatgttgggggtatttttgataagtgttagtatggtatatctttctgcatccctttaatttatgcaggtgcatctttatatttagaatgtgtttcttgtagactacatatagttgagtccaactttttaatctacactgacaatctcttttattttatttctgtcttcccaccttttattttaggttcaaggggtacgtgcgaaggtttttttttttctcatatgattttttattatactttaagttctagggtacctgtgcacaacgtgcaggtttgttacatatgtatacatgtgccatgttggtgtgctgcagccattaacttgtcatttacattaggtatgtctcctaatgctatccctcccccctcccctcaccccattgacaggccctggtgtgtgatgttccccatcctgcgtccaagtgttctcactgttcaattcccacctatgagtgagaacatgcggtgtttggttttctgtccttgcgatagtttactcagaatgatggtttccagcttcatccatgtccctacaaaggacatgaactcatccttttttatggctgcatagtattccacagtgtatatttgccacatttttttaatccagtctatcattaatggacatttaggttggttccaagtctttgctattgtgaatagtgccacaataaacatacgtgtgcatgtgtctttatagcagcatgatttatagtcctttgggtatatacccagtaatgggatcactgggtcaaatggtatttctagttctagatacttgaggaattgccacactgtcttccacaatgggtggactagtatacagtcccaccaacagtgtaaaagtgttgctatttctccatatcctctccagcacctgttgtttcctgacttttttaatgattgccattctaactggtgtgagatggtatctcattgtggttttgatttgcatttctctgatggccagtgatgatgagcattttttcatgtgtctgttggctgcataaatgtcttcttttgagaaatgtctgttcatatccttcgcccacttttttgtggggttgtttgattttttcttgtgaaattgtttaaattctttgtagattctggatattagccctttgtcagatgggtagattgtaaaaattttctcccattctacaggttgcctgttgactctgatggcagtttcttttgctatgcagaagctctctagtttaattagatcccatttgtcaattttggtttttgttgccattgcttttggtgttttagtcatgaagtccttgcccatgcctatgtcctgaatggtattgcctaggttttcttctagggtttttatggttttaggtctgacatttaaatctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttttagatgtgtgacattatttctgagggctctgttctgttccattggtctatatctctgttttgataccagtactatggtgttttggttactgtagccttgtagtatagtttgaagtcaggtagtgtgacacttccagctttgttcttttggcctaggattgacttggcaatgcaggctcttttttggttccatatgaactttaaagtagttttttccaatcctgtgaagaaagtcattggtagcttgatggggatggcattgaatctataaattaccttgggtagtatggccattttcatgatattgattcttcctatccatgagcatggaatgttcttccatttgtttgtgtccttttttattttgttgagcagtggtttgtagttctccttgaagaggtccttcacatcccttgtaagttggattcctaggtattttattctgtttgaagcaattgtgaatgggagctcactcatgatttggctctctgtttgtctcttattggtgcatacgaatacttgtgatttttgcacattgattttgtatcctgagactttgctgaagttgcttatcagcttaaggagattttgggctgagacgatggggttttctagatatacaatcatgtcatctgcaaacagggacaatttgacttcctcttttccttattgaatactctttatttctttctgttgcccgattgccttggccagaacttccaacactatgttgaataggagtggtgagagagggcatccttctcttgtgctggttttcaaagggaatgcttccagtttttgcccatttagtatgatattggctgtgggtttgtcataaatagctcttattattttgagatacgttccatcaatacctagtttattgagagtttttagcatgaagggctgttgaattttgtcaaaaggcctcttctgcatctattgagataaccatgtggtttttgttgttggttctgtttatgtgatggattacgtttattggtttgtgtatgttgaaccagtctggcatcccagggatgaaaccaacttgattgtgctggataaactttttgattcagtttgcctggaatcagtttgccagtattttattgaggatttttgcatcgatgttcatcagggatatttgtctaaaattcaatttttttgtcgtgtctctgccaggctttggtatcaggatgatgctggcctcataaaatgagttagggaggattctctctttttctattgcttggaatagtttcagaaggaatagtaccaactcctctttgtacctctggtagaattcggctgtgaatccatctgctcctggactttttttggtttgtaggctattaattattgcctcaatttcgcaacctgttattggtctattcagagattcagcttcttcctggtttagtcttgggaaggtgtatgtgtccaggaatttatccatttcttctagattttctagtttatttgcatagaagtgtttataatattctctgatggtagtttgtatttctgtgggattggtggtgatatcccctctatcattttttattgtgtctatttgattcttctctcttttcttctttattagtcttgctagtggtctattttgtcgatcttctcaaaaaaccagctcctagtttcattgatttctggaaggggtttttgtgtctctatctccttcagttctgctctgatcttagttatttattgtcttctgctagcttttgaatgtgtttgctcttgcttctctagttattttaattgtgatgttagggtgtcaattttagatctttcctgctttcttttgtgggcattgagtgctataaatttccctctacacagtcctttaaatgtgtcccagagattctgatacatcgtgtctttgttcttattggtttcaaagaacatctttatttctgccttcattttattatttacccagtagtcattcaggagcaggttgttcagtttccatgtagttgtgtggctttgagtgagcttcttaatcctgagttctaatttgattgcactgtggtctgagagacagtttgttgtgctttctgttcttttacatttgctgaggtgtattttacttccaattatgtggtcaattttagaataagtgtgatgtggtgctgagaagaatgtatattctgttgatttggggtggagagttctgtagatggctattagttccacttggtgcagagctgagttcaagtcctggatatccttgttaaccttctgtctcattgatctgcctaatgttgacagtggggtgttaaagtctccaattattatagtgtgggagtctaagtctctttgtagatctctaaggacttgctttatgaatctgggtgctcctgtattaggtgcctatgtatttcggatagttagctcttcttgttgaattgatccctttaccattatgtaatggccttctttgtctcttttgatttttgttggtttaaagtctgttttatcagagattaggattgcaacccctgctttttttccctttccatttgcttggtagatcttcctccatccctttattttgagcctatgtgtgtctgtgcacgtgcgatgggtctcctgaatacagcacaatgatgggtcttgactctttatccaatttgccagtctgtgtcttttaattggagcatttagcccatttacatttaaggttaatattgttatgtgtgaatttgatcctgtcattatgatgttagctggctattttgcctgttaattgatgcagtttcttcatagcatcaatggtctttataatttggcatgtttttgcagtggctggtactggttgttcccttccatgtttagtgcttccttcaggagctcttgtaaggcaggcttggtggtgacaaaatctctcagcatttgcttgtctgtaaaggattttatttctccttcacttatgaaccttagtttggctggatatgaaattctggcttgaaagttctttgaagaatgttgaatattggcccctattctcttctggcttgtagagtttctgctgagagatccgctgttagtctgatgggcttccctttgtgggtaacccgacctttccctctggctgcccttaatattttttcctcatttcaaccttggtgaatctgacaattatgtgtcttggggttgttcttcccaaggagtgtctttgtggtgttctttgtgtttcctgaatttgaatgttggcctgccttgctaggttggggaagttctcctggataatatcctgaagagtgttttccaacttggttccgttctccccatcactttcaggtacaccaatcaaatgtagatttggtcttttcactagtcccatatttcttggaggctttgttcatttctttttagtcttttttctctagactcttctcacttcatttcattcaactcatcttcaatcactgataccctttcttccacttgatcgaattggctactgaagcttgtgcatgtgtcatgaagttctcatgccctgcttttcagctccatcaggtcatttaaggtcttctctacactgtttattctagttagccatttgtctaatcaaggttagattaagacaaaccttaaaaatcttttcaaggtttttagcttctttgcaatgggttagaatattcttcagctcagagaagtttgttactacctaccttctgaagcctacttctgtcaactcattaaagtcattctctgtccagttttgttccgttgctggtgagcagctgcgatcctttggagaagaggcgctctgatttttggaattttcagctttcctgctctggtttctctccatgtttgttgttttatctacctttggtctttgatgttggtgacctacagatggggttttggtgtggatgtcctttttgttgatgttgatgctattcttttctgtttgttagttttccttctaacagtcaggaccctcagctgcaggtcttttggagtttgctggaggtccactccagacctgtttgcctgggtatcacaaggggaggctgcagaacagcaaatattgctgcctgatccttcctctggaagcatcatcccagagcggcacctgcctgtgtgaggtgtctgttggctcctactgggaggtgtctcccagtcaggctacacagggatcagggacccacttgaggaggtagtctgtctgttctcagagctcgaacgccatgctgggagaaccactgctctcttcagagctgtcagacagggacgttttaagtctgcagaagttgtctgatgccttttgttcagctatgccctgcccacagaggttgagtctataaaggtagtaggccttgctgagctgcagtgggctccacccagttcaagcttcctggcagctttgtttacctactcaagcctcggcaatggcagacgcccctccaccacctcccacaaggctgccacctcgcaggtcgatctcagactgccgcgctagcagagagcaaaggaccatgggcatgggactcactgagccaggcacgggagggaattttctggtctgctggttgctaagaccatgggaaaagtgcagtatttgggcagaagtgtaccgtttttccaggtacagtctgtcacggcttcccttggctaggaaagggaaatcccctgacctcttgcacttcccaggtgaggcaatgccccgccctgcttcggctcaccctccatgggctgcacccactgtccaacaagtcccagtgagatgaaccaggaacctcagttggaaatgcagaaatcacccatcttctgtgtcaatctcactggaagctgcagaacggagctgttcctacttggccatcttggaagtgactaattgattctttaatccataatctgagcatccaccttatatgggattgcttttcatgatgaccaccatgaatggccagattataacatgttagaaaacaaaacacacaggggaacttaccaaaaggagtaaaagatttcttagacaaaatttcaaagcagaaaccataaggcagaaaaagtggaggggatttcatgatgttacaatcaaatagatctgttgcaagtgacacatggcaaaatgagagaagttatgtgcagtctaaaactgacaagagattagcagcctcaatatacgaggaactcctgaaaattaacaagaaaaataaatagacaaaggacacgagcaggcagtttttgggagaggaaaccccaaaagccaggaagcatatgaggaagtggctaagatcattagtacagaaatacacattctaacaataagatatatgaggaaatagttctccaaaaaagatacacagatggtcaatgagcacaaaaaaaggtgctgagaatcacccagaataagggaaatgcagatgaaaactacagtgagatagcacttcatacccactagaatagctactgtcaagaaaacccgaaaataccgagtgttggtgaggagtgagacattagacccttgtgcactaccggtgggtatgtaaaatggtgccgccactgtggacaacaacatggccattcctaaaaaaaaattcaaatagaattaccgtatgaccaagaatttccacttctggacgtattcccaaaaggattgaaagcaggatgttaaagagatattgtatatccaagttcatagcagcagcattcataggaaccaaaaagtggaagcaagtgtccattgatagacgaatgcatgaacaaaatgtggtctatacatgcaataaaatatgattcagccttagaaagggagagaatcctgtgacaggctacatcgtggatgaaccttgagggcattatgctaagtggaatagccagtcacaaaaagacagtattccacttacatgtgatacctagaataatcaaattcatagaaacagaaaatagaatgattgccaagggctggggcaaaaacggaatgggaagttagtatctaattggacacagtgtttcagtttcacaaaagtagagttcttgagatggatggtggtaatggttgcacaacaatgtgaaagtatttgataccactaaagtgtacaattaacagtggttaagatgggaaactttatgttctgtgtgctttactacaatttgaactagatacaaccttatacatacatggtaggcaaaattctcagctgaactccaataggcaagcacttctgtaatcctctcctggtaaatgtgcttctaattaatagattctaacaaaggtgatgatgtgccatatggaaaaggggaaaagaatttgccaatgtaattaaagtccctgatcagttgactttatgttaatgaaaaaggacatcatccagggtgcatctaatcaggtgagccctttaaaaaaggatgtaaaggtatgagactatctctcctgctgacattgaagaagcaagtctccttgagttctacaaccactcggagatgaatactgccagccacctgaggcagcctggaatcagatctttctccagtggagcctctgatgagaatgcagcctggccaacaccgggttacagtctgagcagagcacccagctaagccgagcccagaatcctggcccacagaaaatgggagatgaaaaataaatggtgttttaagccacacgatttgtgttaacttgttctgcagctgtagaaaactaatgcaatcttttaggcaaaactaatctaggaagagacaagtattggagctgggcacagtggcagatgcctgtcatcccagctactcaggaggctgaggtgagaggatcccatgagcccaggagtttggggctgcagtgagctatgatcgcacctctaagtagccagggcaacaagtgagaccctgcctcaaaaagaaaaaaaaaagaagtcttcatgttgggtggggaagtggggaagttgatgagggcactgcttgtggagtgtagaccagagccaccattgtggagggattttgatcaatagtatgcatcccttacacccctgctattccatttccaggtagagatgtaaaagaaattgacacattcgtcaaacatgcacaccaagatgttcactgcagagttctttgtggtagtgtggggatgggggctgcgggaggcaccctagggtttctatcctggggagaacggagagacaaaatgggaatggtccacaccatggagaattatgcagccacaaggagagatgaaaggcacacatagcaacatggatgggcctgaacacaggactgagtttaaaaaggaagaagcaacatgggaacccaaacattaccatttgcagacattaaaaaacacataaagactgtatctcttttgaaagagcatttttaaagcagcacaggaggtgggggaatctatggggagcatgttgcccatgcaggggaagggaatgggagtgagtgtggagacaaaagaataaataaaacaaaagtggttttattggaccaacaataattcactgagtagtttagcgcaacttgagggtaaaattaatggcacctggatctggggcagctgcagaggcagcgacgtccaggcctttgtgcaggggggctgaggtcacccgtgcaggtggggaaacagtaaatgccaatgaagcaggtgtgtgtggtatagagcgagcaagaaaggagagattactttggcctaagagggatatctgcatttatattactaatgagtttccactgtaagccacagaaagcccggctcaaagcgatttttttttctttacaaacagaatttattgactcaagtgactaaaatgtccaggctgactcccttgggtgggaaagatggttgccagcagggccaggcgtattctctccagctaggaaaccagaattgtggacctccctttctcagaggtttccacaaaagccccaaggctggtcccctttggtcagaaagagtgacacgcctgaacaaatccccagggccaggcccgggtcacatcgccacctgcagacagcaagggcttccagcataggcatggcatgagcacaagctcgtggagggacgtctttgggaacaaagctggaaaagtaggaggtgaggttccatggctgccagctcaggcgtgaccttcgctgccacttactcaacttggaggctgttggtggatggaggagagccctggagcatttcctcccggaaaggaaatgcctccagaagtgcctccctctaggtccttctcactgccaaaaagtccctttcccagagaggaaggaggctcaagggctcagagcgttctcaacacaaatgactgtggggagagccctcgtgggggcctgggtcattgcaagagggagctcatgtggatgcaaatctatataatcggttgccaaaaaagtactgagccggcctgttttcatcctgtaccaggcggcctgcagaggacagaatgtccacgctgtctctacagaaatcctttccggccaagccccagggcctgggggttctccagcacttaaccaccagctttcctgccctgcccgcacaggagcagccagtgggtggctgccattattgtctccaggggcactgggggcgatgctgggctgggtagggctgtgtggggctgagggcagtgtgggttctgagggtcaggaaatgaccttcctttatgcactaccacaacacctcccacaaaccactcctcctgctgcctggggttttgaacacagtcctggcctctttatggcagtggcaggcagtgtggttttggaatggccagcctgccacaggaggcagagctcccactgtgccaggaggcagagctcccactgtgccggcaaacaataagcactgttgtttttccccagagtggggctgcccggtactggtctgtgcctgtctctctggagcaggaaatcgagcagagggaaatgtgtggattggttagagtgctgtcagctgcaaggaacagaaaacccaactcaaaggggcttaaacaatcaagatgtgtctcctgtgccaagcagtgcagaggtaggacagctcagggctggttagatcagggccgcaggaagccaacagggacccaggtttattccacattccatgctgccctcctcttcagtgggccagtctgttttcaggccagcttccctcataatcacaagacagctgccacagttccaggcatcacctccagatatgacaacacccagcaaaagagactctcttctcctggatccatcttttaaagagtaagggaacttttcccagaatttcacccagcagctcttccatcatgtctcactggccagaattgcatcacagacctatccttagccagtatttgacagaggaaacaggaaagccatgactggcttgaagggcatggactaccccaatagcacagggtttggatgctcctgcagatgctccaacagccttcaccacaccaggagacagaagttcttcccagttggagatcagctttattcaccattgaggatgtgatgtttggagctgtaggggccatcttgcagcaatggggggaaattcaagaacatctcagacttgctaatgccatgctttgcctttactgggccgtgagacaatcctgggaccacataggtttgttatgtgagtaaaatgaactcctgttcaatgaggcctccattagttgagttttctttacttgcagcccaactgacacagagttcagttgttctgggcagtggagggacaggaaaggctccaatggcagccattctcctttgggttcccatcctctgtgatgagaaatcctcgtaaaaatcacccaccaggacactgagatggccaagtttctgctgaccttccatgtgtccttgcaaacttcagaggaaactggaccctgggcaaaatgatgaaattagagagtccctgagcccttcttctcaccagaaaactccacccatgacccaaattcccagagaacataggaaattatcagttataattgcaaataataaagacttagaaacctgacaagagggtcttaagcaaacacggtttggggtttttctattccttgagtaatgagaagcccaaaggtcaggatccatgatggtcccactgctggggctgtggtgaggctataggggaccagggtccttccagctccctgtgttgacatcctcaccaggtgccttcatcctcagggtcacaaatacctgctgctacaccttcaggcagaactttgtgccccagggaggaatatagggaaggggaaaggtacagtgaagagccaccaggcccaacaggaaagcagtagctgtcctggaagccccactctgaagatgcctgtcatgggctgtactgtgttgtgtaaccacctttggctttgagggagaggaaggggagaatggctgtggactaggtagctagctgcgtcggccaccaggtgtggagtccggaaacctgggactcaacccaacactgcttcctgctgccttcagtaaccccaggcagcccaggtcattgctgcagcctcagcagcctctcctgcctggcagaaagtgggggaagagaactgcctccatgagggttcctgaaggctgggtgttcacttggccttctccccatctggggcaatgggtcctagggcaagcatggaatgggaagtgtggcttattcaaggctcttctgatgtcaagtgatagaaattgattcaactcatctatagggaaaaagggcgggtgataattaatttatttcagacccaatgggcaagaggagcagtcagacctcaggaaggaactgacctcaagctagcaagcccttggagacagaggcagccactcctccttgctccccggccccagggttgcctgcctctgctgttctcccctcacccactataccttctttccctctggatggaaaggggtttctcagcctcacagcttctgcattcccatgaacaatgggctgccagtctctctgaattcgtatttcacattcctaggagagactgtctgatgatccagctcaccctgatgtctgtctcttggccagtcaatccagccatagagttagagcagttcccagaaaagaggggctggatgaggctgaccagcacactgcaaaattgacttcaggggaggaagagaagcagaggcaggagggtcctcttggagatctgggggaaagagagacagggcattcctttaggacctgtgcctcaaagaccagtgggaagagacagctgggtgaggacaggcttcaggtactctcatgtgtccagatcaaatacggctttaacccctctctaagtcatcgcaaatctttattttgcaaatagcagaaaatgccattcaaatggcttggctgaaaaagagaatgtgtggacccacctaactgaaaagtcagagccaggagggactcagccatggttcgatccagaggttcaacatttacttgcaatattttctctgcaagtttcattttgtttctgtttccagttctctacaagtcattcatctctatttctttgcgagacagtttcatttgaggctggctttccccctgtggcacaagtggctgctttatgtcagcatttcagtgaagtccttagatgggctctgagtggcccagcttttgtcacatgccccctcctgaacaaatcaactcctgttgggaaggaaggtagtttgccgattggcttggtcaagtcacagtctcccttcttctcagccccttcaagaaggaaatcggcttctttgggctcacaccatcccccagcagatctctggactatgatcaagaacagggagaaaatgaagcaagtgttcccacactagtcatttccaagagctggccagttagcacagaacaagaaaacacacgcacggggcactggcatgtgggcagctgaagaagggccctgaagatgtacaagtcctaatttctggagcccatgaatatgttaggttacatggcaaggagaagttaagggcccaaatgggattacggtcactaatcagctgacctcgatgtcaggagattatcctgaattattcaggtgggatgtgcaagagggaggtaggcgagtccgcgtgagggtgcgcagtgtgagaaagcctcacaacaattgctggctttggaaatggaagggggctgtgagccagggcatgtgggcagctcagagaagcacagaaagagattcttctccacagtctccagaaaggaacgcagccccgatgacgccttggctgtagcccagtgacacccaggtcagagtctgacctccagaactgcaaaataatagatgtgtgttgttctgagccactgagctggtggtaatttgttacagcagcagtgagaaacaaaaacacggcattccaagggcagtactctgcatggcaggagtgacagagtggtgcccagtgcaacggtgtgtgacagaaatacaacatgcactgcaatggggatcttaagttttctagtggccacattaagaaagaaaaagaggccgggtgtggtggctcatgcctgtaataccagcagtttgagaggctgagtgggtggatggcttgaggttgggagttcgagaccagcctggccaacacggtgaaaccctgtctccactaaaaatacaaaaattagccaggagttatggtgggtgcctgtaatcccagctgctcaggaggcgaggcaggagaacacttgaatctgggaggcagagtttgcagtgagccaagatcgcaccactgcacgccagcctaggcaacagagcgagactccatgtaaaaaaaaaaaaaagaaaagaaagaaaaaaaacaggtaaaattaatttcaataatatattttaacccaatatattcaaaatactatcattgcaatgtgtcatcaatatacaaaatattgagaaggtgtttcccattctttttaatccccagttttagaattcagtgtatattttacacacagcacatctcaacatttctgagctccttttcagtgctcatcaggcacacatggttagtggctgctgccctggacagcacaggcctagtgactgtacttttggttgtaagggtggcagtggctggcatgaaccagaacaggggtttgtttgtgacagtgacaaggagaccgctaacccctgctgatctgtgtgtccagttttatttctcttttttctaatttttttatttccatacataccctgcttgtatatcaagctcttttctaatcagggatcctcaaatgacaggagttgacctctgattgtgtttgtgcatttcaaagcccagagctgtgacctcagccacggtgggcaggatgggtgctggagaagggcattaaggctcccagctttgtgggggaaatggcatcttcttgagtgagtggggaagtgcaaatagaatatgcacaagctaggaaggacgtttttaaagcctgtgcttcgaacattcttcctctaaaggatcaggtgagctggctcagagcagggagccaaccgctgagccagggtgagagggctttgtatttggagagtgaaaagaatacggttgtttaggctttggactcagagcatcagaaactcaggagaaatgagatcagctgaaaaagaaatgggtttgatgttgtagaccaaacatgaacagtggggaacaggctgaaaaatgaggggagaacagtcagcagcttccacggcttctcccaaatggagggaagtggggccagctcaggggacaggctggaggcttatgacggaaagatggtggggtccaggtgtggcaggacaggaggcaaagctgggggctgctatgggacagagggggcagagggaaagttgtgctgctaatggggtcacaagagtcacttatggcctggggccttcaagaaccaagggaagccctcccagagcccagcaccaccacaagcaatgctcacggctccagccagcaagacttggggtagcagcccccagcctctctccccatattggggacaaaagagaactggagaagccagagagagggagctggccaagcctttccggagggcacagcccaggcctccaccatcctctccccatgtgtgctcaacccttaaacactttgctaagcattacaggtcaggcccctcccctgtgtgttcaaccctttaacactttgctaagcattacaggagttcttctgctagaagtggccaatcaaatgtccctgggcttggctcttggtccatggcaacattccttgcttttggagagggtgtggggtccaggagctaagtgtacccttcagccaagtcatatatcctctcactcaacctcacaataatcattccaggtggtatcattcttacccattttacaaaggtgaggttgaccctgtgtaatagtcagggtaggcttggttacgctgctgtaacacacagctctaaacatctcataacttaacacagtagtttacctctcactcccactcatgggggctggcgagggaatctgctccatgcaggtcgctcagggattcaggctgattgaggctctgctgtctggaacagtggcctctgccaactccctggcaggggaagacacagatggaggtgcgtactggcttctttagaatttggcatgatcctgcctaactagaaaggtgctgagtagtctgaggaacatctgggctgtctgaggatcccctagtcccctagattgggaagtgggagcgaggcttaactgaagcgtgtctaatgtcaaagtccttgctgtcagccccgccttatgcagcttcccccctaaaccactgtgaaaacgtgtgagctgtgtggtaatgtgccaattccaggggtgtcaacaccatgacccccagatattctcatacactgcctccttagcccatcccaggcaaagagggctctgcaaaccagggaccctgcgaggccaggggacagtgggattatactgccccatcccctctggcctgcctcccgcccttccagcctgctcactgtgtccctgctgagtcccatgactctcagctgccctcaggatcctgcctctgaagagtcctttccttcctgtggaatctggagcctggtcctccttctccaaggcagcacctgccaggttcctcactggcagcaagcagccttgctaacagccttgctaatccattaattacctgcttctagcagaagagctgttaattgaaaactccaccccctcctttaattgcctgcctgcctctggctgtctaggcttccctgggttccctccaggcccgcagcccttggttctctgcctttgggctcctgacttcttcctggtcaataagggtgtctgtggctgtctctgcagtgctcattactggggttgccaggtgagaatccggggctacactccctagcctgcagctaacagcctctctcctgcctggcccactgtgggaggaaggaaagcatttaatgcaatttgccccagaaattaagggggagataacaggccagtgggaggattccacagggtagcagattttactgaaaccaaaggctgaactcctccaggtcagagctagccagaggggccagccacccagaggggctgcaccacttcctggaagggtccaccctgactctaagtctcagccctgcccggaggattttctgacctcagtcctttgagtctggacacacgagggctcaaggtggccccgaccttaatcaccacttccctcccagatacatcaccagattctccaggcacagttagaatttggcaatattgacaatctgaagagtgaaaaagaagtgaatttcagaaaaatgaggtcaatatcccattttccaatataactgtatgaatattgtatacatatatgttgataaacaccttttttaaaaggtctgatacaaaccccaccaaactcttactaagagtggctacttctggagagtgggagaggagagggagagggaggactcacagtggatcttcactgtttggattatttcactagaaagggagcaggcgagcattagtcctcaaaggccctatgatcttgaacaaggcgcctggccactctgagcctcagtgcctcatctgtaagagggaggcttctcccatgtccccttttactctggattaggacgcgtggttgagtgcaacctaaaccaacccaagcttgtctaagaaaaggggaagagtttcccgggacacaaggatttttatgcatccagaccttaggcagcggagagaatcctggggagggctctgcacgtctccttactgtgtgcctgcttcctgtaaggtcctctgaatgggctgcaccatggtcaagccattgtgacccctgtgacccacacgtacaggcctcctggagtcacaaagcctggagcactaggagaaccactaaagaagaagaaacagctagttcctgccttaactgatgaactgaccttgcagcattgcaccattgtgatatgttcctgccccaactaatccatccaccttgtgatgttgtgccttgtgacctcccccacctcgtgactatgcaccttgtgacattcttcccctgcccgaaaaaactgcccctaactgtaactttccactacctactccaagcctataaaactaactccactcccacaaccctccactgactttcttttcggactcagcccacttgcatctgagtggataaacagcctgttgctcacacttagcctgttcagggcatctcaaaacacagcagccaggtttacaccttatgggcccagccctctagagagttgcaggtcctatttctaaagtcctgggcagggatcttactgactagcttggtgactgcatcgaggctgataggctgggttatgtaggtaacaagtagcccactgtttcaatggatgaaaatagcgaagtttatttctgacatatgcagtatgaccactgagtcagcaggagggctctgggcatcacagtcactgggtgacccagtctgacagagtttcatctcaacaggtgtgtccaggatctcagagacaggaatagagaacatgctggcccacacaagggctcctaaggcttctgtctgaaagtgacattccacccacttccacccacattttgttggtaagagcaactcacatggccatgcttgaattgaagtggatggagaagtcaactcctaccatgggcctggcataaaggagacttgaacatctgtgaacagcccggatgactaccataatgacacctcaccaagagcccctgcccactccatttcacctggcccatcgctgcaggacttcccactgtgcaggtgaatgctgccagggaaggagggagagagtccatggagggttcagtttctagctgttgctatctggctccttttctgtggcaataaataggtaaacattgtcatggcagagatgtagaagtcccgcaggaggcgccctgtgaatcccagagagttgccgagcccagcctctgggcctcagagtcacaggagggaagatgtcttcccagctcaacccttcccctcctccagcaggaaagttgcacttttgagagtgaaggccgggtgggggtgaggtgggagtgtggcacctttggcattttctgcctgaacaaaactgcggcccctgtctgccttggtggctgtccctggctttgctttcagagacatcacctctctgtggtcattttggaggaagatgtgcctcgggatctgggtttcgagctctggctctgtcgctaacgggctggctctgtgacctaggcaggtcaatgaacccctccagagcctccgtttcctcatctgtaaactgggttatcataatgtctgcctccctagcgagctctctggattctcgtgaggaccggctgttatggggggcatcacggctctttgtccaggtgacacgtgggaaatatgagggcttatctttgtgctgctgtggccttcttgggattctccctgaggactggccctgccctgccttgctcttgcccctgggaacggcccaccctgtctcctgcctccccacccagacgggaagcagtcactctgccagctctcaaggactcatctctgaggttttagacagaataatttcctctccctctcacgcctgcctgtccgggaaaatcacacaacccacgcaggaccccccctacgtgcacccacatgccccacagccattgtctcctgcaccagccagcagaaaagcagagtggggcatgggaggaggatgcggaggctgcaggaagggggggtgacacccccaaccctgagggtctcctggtgtcaggccaagagctgacatggacatggggagacaggagccaggctccttccagatcctcccacaacctgggtttcagccaccctcagccaccctgccaaggccgcaggtgctgcacaaggccacaggcaaatgtccggctgaggactgaggtaggggctggatcccacagcccattggtaacagagactggatgagaacgcccgagtccagtgctctttctgcactgcttcccagaacttcctgccactagggacctgcagccagaaaggacagggcaggaggtacagagagagcagagagagcctgctccaagggagagcctcgggacacagggagtctcattcctccctcccagcacgggctacgcccatgccactcaggcctgagccacagggcactgcctagccctgcttgggccggggctcaccagcccttacagacagcaggccccgcctccaagacactaccccatggcaggggaaagccttggggtccccataaaatgcaggcatcgccagacagagaataggtcttcccaggatgggaagatttacttagggaggggccaccctggataccctgccctccagtagcagccaggttccggaagatcccatgaggggccagtgtggacccctccccttcaaccatccaggcctgcaggtctggggctaatggtggggaaagggggctccagcagctgaggcggggcagagccagtggatggaggcagaaggcgggcaaatctcaggcacattttctgcagtgataaagaccttttgctcagcagctagcttccacggcacttctcccccacatgacaccacatcagggcccacaggagaaagtccggagtaggctgaggcactgggtcccctcccttctcccaaacacacctgcctacagggggcactgccccctctcagagactgggggtggaagcttagctgcagggggtgggatggctccaggacaggagagccatccaagagaaggccagggctctgggagaagagggggtcctactgccctcccggaacagggctcctggctccgtgaagccatctccacaactcccacagctgcctcctcttcccctcctcaaactcccacagccacctccagctcccgcaccgtgaggtctgctccacgaccgcaggagccagacagaggccggggtagcctcaggcagacagacacttttgtgggtgttcacccagagctagacctcagggaaaacaggggtggcctgggggctgagaattcggcagtcccagcacatccaggaccataaatacaccatgccctttgacccgctaaccccactgtttggaattcctcccaaaaacataattgcaaagggaaaaatagctatatgtgcacagctgtttatagcaacactatttatcatagtaaacaagtcaagtcagccaaaatactttgcaagttgtgggagggggaactgtgggtcaataaggtgggatatttattatacgtacaagaaaaatggtaaacttgtaaaattactcatacaataatgttaacagcagtgagaagacaaacttgcacatatctgttcaggcagcagacaatgactgagcaccccgtctgggctacacagctgctccaggtgccagagagatccccatgaacaggaccaagtccacgccctcgtggagggaacattccagaagtgcaccatagggtcaaaggtaaattaaaaccacaggcaagtacttccccaaggcagggagatggacagaaccgagtgttgtccactgcggggtccatccttcctgggctggtgggtcaccagggagtggccccacagaggtctgcaggctcctaaggcaggagccagacccaggatcaaagcgaggggcacctggccaagggcagtgggtcctgccagaccacagggtcttctccccacaggagggaaatttgtcaggctgcttttaggaatcccatgaacctttggggtttgtgcatgaaccaggggaggagcagtccccgagactgtgagctcagttttctactaacctaacaagctaggaagggtcacaactgaggggctggggatccattttgcctccagcatggccagatctgcaagcaggagatgtcgtatggtggcctgggaggcaaaggggtctgagtcaaaggtaaaggtgtaatctgaaggtggactggcccccatcctgccggctccctgtggtccagagagttggagaaagccccttggaccagagccttcccacacttggtcctgtgtcgggtaggagatttgcaggaggccgtttctgctgttccagagcccagacagacttccctggggtgctgggagctaaggcatggaattgcagtcgcctcccaggtgcagggccctgggtggagctgctggctgcagccagggccagggagcagagatccctctctgccaccctgccccaccaaaggcaatgaagaaactccaagctctgggtctgtgggaggcaccaggcaaacagaggagtcagcaagctaaacatgctattagcagcgatggagaagtgacaattgtctgcacagctatcagaagcagctccccgccgcctggcaccagcacctggggaggggctgccactcatcggccttcacagagatgccccaggctgggaaagaaagaccagcaggccggatgttctgtgccaccactccctcgtccttagctgcagggatcttgcccttcatccagagactgagacctggaagcgaggcccacctctgcacctgcccccatagctgggccttcgttcctcaaactgtaagctggggatgaaagtaataccagcttttgtggcagaattgttgggagggaccagtgagatattttgtctgaagcaccttgcaaatggtaaagggctatggggtcactgctgttacaattcttctatcaaaaatctaatcttcagggctttcactgtttcattcacacagaatgaaattgaggctcaagaggttacatgatttgaccaagtcacacaactgcaaacaagtaggtgtcagtttccaggatcgaaaccaggaggaagctcaaagagcatccagcccccatgctgtaaaagggattcaaggcccagaaccagaaggtgattagccttgcagcaggacagagggcagacagcaccgaagcccaggtctgctcactctgctgggagcacttcccaggccactgtggatctgggccttgtcctcagcttggggtggctgcaggagcatcctgaggaatgaacccatgccagagcactgaagatgcccccaccgcccccgctgcagactcctcacccaggtctcttcatctcaaaggggctgtcatagaggcccagggctgtgacctggaggaacacactccaccttcctgacatccagcccgtctatcactctgatggtggaaaggtgggttccagagcctgctcaagacacagtgtgcagagcagggaaggagcctgcccaggcacaaggcaggggcccctctcaaagcctcatgcgctgcctggggcccttgacaacctgaggccttccaggatgctttgaattcagtcttcttggccctgctgctgccccacttgacagaagagagatggatggggaggtgagaggcactgcccgcctaaccacccaccacccgtcacttctgccttttgaaatcactttcgtgggcagaggcagggatgctgatcacaccatgtgggagggacttggagggtggggcggtgactcacaggacagtgggggataggaagcagctccagagcctccctggtagtgaaagggaagggcgctagtgactcagggacagctggggaggggcgcatggggagggagctcattccccccagctctgtgccctgcatgcctggggggtgacctcctgtggtgggccccgatcttgcccctgtggggcagtctttgccctcagcttgcttcccagcagtagccaggcagccagtagctgcatggtgagtgaattccaatctcgcccgctgccgcccagctgtgcagaccttcggcaggctgagtgctcctctgccctcacatctaggcctttagatggaagcagagcccgactcatagagccaattgcccatcctgcagctgtgaatgttgcagcttccagcaggttcttgctgcagacttactgagaggacagagtgctgtggcaggccaccccagcctgctgggcaccccctccaagatggccccaacaaatagtaaataaatgccccactcccaggcctgcttgcttccggtgctcctttcacctctgccctgcactgagccccctgattatggctccctgattcattctcagcaacacccggtgtccccagaacgctacacactgggccctggtggggcacaagggaaacagcacatctcagactggggttttcaaacccaaagagagtctcccacctagacagaggcagaagagaggcaggctcacgtggttgaactgtgtcccctgtgcccataacactcagcccatcccctaccacctcctccccggccaccttccctgacatcgagcccatccatcaccaaagtctccccagagcccaactactgtcatcccaagccctgcctcagtcaggccactgcccccttcactttctatccaggagacccagccagccagtcagctctgtcctgagatggaaatgcggccacagggaggagagcagggggagagcaggggcccaggcttcttcccctcctcattacccatccatccattggttcatctgtctgtccgtctatccacctatctacccatccatccatccatccattcatctgtccatccacctatctatctaccatccatccattcagtcatctgtctgtccatctatccatccatccatctacccaccaatccatccattcttctgtctatccatccatgcatccatccacccatttactcattcctccatccattcattcatctgtccatccatctatccatctaccatccattcattcatccatccatccattcatctgtctacccatctatgcatccacccacctatctgtccattcttccatccattcattcatctatccatctaccatccatccatccattcattcgtctgtctatccatctatccacccatccaaacatctatccatccatccatccacccatctatccatccatccatccacccatctatccatccatccacccatctatccatccatccatccacccatctatccatccattcatccatccatccattcatctgttcatccatccacacatccatccatctaatctcagaatgcttaatgatgtcacgccgtgcacatgggtctcctggaacatcagctctaaagggggaaggattacttctaggtttgttccctgtggtaacctagtgcctagaagttggcagaaagtcagtgttgaatacatatttgttgaatgtcaaatgactgaatgaatgaatagattcttcacctggagaaggggagtagagctcaccagctctcatcttcaactctggatgatccagtccaaatcccaggccatccagaggtacagccccaagtccaggaaagggcatgacttgtccaaagccacctggcaaggaaagagcagggccgggtgtccggcctgggtattcttcacccaaattagtgttttcccccctaactactaagagcctcctgtgccggcagtccctgggagcagcagcagaagcctagagcccaggagcggagccagtggccagagtagaagccaagactaggagcctctgaagagcaggaaccttcctgagtggggtttggatattcccagcaggaggaagagtgtgtgctgtgtggcaaagctgtcccagctgcccagaggagcagcaagtgctctgttggccttgcaatccctgccccatggcaggatgagcaggctctggcctggaatgcaccaactgggcagccctccaagcccagccaccgcccctaggctttcatgcccctccacctctagctctgggggccccaggagtcaatgcccacttcagctccagccaacatggcctgggatctggtctgatctaggctctgacctcagctctgcccctagctggctgcgtggccttggaaagctcacttctcctctctgcctcaggcaagccctgctcctcagcctcactcaggactgcggaaaaatgcatgttcttgggcctgtcactagagattctgcttcagcatgtctgcagagaactcagaaataagcagtttacaaatgctgccactcaagcatttaaggagacaggctgaatgagggcagagggccccatggctgaaccaccccatggcatctggctctgggcaggccacctgaacactgcccagcctcggtcctcttacctgctcaatgaggatgaccagggaatcctgtgggttttggcaggtcctgtgggagatggtgtggtaacagcacttggccataccttacaggactccaaagggtaaggggctcaggtctattgggatccatttcggctgtgagtaacagcagctgaataccatggaagttgatttctctctcctatctgtctgtgggaagctcagagcacttgctggcaagggaaggggtctcagaggtggagggagcccccaccgcacagccccagcctcccaggcagcatagggtggggacaggcgcatgcagaagtcctgctttcttccctctgcttgcacttttcagccatgtgtggagcctcacggggcctcagctgcctcgtcggtgaagtgggtgtagtgatagtgtccactctaggaggtggtcactttgaggattcgatgaggtcatctgtgcagcacacctgctcagggcctgcgcgtggcactccacagagcacaaggccagctctactcctccaggctgctgcaaagtgctgccagtgcaggggcctctccctggggactcaggaaaggccagaatctatgaggctgttgctctggccctgctgcctgcatcgctgatccatcctcagcctgaacctcaagggctgcagctcagacacagctctgctgctgcttcctaggaacagagtgaggactcaaagggaggtgctgggagcaaccaaggacatcagtgcctccttctcaaccagacaccctgggctctgagccctaatggttctccctcccactgtggcctaagtgtcttcacattcaaggctctggcagtcaagaggattacatctcaacatgagatttggagggaccatccaaactatatcacacggtaagacatgatgtatgtttatacactttattggacaattcgtttactgacagccaaaagcaccctcacaaatacaaaggctcaaccctatctggggagtcttttcagcctcattttccaccactgctctttgatgcctctctgggtgaaccatgtgttgctttctctttgctttggctgctaactgcaaggcccctctagtctcctcaaattggtgaactcctagtcatccttcaaagcccaactcaaattcccctacctctacaaaggcttctgagctcccctaggcagaactcaaagccctgtcttgctgccttcaaatgtcttcactgtggaatttcccacatcattctccagccacttgtctgctggccactctgctgcactgtgagctcttgtgtgctgcagccctttctctgtgatctgttatcccctagcattgcacctggtatgctgcaggtgctggtcaatgctgcatattgcattactgaaaacactgcttcctccaggcctcctgtaacccttggctctcctgatgttcttgcccagctgggcaggaaggtggtgcatctctcatgtcccaggggaaacaagctctcagcgagtgcacagtatgggaataggctcctgctgcaccacactgtccctgctctcttcaacccaggtgggatccctggcccagacaggaaaaaggacacccaaggtcaccagcctgcttggagcagagtggggcctccagaattgggtaggaaacactgggtgtgtttcagagctggcatgacagctgtccaaattgacacaacagtgcaggaggcaggacctgtgggagtggagggagctgtcaggtgctgaacaatgccacctgccagccactgaggagcagaggggatgggggaatggggggagagggaggggagcttggcaccgggaatgggtctgggacgcctcccccaaaaaccctccccccacaagcccatgtccctcagcctcaggaaccagaggggccatgggtgagggggaaggagcaagagagctgagtcagagctcaccctgggcaaaggtgtggactgctggctcagggtcgaccagggctcctttggaaagcaaaaaacgaccggggattagaggactttggagactaggaaggtgctttgtctgtcttgggggccgggagcggtgccaggagcatcatggattgctggggagctgggccaggctcctgggctcccaccctgctcctctgagagcggacagcaggattgagtaagcgctgtgccctctgaacttttctggagccccatggagctgggatccaggtgctgagctgccctggccacagcacacagatgctgagaagtcagtgaggccttttaggaaggcaagctgcaggcaggggcttgccttcctaagacctgagctcccaggcagggtgtgcaggggaaaaaaggccacaggctgcagccaggagttgctttgtttttctttattattgcagtttaaagactttttttaattgtacaagaacatctctttttgttagaaaaaaaaaccctgaagtattacaggcagtgttaatatgtctcttaaccacctaaccctcccacaaaacaaatatctgtttctagaggtaaccacttcagctactaccgtttaataaaaataatacatgtcaccctccaaaaaaatacacttcaagccataccaaatgtctaagataaaatgtttccctttccctaataatcatgaacaatttctcgggtactcctctggatcttttaaaattcatattcatattcaggcaccagatagttgttgttttctcataaataagaatcgatacttaatgataggaataataggtcctgctctgcatcctccccacctcctgggttcctgtgacgcctcggcttctccttgcacacccagagagacccagccagggccccgcactttcttcacccttttccctgggggtggacgcccgtggtctttcctgttatttcccaggcagcacaggagaagcacacataccctcagtcctgggtgcatgtagggtgactgcccccgaggtcgccactcagcgggtcctgggcagcttccgcagggacttggcctctgcttcctccactgcagctggggggttggactggatctagtccattcgaacctccccaaggatgggcagggggcacacccctcccactgtgcctgtcctagcagatgacccggacccggaatgtgggagcaccaggggtttgctctgggccaaacacccctggacacccctgctcctctgcccccaccccctctttacttcttctttccctcccaataccacaagtccccacaccatggcagagacaggagcctgtgtggccagcaagcccagcgaagggggctcaggtgtcatctccacccccagcagaggagggagaacacccccagccagctttgcagctcccccatttctccctctcccgctgctgctactggttcaaaagataaaataaaaaccctctgcatcaacaaataaaataaaatcacaataaaaaatttatattcctgggatgtaggtctttccaaacaggagcagctgctgccagagctgagtctgtcagaagcagggcggggctttttttcttactaggagtttcttttttgttctttttttcccaaggaggcacatccagttaaaatacattcctggaatgggagctccatgcgctttcctggtcatcaaagctgccgtttgttagcatgttctttgcctgttatcttgtttgtttgtgaggattgctggagtttcttttttgagatagagttttaggctgttgcccaggccagagtgcagtggcgcgatctcacctcactgcaacctccacctccaaggttcaggcaattctgctgactcagcctcccaagcagctgggattacaggcgtctgccaccacacccagctaattttttgtttttagtagagatggggttgggttgctggagttcctgagtgacaggatgttgcagcagaggtggtgagtggcggggaggggggtatccatgaagtcaggagagctgcctggcaactggaagccaaaggggtcaacccaccagcccctctggagacagctgtctgcagctcagacctcgttgaatacggcagccactcattcggctaaacgtggggatgcattaaagacatttgcagacatcctttcttctattgcaccttttctcaggaaacttttagaagcattccgtcaaaactacagactagaacatgagtcaccccctgcacgatgcccagtcctgtcactgggcagtttcctgaaagctgctaccatcccccatctgagttccagatgcagtgccaaggctgggctgggggcacagggaggagctggcccagtgaacggagcacaaaccaagacagcccagtgaggggtccccagcgagagatagagcaaaggggtgcattcaacattcaagttcccaagacccctacaacacaggctgtacccagtgttggcatgtggtaaggggcctgttgtgcaggttggccactgctcaactgaaaaaaaagtggcagctgccagaggctggccttgaaccagggaagctacccactctttagccatcactctgcactctattatgttgccattacggaatgagagtggagcccggatattgccccagacctcgaccctgtgagttcagtgccactggctgcccagagcccctctctgtctgtctctccttggcctggaggagagtgtggccacaggtagtatccaaagcctttccttagggccttctcctgacctatcctgcttcccgggctcaggggacatctcccggagttccaaccacacgactgaagatccagcgagcctcatggaaggggttgtgtgttgtctttcccacgtccctttcttctctctgtccctctgcccctctgccccttcccgtgcctgggagagctccagagtcaccttcctccatcacagagcaattgagctccaggcctacaaccctaagatgggcaaacccagcccatctttggctcagccaaatcttccaggtcccagccacccacccacttgcaaacacacatacatcttcaccccacaggtgacctgtgccatactcctaggggtgttcaaactcaggggaaggggtggtgctccctcagggaacagcgccatgactctacgacagtcagtactggcagctgtcagagctgtcattccctgagtgcaactcttaatgagggcctattaagtctcctcttatgactgcataattgttgccacaaggaggctttgttctctttattttggaaatgaaactgttttatatccctaaagcaagagagatggacaccagcttggggcgcactggagaacacagaacggcagggcaggggctccactgggttggggctctggtgtccccaggctactgcagacacagccctgagcccagggagcagcagctgttgtttctgcagcagagcggagcggccaggtcagctccagccctcctgtgagctgtgggaagttgccacaggcccaccggccctcctcacttctcctgtagctcccagcaactgtcatcatgaaccatctgcaccctcaccaccccttaggggctgggcagtggtagggctcttattcccattgaccatgagaaaacagaggacgctggttggcctggccagggtccctcaggtgtaaagggaggattaacaggaagaagaagttgagcatgtcctatgtccgaggcacatctgctctaagtcttcacatacacgacctcacctgctcactaccacaggctgcagaggaggagctgagctcccatgttaaggtgaggcttggaggcattaggtgaagtgtccagtacaacagcttctatgtgaccagctgggctttcagtccagacatttctacctctccagcttcccatcctcaagaatgtggctgggccagacccagactctgaggacattcagggacactgtgcctcgccagccctctgaagtgctcagaacgtatgtcccgaccccactgaatgccaggaaccatgcactgggaagtgggtggacaggagagacaagacatgctccttccccaagaggaggctgcaggcagcaagggaaacccttaggtaagctcggaacagccgtccaccactgggaccatgagctgcatcctgccttggggggccgctttggtgggagtgtgctgggcagagaagaagggaaggacatccaggcagagggggcacctgggcaaaggctcgaaggtgcagaggtgagaggcatttgggagctggtgaaggcattgggggtggcctccaattgaataatatgcatttaagtttccttcttgtcttttcatggcttaaaagctcatttctttttagtgctgaataatattccattgtctggatgtaccacagtttgtccactcacttactgaaagacatcttgatagcttacaagttttggaaattcggaataaagctgctaaaaacatccatgtgcagttctttgtgtggatgtacattttcaacccatttggataaacagaatggacttgcagttgctggattacatggtaagagcatacttagttttccagtttcttctaaagtgtctgcaccactttgcattcccaccaacagtgaatgagagttcctgttgctccacatcatcaccagcatttggggttgtaagggtttggatctgggccattttgataggtgtgtagtgctatctcattgttttaacttgcagttccctaatagcatatgatgttgagcatcttttcatatgcttctttgccatttgtatgtcttcattggtgagttgtctattctggtcttttgcccatttttaattgggttattcatttgcttattgttgagtttaaagagttctttatacattttagataacagtccttaaaagaattcattgttggctggacatggtggcttacccctgtaatttcagcactttgggaggctgaggcgggcagatcacctgaggtcaggagttcgagaacagcctggccaacatggcaaaaccctgtctctactaaaaatacaaaaaaaataaaaaatgagccgggtgtggtggcacatacctgtagtcccaactattcgggaggctgaggcaggagaatcccttaaacctgggaggcagaggttgcagtgagctgagattgtgccactgcactccatcctgggctacagagagagactccatctcaattttaaaaaaatgtattgtttagtgcatgtatttatttccttttaaaaaggtttattgacatttaatgtcttcttattttcttggcagtgtgttccacagagcagaagtctttaattttaatgaagtccagcttatcaaatattttcattcacgaatttcaccgttgatgatgtattttaaaagtcatcactgtacccatgataatctagattttctcctatgttatcttgtagaacttttatagttttgcattttgcatttaggtttttaatccattttgagtaaatttctatgaggggtatatggtgtgtgtctagattcttcttcttctatttttttttgcgtttgtgtgtctatgtctatttgttccagcaccttttgttgaaaagattgattttgctctacagttttgcctttgatcctttcacaaagatgagctgactgtattttatggggatctatttctaggctctctgttccatttatctacttgtctattctttcaccaatccacactgtcatgattatgatcgttttatagcaagtcttgaagccaggtagcatcagccctccaactttgttcttctccttcaatatggtgttgactattgtggctcttctgcctctttgaataaactttaaagttagtttgtcaatatccaaaaaataccttgctaagattttgattgggattatatttgatgcatagatgaaattggaagaactgacatcttgacaatatgagtcttcctgtgcatgaacaaggattatctgtccattactgagttcctctttgatttctttcaccagaattttgtagttttccttatatagatcttatacatattttgttaggtttatacctaaatatttcaatttagggggtgttaatgtaaatggcattgtgatttttttctgatatattcttattaaaagtttttctgggtacataatatatatatcatatatgtatctcatattttatatatgtatatatatatatgaggtacatgagatgctttgatacaggcatgcaatgaaataatcacatcatggagaatgggatatccatcccctcaggcatatccctttgtattacaaacaatccaattacactcttttagttatttttaaatgtacaagcaagtttttattaactatattcatcctgttgtgttatcaaatactaggtcctattccctctttctaactattttttgtacccattaaccatccccacctcacccccactatccttcccagcctctggtaaccattcctctactctctatcatcatgagttcaattgctttaatttgtttagctcacatatataagtgagaacatgctatgcttgtctttctatgcctggcttatctcacttaacataatgatctccagttccagccatgttgttgcaaatgatagaatctcattctattttacagctgaatagtactccattgtgtgtatgtaccacattttctttatccattcatctgttggtggacacttaggttgcttccaaatcttagctcttatgaacagtgccacaacaaacatggtagtgcatatatctctttgatacactgatttcctctcttttgggtatacacctgtgaatgagattgctggattatgaggagctgtatttttagttttctgaggaaccttcaaactgttctccatagtggctgtactaatttgcattcccaccaacagtgtacaaagtttccctttactccacacccttgccagcatttgttattgcctgtcttttggatataagccaccttaactgcagtgagagaatatctcattgtagttttaattcatatttctctgatgatcaatgacattgagcacctttttatatgcctgtttgccatttgtatgtcttcttcagagaaatgtccattcaaatcttttgcccagtttttgataggattattatatttttttccttatagagttgtttagctactcatatattctggttattaatttcttgtcagatgggtagtttgcaaatattttccaccatttggtgggctgtctcttcagtttgttgattgtttcctttgctatgtagaaactttttaacttgatgtgctaccattagtccaattttgctttggctgcctctgtttgtggggtattgctaaataaatttttgggccaagcgtagtggctcacgcctataatcccagtcctttgtgacacttagaggggtggattgcttgaggccaggagttcaagactagtctggccaacatggtgaaaccttgcctctactaaaaatacaaaaattaatggggcgtggtggcgcacacctgttataccagctattcgggaggctgagatgcgagaaaggcttgaacccaggaggtgaaggttgcagtgggcagacatatgccactgcactccagcctgggtgataggtcaagactctgtcagaaagaaagaaggaaggaaggaaggaaggaaggaaggaaggaaggaaggaaggaaggaatttttgcccagactaatgtactggagattttccccaatgattccttgtagtaatttcataagtctttaaacacttttgatttgattttacatatggcaagatacagaagtctaggatttagtttcattcttctgcatatggaaatctcgttttctcagcaccatatattgaagagactgtcttttccccagtgtgtgttcttggcacctttgttgaaaatgagttcactgtaggtgtgtggatttgtttctaggttctctattctgttccattgggtctatgtgtccatcattatgccagtaccatgctgctttagttactatagctctgtagtataatttgaagtcaagtaatgtgattcctccagttttgttcttttggcttagcatagctttggctatactgggtcttttggggttccatataaattttaggattttttttttctatttatgtgaaaaatgtcattggtattttgatagggattgcattgaatctgtaggttgctttgaatattatggacattttaacaatactgattcttccaatccatgatcctggaatgtcattccattattggatgtcctcttcaatttatttcatcagtgttttatagttttcgttattgaagtctttcacttatttggctaattcctgggtattttatgtgtggctattgtaaatgggattactcttttaattcctttttcaaattgttcactgttggcatatagaaatactactgatttttctatgttgattttgtatcctgcaactttactgaatttgtttatcatttctaatagtttttttgtggaatctaggttttttttcaaatgcaagatcatatcatctgcagacaaggataatttgacatcttcctttccaatttggatgccctgtatttatttctcttgtctgattactctagctaggacttccagtcctatgttgaatcaacagtggtaaaagtgggtgtctgtgttgtgttccagatctttgagggaaggctttcagtttcttcacatttggtatgatactagctgaatggtattgtgtgttaatttcaagttccacttgttctttgtaggtatctaggaacgtgactggcttttgtatattaaccttgtatcctgcaaccttggtataattattgactttctaatttttaaatttctttttttttttttttttttttgagacagagccttgccctgtaacctaggccagagtgcagttgtgtgatctaggctcactgcaaactccgcctcccagattcatgcgattctctcatctcagcctcccaagtagctgggattacaggcatgcaccaccatgcccagctaatttttgtatttttggtagagacagggttttgtcaggttgcccaggctggtctctgaactcctgggctcaagtgatccacccaccttggcctcccaaagtgctaggattacaggtgtgaaccaatatgcccagcctagaatttttttgcttattcttttcagattttctatatagacaaacatgtcagctgcaaacagagagtatattttttcctcctttccaatctgtataccttttatttcccttgcttgtgttatcacattagctaagactctggcacaatgttgaaaaagagtggtgagaggagacatacttgctttgttcctgatcttagcaggaaagctgtttctcaccattaagtataatgttagctataggttttttgcagatgttctttatcaagttgaggaagttcccctctagtactagtttactgagagttttttatcatgggtgttgtatttcgtcaaaatgtgatttctgcatctattgatataatcgtgatttttcttctttagcctgttggtgtgataatttatatatctatataagttttgaatattaaaccagctttgcatacctgggataaatccctctttgtcttggtgtataatcctttgtttacattgttagattctacttgcctttattttgttgaggaattttgcatctatgttcatgagagatattggtcccatagttttattttcttataatggctttgtgtgattttggtattagggtaatactggcctcttaggatgagttaggaagtattctctctgcttctattttctggaagagactgtagaatattgatagaaatttagaatattgatatatttgtagaatattgatataatttcttcagactctcccctccccccaccatctttaactctgagtgtcatgaagtcaagaattgtatctttcatctgtgtgtcacacataaggagggcaagacttaaaaaagagtagatgcagaataaattttaaaatgctgtatttaaaatcacaagcaaagtcccaattgcatttgtacatctcaccatctagcctgagctataggccttactaccacttagtggcaaatgtgacttacagtatcttctaaattggaagtaaaaagaatcaggtctttaattttgcaaacttgatgttaagaagcgaaacaaggggcataatatgcaaatacattttctaaataaattcaacccatcagccatctagaattcatgaaaaaatggtgaaaatgcctaaatccccagaatctgtaagaaaatgaaagtgtgatagtaaattttatgtgtcagcttgaattggtctctgtaaagtaggtttccctccccagtagctcctgaatagaacaaagggcagatgacagaggagtttgacccttttgttcctgcctcacttcttaagctagtacatctcatcttctcttctcttacccttgacttggggtttacaccattggcttccctggtccccaggccttcagactcagattgaatgacaccgctggctttcctaagtgaccagcttgcagattgcagatcatggtattttttgcctccacaattttgtcagacaattcttcataataaaattggtctttctgggtgggcggatcacttgaggtcaggagttcgagaccagcctggccaacatggcgaagccctgtctttactaaaaatacaaaaattagtcaggcgtggtggcaggtgcctgtaattccagctacttaggaggctgaggcaggagaatcgcttcaatctaggaggcggttgttgcagtgagcccagatcacaccactgcactgcagcctgggtgacaagacaccctatctgtctctctctgtctcctctctgtattattctatctctctctctgtcattctgtttctctctctattttggtgctactgtttctctgaaggatgatgactaatacactaaggaaaaattacataaatatatgataaatttaacaaaataaatttgttaaaaatcgatatacattataaagttaaccaaataataataacagtaaatagcaattttcttatttttttgtaatttatttcaaatgtacacatcagcataattttcatgattttaaattctgtaagcattagattgaaagtcagaagcaagccaagaacatattactttattattgcttaacattctcctggatattttaatctgatacatttagaggtataaaatggtaaatattttcattattctctgaaacttatttacctagaaaaaacttataaataaaaatttactaagatatctagggacaaaataaacacatgatagtcaatggttttcatataaaaagtatacatctacttctgtgatgcttatgttcatgagaacaaaatatgaaaatagccagaaatgtttaagagaataaaggtatactgagaaggcactaaccttaggttgattttcaaacatattagttaaccaaaaaaaattaaaacaatgttatattggtgcatgaattcatagagcagatagtgaaacagaatagtgtatttatctatatgtgtctttctgtgcatctttctatcaatcctgagtgcttaaggtgagattcacttgcacctgaatcagcagaaaatatttggagcttcaagaataaatgcagatggcacttagagatgctgcacccaatgtcataagggattctgtggaggagctcattccgatgaaataggtaagtttttattttgtattttcatttttttttttgaaatgagaaagaaaagtctcaatgaaagctaagagtcagacacatatatagaaatattgctgcctactcccaggcatgcaagtgaccaactccttacttcagggagtggaggagcgagatatcaagagtacaattttcttaagacacctaccccacctttcatcaaatatccccaaccctagattaagtgcaggagtcctgaaaaacatttccacagggaaagtcggggtcccaggctcatgggtgtcttcttactgcctttagcagaacaaaaatgagtaaagcaaagcttcttgcttcagaaatattcagtctaatacagtgtgtaccctacacctaatcatcacttcattccagaagctttaattgcacaaaattcactgggaaagggatgatatttgtctgttttttaaggataaggttggtattggctcaaatttatatttattctccccaaagagtccctcccaggtttgtaatcctgatgtaagaggctgctgcaccaagtcgcttctttccaacctgtcctactttgtgtagaggaggagagcggggaaggaagaaaagagaaaaaaaaagcaaagaagtaaaaagaggcagaaggacagtcccttttccttgacacggatggcatgaatgggcttttgcggagaaactctgcctgaccctggagtctgagtcaggcagagtctgagtcaggtggagtcccagttagaagtcctctgaggaagctgcactagagtcactgccctcagacatcaacttccatgtcttccccactgctgcagtctaaagagttactgctttcttcctcttcgccatctttcttcctgttgtcttctggttccatagagacctgacagtttacccaaatagtctgtgatgcctctgttcctgcagcctggagcccctgcccctccccaaacccttcttgcagaccctttgctgatgaggactgcggatctgtttgtttcaagctgggggccgggcctcccatcatcgccatattcttacccttagcataggtcgattctttgtatgcagcataatcttcaggtgacaaagtcttgagccagagatccaattccactttgtattccttctgcagcaactcagcctggctcttgtaatgatccttctggctctgcgggatgcgctgccagcgtctgccaatctctaccatgcgctccctcagggacaaatgttgcagctccttacttgaccaggaatcttggtgaaacttctggtatccattcatggggggtttctgaggctctccatgaaattttaccttcttgaaaaattgatccgtttttggaagagacctcacttcttcaatatttttctgaaccttcttttgcactttggtttgaaccctcttgcagatatcagatttcttgcccttctggtctaaatcagggtgttcttccctgaatcgagcaagtttttcctcaaattcttgcttttccttccggaaatcctgaatatgtttctgtttcatctgctctgggagctccttgtatttctttgacaggattttggtcacttcctggcttctcatcccagggtacatttgggagtactggggccaattctccttgaagaagcggatataagcagtaaggagcctctttggaaagtctggatggttcctgcctttttggcttttgtttgtatttttaacacatttcttagcttccaggactaattttttcaaagtgctgaattttctcaagctgcaagaaatctctaaccatttgagtctgcacatttcaccagaaaagtttttaaaagctacttttccccagtccatgtgtgactgagttgagctgaacgtgccgttgtcatcatatgggagattattctccatgcattccagtaacctcaagatgtctgcgttggaccaatggccttggcttctaggcaaagccactttgatgtctttggcttacttataagatcccggttatgcagacaccagagtaagaacacagagttccttacttttaagagtcagtggatgatttctttctggaagtcctgcagtatgtatgattctgtatttctgaggagaaagaaaagaaagttactctgcttcattgggattaatgaaaaaaattacaccctatttgtcatatgtcccttgtataattaatttactcaatgatataaataaaatatagcccatttctgaatgaaaatccatatttgcctttcatatgctacatgcgcaatattcaatatctccgcaccccaccccagccttctttctgccagatctcgcatgaaccgatcttaaattgagttgcataaggcaaacaccagaccactcatcacttaagaagcttaatagaacagaaatgccctgaagacagagtcaagagttaaagtggaaggagaaatgcctaaacgggaaagactgttcattctacagtgccctgagtatgaccattttctaagcacagcccaaatagccatagctaaaggtgcagatgagaagttaaagatgcaataggacaagcccaagagctcctccagacatgcatccaactgttgttacctttttgtgagggaatgtgaatctgtgataaaagactgaattaaagattctccaggaaccatgcatgggaatgaatgctttctagtgaaccataccgcttctccttttaaatatcaaggatttaatgacaattataaaacatttcaattttatttggttaactgttcatcatctttaagcctcagtgaaagtttgacttcctccggaaagtgcctccaaaatacctggcattttccattatagaacttgaaaacatggcagatccgataactactgcttattttttttaaattttatttatttatttttttaccaattttgttttgcctaaagtaattcctctgggacatgatttcccaactaattctccaaattctcataactctttcactagtctttttaggataatcttctattctaagacaaagcctaacttcagtaaaattgtgtacaaacacatacaacattaaatgaaaccagatcttaaacagagggtgcataaggagtgtaacatggggacttcaggggaaaatatgcattagaagggaaagagaacagagttaagatgccagtggaggttgaaattctgagaatgagtttcagaatatgtgagaatatttttgagaactatttttaattctcagtagagtatagaaggatgtagcctttgaatgacgttaaaaattcactagaagtgtgaagaatgttataatatcacatgcctcaaaacacaaattccttaacatagagattaaaatgttttaaaatattggataataattcaagtccatatttgaggtagaagataaaataaagaatagctcatatatcaaatttattatgtgaaaaagacttttggaaaattgttcataataaatgaaaatataaataaaaattaaaatttataaaaaagcattaaaataaactgtgaaaaacttagaagagggtaaacttgaaagttattgaatttttaacctcaaaaatctgaaaaaagtcagttcattagtgtcctaaaaaaataaaaataaacgtaataatgtaacaggagagtaattaagaaaaaagtaacattcacaaaggaaaataaaaaaattaaaaaatatttgatttcatactttgtgtttaagatcaaaacatactctgaaatggttcagggataaaaagatgtcaaacttccaaatatattgtaagtgatgattataaaaaataaatacataaataaatataagatgtattctaactcggaaaaaggggaagtcacatagacttgatgttagaaaagagatgtggaatactcagaatctgaatttaggaaaagaagtactgtcttcccaattgtaaatgttaggatgatgcgtataaagcagtgaaaataaaaatacagttgtgtttttgttgttatgtggctcttttatgagccagacattttttcaaattgccaaagagcgtggccccccaaaatatgtgtctaagtcctaacccctgaaacctgtgaatatgaccttttgaaaataggatctttgcagatgtaattaccttggtaatctcctaatgagattagtctgggtttagggtgggacctaagtccaatgactcgtatcattatagaagaaatcaaaggaagatctgagacacatcgacagccatgtggagacagaggcagagacagagctcactggagctatgctgccacaagccaatgaaagctaaatgttcccatcagccatcagaaaccagcagacagggaggggctggatttctactcagaatccccaatgggaaccaactctgtcaacgtgttgattttaaattttaggttttcagtatgtgagagagcaaattattgttttatctgtgatagtttattacagcagccccagcaaactaaaatgtaaatgttttacacttattattaatatcttatttttcgccttgaatttctatgaggtcattttatgcttgctgttctattacttccatgatgaaactgcgaccaggtgtggaggctcatgcctgtaatcccagcactttaggagcctaagatgggaggatcacttgaactcaggagttcaagataagcctgggcaacaagtgagaaatccccttaaaaaaagaaatctcttaaaaaaagaaagaaagaagctgggaaatactaagaatttatacagggccaggcacggtggctcacgcctgtaatttcaacactttgggaggctgaagcaagaagattgcttgagctcaggagtttgagaccagcctgggcaacatagagagaccccatctctagaaaaacaaaaatttagccagacccacacttgtagtgcctgtagtcccagccactctggaggctgaggtgagaggatggcttgggcacaggagggcaagacttcagtgagccttgattgtatcagtgcacttcagactaggcaacagagtgagaccctgtctcaaaaaaattaaccttgtgaactgtatgtgattgcccccttttctgtgttagaatacatcttttatttgtttactttttactttttatcatcatcacttgtaaaatacttagaagtttaagacatccttttatccttgaaccatttgagggtaagttttgatcttaaacataatgtatggactcctgtgactttgtgaagctgtatgaattcttaatttttaatttttattaatttttttaatttttgtgacatgaaaagtaaaaaataaaaataaataaataaaaatgtataaccttcacaaagtcatgttttctattttatagagtaaaaatatcaaaaaataacaagagactttgaaaagaacattcaaacaacaaaatagattttgtaaattaaaaataccattacataaataaaaacttcagtggaatattaggaaaataaaaaagtgcctttgagcactttgaaaactttgcagacgaccaaggctgcatgcaacctgaagttacagacaacacagaacttttcatattctacaataaatgtttccaattaaattctagatgtcatgctatagataaaactgtaaaatatccaggactttccgtccagaagttcacaattttataaacaaaaaaaaaattaaaggacatactcacctgaatattctataactggtctgaacagtgcttgcaggaaaattcatgcatttggctcaggagttgggtgtcccctgggctttctggataacagatgttattctctgagatttccacagtctagcaaattccaaatgcctctataaataataagccttgctttttggaggccaatgtattataggatccttaaatcccctcccttattaggtttctgcagtacagaggaccaatgaaaggatttacccttccaccattgtttacatcaactcaatttctaatctctgtaaatagccctctacaaacaccctctagttgtggttagtgctggtttatcttgtcatttatttatttatttatttatttatttatttatttatttagagagggagtcaccctctgtcatccaggctggagtgcaatggcatgatctcggctcaccacaacctctgcctcccaggttcaagggattctcctgtctcagcctcccgagttgttcagattacaggcatgtgccaccaggcccggctgattttgtatttttagtagaggcagagtttcaccatgttggccaggctggtctcagactcctgacctccagtgatctgcccgccttggcctcccaaagtgctggaatcacaggtgtgagccaccatgcctggcttttgtcattgattattaaacaacacccacgtggcaaattcatgtttgattttttggggccccaagtctactttcatttctgctcccacatctgatagtatttttatatgatatttgaatacatcattccattctttgataatttctgccctttcttcactgaaatctaggatctgctaccatctcacctggctcatcgacatgtaaatcccttcagtactgatcaatttctaccagtctttagatttgaagaccaaaatgctaatgaccatgatggatggttttggaaaaagacaagtagagcctcaatgtctggcacctatggctgatttaattttaaactcagggaaatgaaataggtactgtgcataaaaaatattcaggtgattttatttaaagcatttttactaaattcaaactaatcaaaaaaacctttatttaaatgacaacttatttcaataatttttaaattttcatttttaatcaatatataaaaattgcacatatgtatgacatacgatataatattttgatacatgtataaattgtgcattgatcaaattagggtttgacaacctcaggcttcataatttatgaaatagacctctgccatttaaaaactttatatctaaacttaccaactagtaattaactgaacatatcaaataagatattatttaaaagagcctaaattaataaaatgtttaaatacattttgagctttaaaatacaataaataaatatgacttattttagaaaaatttttttaaaaaatagacaaaggtggatatagacaaaaacatgtacagaaaaatatcaaaaggactaaaccccttggagattttaatggtaaaagcttgctgatattatttttaaaattatcaacttttaaaaaaacattttatggccatttgttaatgagcataagcttctactgaaaatgaaatatttgcttctataagaatatactctcagatattgtatgagaatatactgcagcattgtatgagaggcaaaaaactagaagcctttggaatattcatcatgggagaatggctgggcacattaacgtacattcacagtagggaatattctgcagccatcacgtaagttaagatctagatgtattgatctgaagggacatctacaaaatatatatattttttgagccggagtcttgctctgtcgcccaggctggagtgcaatgatgtgatcttggctcactgcaacctctgcctcccgggtgcaagtgattctcctgcctcggtctcccacgtagctgggattacaggcgcccaccaccgctcccagctaatttttgtatttttagtagagacagggtttcgccatgtcggccaagctggttttgaactcctgacctcaggtgatctgcctgcctcagcctcccaaagtgctaggattacaggtgtgagccaccgcacccagcctacaaaatattttttaatgaaagaagcaactaactaaaactttgtatagtagttatgtttttatattttatattcatatatgcagtgatgctcaatgggaattttgcaaatccagggggcatgtggcaatggctgaagatatttttggttatcatgtcagggaggtgctaatgacatagggttaaatcctacaatgcacaacctccctcaaagaattatcaacccaagatgtcagttgtgctgagcttgagaaactctgtcatagggaaaggaaaaaaaggataagcaccaaactgctagcttgttccttatatatctgtgctgttcaacttataatgtacatttattttgacaactgaaaattatcctataaaaataagtttattgtgctggcaaagacaatgatagagcagaggtggcagactgttccccaagccaactgtttccaaaggagacctgagggactgggtgtgagttgacagtggtgggagctggaagcagcaagggatgcggggacatctggggagcctggacctgaccttggagctcactcacacaatctaaataatcccagagtgaggctgaggttttcctgagttggatgagggcctgcgaaaatttcctattattaggcaagcctactatgagagtgagaagcctaaactcaatttccattttatagcctggagtaaaccacttctggtcaggcagcagggaatcataacatatcagagctgaatacctcactggtttgctgaggggcaagttagtaggtgttcctcagaaaggattttgtggtcaattaagacagggaaactctggcttaaactgcaggtaaattaaataagaggtctttactgcaagcctaatcagagcctttattatgctagtgtccatctccaaaagggtggtcatcaaatgcaggccctccctgtcttgaccaagtcctttttcttgagatcatgtcttgagacttggatgccatgcaatacactttgggaaatactaacctagttgaacgacagttttactgatgtagaaatggcggcccaaaggataaaaagtagctgaactagctggtggggctactttccagaccaatgcttttttctcctgcctaagaccttaaccacagttgcaaattaactacagatcctcagaattttcgcccaattcaacttggaggggttgcagtggaggtgagggagaagggagtaacagtgaagccattcaaagcaaaaaccacctttaaagaaattttggccttagaatacagggtttttttttttttttttttaattggtggagggggcacccaggaagaccagacgtgctcctgtgaagcaacgctccaccacgtccttttgaaaataccgtagcctgcatgagacaggcgggagcacctaagccttcaactctccccatgttgcctccaattgacctcactgggccaggaaaagccctataaactggttttgtatactctatccaagtagtaaatttactaaaattactggatcctactatataccagacctctgcaaggcattgaagattcaatgatgagcattaattcccactctaaggggatttttctatctggtagggaaactcagataccgcatgcagctagcctgtcacagggctatactgactaaagctcaccctaagaaatttgcacatcttagcctatgggcaacgggaagccatggacggaatatgttttccgtttcaaacaaggaactccagtcacagcaggctctaactccatttcctattatcaactccccttcctgctcctcctcccttagtagcctcgaaaaagagtggccacttccttcacatcaccagggccttggtcctggtagggggtcccgcccccggccctgtcctcctccccaggccgggacctccgcgcctcccacacacagtacaactctaacacgaaactgggccaggactgcaggtaggtcccgtccaatgcgacacgctcgcgacggcccacgcactgccagaaccagccctgccactaaccagcctagtaaggaacgcagtgatctttaggagcccacttctaaattcaaatcatttggggttcagtaagtctcttcacagacggggacctaatagcttccattagcagcctccacgtttgctgaacacgactacggggccagacccacaggaactccaatgtggttcagccgctcaactccagggaccaaaaagactttcccacctcccagcgttattaaaggcaaccccgcccccaagcctcagccactacgcggtgcagaaagaggcagagctgggcatgcgcaatttccgcccccgccacagtcttgggagtgggcgggctcgagggctgggaggaagccgaaagctgaccgagaggagaaagaagcccgcccccggaagtccctcctgtctctgcagcttgttcccggaagttttgctgctagtcgcggacgcaatggcttcaaggttacttcgcggagctggaacgctggccgcgcaggccctgagggctcgcggccccagtggcgcggccgcgatgcgctccatggcatctggaggtactcgggtctccgggcgtgccagggaccagagtgttgccctcccagggtggtcccagggcggcaaagcggcgcggctcgtgcagcttctcgaggtcccagtggccgctttacggtccccagtgcctcaggctctgcaggcatctccctgtaattctggaccgctgctcctgccgctccccgaactcactccgctgcgaaagtatcctaaacggaggtgccgggtgaccttgggagggaccggggctgccaccgggatggggaggggtccggcctcccttcaaacctgcgcccacctcaagcagagtgggttctacatgcttttagacaaatgtcgacaaatttgcctcggtggttggagaaagaaaagctcataggccgggcgcggtggctcacaactgtaatcccagcactttgggaggccgaggcggacagatcccctgaggtcaggagctcaagaccagcctggccaacatggtaaaaccccgtttctactaaaaatacaaaaattagccgggcgtggtggcgcgcgcctgtagtcccagctactcgggaggctgaggcaggagaatcgcttaaacccgggaggcggaggttcccgtgagccaacatcgcgccattgcactccagcctgggcaacaagagcaaaactccgtctcaaaaaagaaaaaaaaagctcccccgagtgctgccgcttgtgtggatgggtacttggtggttcttaggggaccatggatatgagtagcctttaggagcttgtgagcccgctaaaacttatacagaagtttcggggcaccattttccttgatcatttctgtttgtagtttttctatcagtcatttcagtcagcgtcataattcacgttatcttcctttaggtggtgttcccactgatgaagagcaggcgactgggttggagagggagatcatgctggctgcaaagaagggactggtaaggagaaactcccttctgtgtcttctgtgtaacttatggccttggatgtgttcatagtggtctcctctctgggagtatttgatacaggaaacttggcttgtaggaacagtcccctgagcttctggaaggtagggcttatttggcctaatggttcaattcttgttttttttgttttgttttgttttttgttttttcttcaggacccatacaatgtactggccccaaagggagcttcaggcaccagggaagaccctaatttagtcccctccatctccaacaagagaatagtaggctgcatctgtaagtacctcacctctattttttatccacttgcttaatatatcctacaatagtgtgtaagctgcctcaaatcttcagtgtgtgagtgcatgttggtaagtttgtctaagggtcttgacactctcaagcctcattatgcctgatagttcatccttactggaaagaagcgcagcacagcggtaagactggctcactgggagtgcggcatgaaggagtacccacccagcaaatatttattgttatactgcttctatgccaggcatcattttagacactagggatacataccagaacggaccctgctttgcgttctacataggcaagggaattgttagaatttacagtgaccttgatacaaggtcagtttactcataggtgaactcagagcctcaatttcttcatctgaagaatgggaggagggcttgaactgatctcttaagatatcaaccatagtcttacttgtgtatcagagatgtctgaggaaaagaaattcatgttgaaagtctccctttctaggttggatgaccataaaccaccttttttcccttttaggtgaagaggacaataccagcgtcgtctggttttggctgcacaaaggcgaggcccagcgatgcccccgctgtggagcccattacaagctggtgccccagcagctggcacactgagcacctgcactaaattactcaaaatgtgctgtaaagtttcttctttccagtaaagactagccattgcattggctccttctcccatagatggctggtcttatttcttacccgtattctttggtaggcatggaatatgcttattttgggaaaagctgtctgttaatgctagcttgccatccacttactgaaagtgtataaccagtgtatagtgcttagattaataataagaatagatcgacaacccgtaatgcaatgaatgggaccacctggtatgagagaaaggggcgggctgaggagtcaggctgacaggacttaaaatattggctccatcatttggctctatctctgtggacatgttctctgggggtcaagtacaactacaaaaaggtaagtaccttacaaggtgcttaatatgtaaagagctgagtggatagtaggtcctcacagtatcctcatagagacagggtggccttgtgaagagagttttggggattttgaagtcttgagggacccaggtgcaaagtaagaattcatggggataccagcagcaaaattcagaatatggaacaatttcagaaatcactgaccatgtttcttcaaataaattgcaaggagtggggggaaaagctagggagaacatgtggagaaacagataagggagataccagtcagcagcatgcacaccttgtttagatcttgatttgaaaacaattataaaggaaaaaaaattgagaagaatttgaactctggatatttgatatgtagacatttaccaccctttcaggtatttatatagttttgttttgttttttttaatgcttgagatacgcacaggaataagggaggggagaaatgccaaaaaagcccactttagctgcttcatacctgtgacaccttgggacaagttaaaatctcaaaaccctcttacctacaaaatggaaataccttttcattttgtgtggagattagccagaggtggcttcagttactatcttcacaaaattggtcgaaagtaggtatttcagtgggagctgatagagtcagagaaaagccccttcccctcatcttgcccatcctgaaggtgtagtcaaagctattgcttccatccttgttgttcatgacctgtgtccaggaaatgtctaagcactgacctgccatttaaggccctttcctctgggaaggggagctctcagataaccccctgtgaaatctaacccctacacgcccatgagattagtctgtgctgtcactaagccctcctgtgtggctggcctgcctttccctttccacatctcttccaactcaaactcggctgagggagacttttgactccccacatcattaatccagtctgttttctccctccctcatctccaagtctttgcttttcttttttaaaatttaaccaatttacttgtaaagaaaaattggctgggcatggtggctcatgcctgtaaccacaacactttgggaggctgaggtggaaaggaccacttgaacccaggagtttgaggcttcagtgagccatgaccgtgccactgcactccagcctgggtgacaaagcaagaccttgtctcaaaccaaaaaaacaagcggaaagaaaaatctccagtacatttccagacagtggcaggcagaataatgatcccccaaagatgtccgcgtcataaatccctagaatctgtgaatatgttaggtcacatagcaagaaggaattaagactacagatggaattcaggttgctaatcagctgaccttaaaacagttattcccagattatccaggtggatccaaaaagcacaaaagaggcaaaagagagtcagagatgtgactcagaatggtcagagagatgcaatgttggtggctttgaagatggaggaaggggtccacgagccaaggaaggcaagtagctattctaaaagctgggaagggcaaggaaatgatactctagtcttcagaaaggagtgaagccctgctgatactttcacttcagcctagtgagacccacattagacttaggaaccgtaagataataactaactattttttttttttgagacagagtcttgctctgtcgcccagcctggagtgcagtggcacgatcttggctcactgcaagctccgccttctgggttcacgccactctcccgcctcagcctcctgaatagctgggactacaggcgcctgccaccacgcccagctaattttttttttttttttttagtagagacggggtttcactgtgttatccaggatggtcttgatctcctgacctgtgatccgcccgcctcggcctcccaaagtgctgggattacaggtgtgagccaccgtgcccggccataaacttgtgttattttaagccactaagtttgtgagaattttctgtggcactaataggaaaagaatacacagatcaataaatccaatccctgagtcagtaggtctcatatttagctgcaccttagaaccacctggggatcttttacaactcccagtgcccaggccacacccagacattaaaatagtatcttggggtaggacccaagcatcagaagtttaaagttccacaggtgtttccaacagcaaggctgagaactgcttcaggctaaccatatggaatagctcgcttccttgcctcatggtaactgggagccctagtggtagggggaaagatataatgttccccactaggaggacaaaacttttgcttttgggtagaagtgggctccatctgaacctctggccacttagcagcttaaattggatgccatctccactcaccaaggaagaatataagcctcactctaactgtattaaactctttccaagtatacaaggaagaactttttcccagggccatttgaaagtaaggtgatctgatgccccatcacacgcatgtttatttcttacaaagacattctcttaatacccacaacatgaccatcaaaatcacaaaactacgatttgtatatttctaccatctaatcttcagactcatttaagttttgctagaagttccaataatgtcttctatagcaaaaggagtcaactcagaatcacgtgttgcccttagttgttccatctggaacagttcctgtctttccttgactatcccgaccttgacacttttaagaattataccaacaacttgggtttgtctctttcacactggattcaggttacgcatggtgggcaaggaatgctgcccccttcctgggaggcacgtgatgcccacttgtccactgctgaggaggttcacttctgtcacttgatgaagctaatgtctgccaaacttcactgtgaagttgctctttactatcttatgaggcactacttagaaatgtcaataccttgttcctcatcaaactttcagcttactaattatcagtatggattcatactttattttattcagtggattataatccatggctatcattatttattttttgatgtttaatttgttccaaatttggccagcgggaacctcttctagctggctcctgtggccttttgacatgcctctatcatttgagatggagtctcactctgttgcccaggctggagtgcagtggcatgatcttggctcactgcaagctccacctcctgggttcatgccattctcctgcctcagcctcccaaatagctgggactacaggcgcccgccaccacgcccagctaattttttgtacttttagtagagacaggttttcaccgtgttagccaggatggtctcgatctcttgacctcgtgatccgcccgcctcggcctcccaaagtgctgggattataggtgtgagccactgcgcccggcctctttgagcatttctttttattttctggaataaaatgttccaggcttgtcttccaggctgtgaataaacccatgaggaagctgctattattaccatccccataatagagatggggaagcctggggacagctcaggaatacacagctagcaatttcttgtggcaagattgtgaacccagaccatagctccagaccctgagctcttttcccccaccccaacttttaagttattatttttgaaacagggtctttgtcacccaggctggagtgcagtggtttgttcatagctcactggaacctcgaaatcctgggctcaagcaatcctgcagcctcggcctcccaaagtgctgggattacaggcatgtgacaccacacgcagcgcaattttctattttaaaataattttagacttacagaaaaattgcaaaaaataatagagttcctacttaaccttcactcagttttccttaatgttaacacctggcagtaccatagcataattattgaaaccaggaaattaacactgatgcagtactatggactaaccagcagaccttatcatgattttgctggctttcctggtaaggtcttttttccaacctaggatctcacattgcacttggtctttccttgtccccatgacctgccacttttgaacaaggcaactctattcatttgtagactgccctcagtttgggtttgcctactgcttgctcctggttagactgaggtgatgcaagaataccagagggaaaatcaggcccctcttagtgcatcatcaagagacaatgacttatggccaggcccagtggctcatgcctgtaattccagcacttttggaggctgggacaggcagataacttaatgtcaggagttcgagaccagcttggctaacctggtgaaatcccatctctactaaaaatacaaaaattggctgggtgtggtggtgagcgcctgtaatcccagctactcgggaggttgaggcgggagaatcgcttgaacccaggaggtggaggttgcagtgagctgagatctcaccactgcgctccagcctgggcaacatagagagactccatctcaaaaaagcaaagaaaaaaagagacaatgacttatggctgggcttggtggctcatgcctgtaatcccagtgctttgggaggctgaggcaggagatgtacttgaagccaggagtttgagactcaccagggcaataaagtgagacccccatctctacaaaaaaataacaactagtggggtgtggtggtgcccacctgtagccccagcaccttggaggctgaggcaagaggatcccgtgagcccaggagatggaggctgcagtgagccgtgatcgtgccactgcattccactctagcctccacaacagagtgagatcctcttaaaaaaaaacagagacaatgacttattactggagatgtatactctgattatttggttaaggtagtgtcaatgtctctccaccataaagttactatttctccttttgtaattaataagtatcttgtagagggatagagacaacacaaatgtctttacttttgcccactgatttttgtctccattcttacctgcaacaatgatcactatggtgtttcctcaatggtgacttttttcccacaattcctttgacatcaattggaattttaccataagtgagaactgtcccttcttccccatgtatacatttattcagttatttatttgcatgagtatgactcacgcatattttatgccatggcttatcatccgttacagatttgagcattgggtgctccttctagttggttcttgtgtcctttagacaagcccttccctttttcacttccttactttatggtaccacagaatattccaagctcatctattattttccctgtttcagggaattgtcccaggggaaatgtcatgtcccctactaggaggaccaaacctttgctcttgggtcgaagtggcttctatctgagcttagtttagaaaatggagcccatcttccctcaccaagggagaacacaggcctcacactaatggtattaaactatttacaagtacagaataaagaactttttcccagaatggtatttagaaaccaagatctggacactgtatgtgctcattgctattgtagtgtcattgcttccagaccttcccaacagacagggctaggaaatgcatgtgtatgttctgatgctggctctcacacacagatgtgtttattttggtatctatctgtatgtatattaaaaccatgacttcatactacctccaactccaatccaacacaggcttcattccagctgtactaccttcctcatctgtagctttttccaacagtaagaagctggcagagtctgagcacttaaacctgccagaagagggggtacagaggatggtgctttgccttaaaggacaagattttcacaggcacaagcgaaggtcattcccatggagagaacagcatgcctgaaggctagcaggcaaaggatgtgaggggtaaacctaaaacagggaaggaacagatctcaaggggcctgagtcaaacacaacatgtggctcacgtaggtggttttaccagcatcacatcaattgtttcatgtcacgaggcagtggagaaccacttgacactttggagtaggaggtgtcagaaccaatcttatctgggctttagatccacgagcaaatagattgggtggccagggaatggagctgtggtcatagctatggtggcagtggctgtgctggaaaagaacggaccagtgggaaaggtactacagaagaaccacacaacctggtgactgacagagtgggagagacagggaagaggaaagcgtcgatggataaggctctaacctgggaggcagggagccagtggtgccatgaacagagcactgtgggaagaactggtctggagggtgccctaatatggagttctccgtgcaaattctgctttccctttgagggccagtgcaagcataactgccttgtgaccacaaagcctcacaaaacgccttggcagacaggcctcagtactctcctcactcctacctcatctcctcagtcctggggctgccctcaccccccacaaaccccaactgcctacaacacactgctctggtcaccatctttctatggctggccacccatctcccaggacacagctaacaatcctccatgtgccagctcaacccaccttttttgttcatctcacacaatgaccacagaccactgacctttccctgctgactgggcattgggtccctgccttcctctccagacccactggtcccaggtgcttctttgggctctcacatctgcatagaatgccttccccatccctggataacctctggatccttgcaagtcggcctgccccacctgtcgggccagatgactaacgcctcggcccccacaactctgtactaaaatggctcatctgtctttctcccttgacgtgtgtatttgttagggcaaggatataacttgttgaccattggccccaaacacacggcaccatcctggaaacactgtaggttctcaaacacttaagaaagtaaagagcagacattctccaaaccctaattcctcactgctcttctgcctattcctctagggcctggctaagctcacagcctctctgcctctccctgccttccccatcctgacttgtctgaaggcgtgagcttgcatcattgctggtgtccaccagccttagccctggctgaatggggtgagcagaggtgctcaaataggcctgtccagggtccgggggcaaagaaggtagcctggttctacttcccctggtggactgcagcaggggaggtaacaggcgagggaattatgctacagggtgagagcccagcctcctgaggctttttgtgccacgttggcgggccaaccactgaaaccttcatgccgctaagctagagccagtgccttgctgcattctctctggtcctttctctgaaagtccccagggatggaagaacaaacgatagcacagagagccacaagaaaacagagccacacactgggccttgtccataattattactataatgatttacaaaagtttttttcaggcaaccgtgttaaattattgtacatatctgagagagggaggtggggccctggccacagcaaaagtgacgacctctttcttgggtgaggtaagaaaatgtcccccacccccttttaggtctgactccttattaagtggcttcccctcaataaatgatgagcatcaaccctttcccacccagggtgccgagggtagagggaggagcaagtggatgaagtgctctgaaaaggatagtgcagcggctctagccaccgtgcatcctctgccctggctctgaagggcctgaccctgggctgcacccccttgctggggatggaagaccattcagtactcagccctacaccagggcatctacccaggaagataggaggacagagtgtgaaaggggctgtgtcaccctgtcaggtcacgaacaggaggtggcaatggatgcagtgacacaccagtgggagctgctggctgccccttgcagcccactccccaaactggctacccaggcatccaggcattctggccctggagctcagggaggcagccctgagagtcggagcagggaaccacaggcctagctggccctgccagggggatacccacaacagcctgacatggcgctcaattcccacacgccagctcaaggctcctgtccatgcagctcaatgttacttgtgtgtgcatgtcctgtgtagaggggaaggctgcaggggggcactgctgtgccacccacccaggggttcagggcatgcaggggaccctaagcctagtatacgagccaagaccaaaaagggttaaaggctctgtctcccctccctccccctctcccaacatgccccgccctccttgggcactagaaagttttgcgatgaatagcacgggagccatcctcttcatactcctttttggacacccacatcttcttaaaagtgtccagcgaggccaggatggagccgctgtggggatggagggatagtattgctgtggacctgtcagggagccaaccaccttcctgggtgctcagagttgcatttccctaatttgggagggaaatccacccacctccacgtggcctaggccaacaatgggaggagcatccagggtaaagtggtctcctcccagagccctcccttgagccccgcctcacccaatccatgtggagtacagccgttcctgcggggctgagatctagaaggaggaagtggccacgttaactgtggatccccacccagaagccatcctcccagccttggggtcaccttccccaggtcctgaagcctgacagcaaaggcataagctggggagtggcagcagcagccttgggaagaacaggactaggtggacgtgagctggtgagcgggtctgggggcagcattcaaccttcctccccatgccaaggctgccagcgccctagtgccccagggggagtttctgtaacctcaccttgattttgatatcctttggggcaagcttcttcacttcactgagtaatcggtctccgaagcctgtgaacacaaagctggctgagcctggggtctgcacccggcctcctcgctgctagctcccgcacccagccttcagggcccccagctactgctggtcctctatcagcagctcttcccaggatgaagggcaaggctgagaaatgatccagccccatggctgcctgcgggccctgcgtcctcacagaggcagcgtgagatgaagccgcacatgctccttgctcgactctcacaatacactttagagcttgtgtaaacttctcctctattcacagagtaaacaaaatttaattttaaattttggtctgt

SEQ ID NO: 148 - DNA, 134304 bp, Homo sapiens
atcatttaaaaaaagaaaatggctgtctctttagaactatcaatttatccatttattgggtacagtctcttggggacatggaagtgctagaagtaatccaggagagctggctgtgaaaaagttcactgtgaggagacattgtacacatagcaatctggatgtgtctcagatgcagggctcagagtgatggaggccatactgaaaaggccacatgctgagtgacatatgtatttatgggacatcctggaagagacagactacagaaacagagatcagtgggtgctggggatcaggggggcaggggttgagtacaaaagtacactggggaaatttccagatgatggaaatattctgtttttttttttttttttgaaatggagtctcgctctgttgcccaggcaacctccgcctctcgggttcaagtgattctcctacctcaggctcccaagtagctgggactacaggcatgtgccaccatgcctggctaatttttgtatttttagtagagacaggtttcaccatgttgaccaggctggtctcaaactcctgacctccggtgatccacccgcctcagcctccaaagtgctgagattacaggtgtgagccattgcgcctggccgaagtattctgtatcttgatggcaatggtagttacccaactatggatttgttaagacttgcagagttctacattaaggaggtgtatgtacaccactcctcaatttttttatttttatttatttatttttttgagatgggtgcctcactctctcccaggctggagtgcaatggcacgatctcggctcactgcaacctctgcctcccaggttcaagcgattctcatgccttagcctcctgagtagctgagattacaggcacacaccaccatgcctggctaatttttgtatttttagtagagatgggggtttctccatgttggccagcctggtcttgaactcccgacctcaagtgatccgcccacctcagcctcccaaagtgctgagattacaggtgtgagccaccgcacctggccaccttaattttttttaatggggaaaaatatgtttgtaaaaaaagtcttgatgcacattttacaagaagaaagagacgctgtgagagccaaatagtgagctgagtgatgctggtgttgattccctccagagacagtggtgtctagaagttggctcttcctttagtcagttgtggcattgctgttatcaattttgtagcaagggtggtctaggatgcaggacttcttatagcccactggcaacggcagaggtgatctggggtgttactgattaaatgtagtcttttaggaaagcagagatcaagagcagggagcaggcagacctaagttggactctggcccccagccccctaacttccagctcgtccaagtcacctccttctctaagactcagttttcttgcgtgcaaagtgcaggtgaaagcagttgtattgctttggggattcagtgagctatagtggctcttagcacagtgtttggtacttagcaagtgctcagcaaatggcaatagctgctgaagtgacagtgtcatcacatgttaacatccctatgatgggtcgtgtgggagtaatcactgtttttctttgattctgcttagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggtaaagcagccatggtgaggtggtaagaccccaataccatggcataccctccccgaccccaccgggctcacctgaaccatcccaggcagtgaagatacaggagctccgagttgaatgatctttgcttccatcgtctcagaaagagccagctcttcatgactcagtttccatctcttgctcttgctgtgcctgtgtcacaggcagatggctcaggtgtgactgcacagcccaggcagtggaatgcttggccttagaaagccagggcaggttaggcctatctgatgggtatttgaattatgtaaatttgaaacagtgctgtatcagctaataaatctctctctagagaacccgtaatatcacagctagagggccagatccactgtgagctgagtttctgtgttgtctcccagtgctgtcacttcagctgataaacagaaacacccgctgttccttatcacgtgaaccttggattgtgttagttttgaaattacttgagatcttcaggagcataatgcaatcatcatctacttttctttttttctctttttttttgagacggagtcttgctctgtgcaacttccgcctcccaggttcaagcgattctcctgcctcagcctcccgagtaactgggattataggcacgtgccaccatgcccagctaatttttgtatttttaatggagatggagtttcaccatgttgttcaggctggtcttgaactcctgactttgtgatccgcccgcctcggcctcccaaagtgctgggattacaggcgtgagccaccatctctctcttttttttttttttttttttttttgagacagggtctcgctttgtcacccagggtggaatgcagtggtgtggtcatagctcactgcagtctcaacctcctgggctcatgtgatcctcccacttcagcctcctgtgtagctgggaccacaggcacagccaccatgcccagctcctcatatcatttttttgggcacacgtgcatgtttggttgtctgccttgtttcctccaatccctttcattgttttccacggttcaaaataaaatgaaatcttccactgtggtttcctgacttattttccccatgataggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtaccttctttaaagttttcctcagtgtgtgggaacatcctgatcttcataagaactcaatcctaaacagataaaccagattcagaagcactggcatgaacttgaacttttttttttttttgagatggagtctcgctctgtcacccaggctggagtgtagtggcgaaatcttggcgcactgcaacccctgcctcctgggttcaagtggttctcctgcctcagcttcccaagtagctgggactacaggcatgtgccaccacacctggctaatttttgtatttttagtagatacagggttttaccatgttggccagactggtctcaaactcctgacctcaggtgatccacctaccctggccccacaaagtgctgggattacaggcgtgagccaccatgcccatccaatttgaagcttgaaatattaatgtgagaaggccaggcatggtggctcacacctgtaatcccggtacttttggaggccgaagtgtgggggatcacttgaggccaggagttcgacaccagcgtgtgcaacatagaactctgtatgtacaaaaaaataaaaaattaatcgggtgtgatggtgcatacctgtagtctcagctgcttgggaagctgaggcatgggaggatggcttgagctgaggaagtcgaggctgcagtgagccatgatcgtgccacgatactccagcctgggtgacagagcttgactctgttttttttagaagaggacatgacagtcatggtcacgctccttttccttctcaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggtacgtcgcctgggctgccacccacttgcctggccctgttgttgtcggccccacagggaacacgggctgtctgctggcgtctctgactggaatatgctccccactcaggttgcctcttcagatgccaccaacattgaggcttccatcagagaggaggacagcttctatgtcataaacggtcacaaatggtggatcacaggtatttggcctaaaatgcactttccaaatgcacatcagggagtctgtgctgttaggcgcgtctctcaatgcctgggaggagcctctgctttttcaagttgacacaaaggagattctgtcacttagcgcccccagcagaggcagctgggagaataggagggtaatccgtggagcacactgttctcagaggtggcacttcacagggcagggacgtcccccggtgcccacacatggacggatgcctccctgcacatgtgaccccaggaatctctccacttcctgctgttcattctgctttgggcagctccccttccttggtggcttcctggctcctcgatcaggtgtgttacatcctaagggctaatgacaatcctgacttttagggattgtccagtgttacttttgcagggcccctacaagtagccgtggagcttacctcccggagcccatacctccctggacattaagaatgagcatccccattttgcaaaggaggaaaccgcactcagacttaggtcccttgcctggggtatgagcccccagccagcaagtagagaacccagagtcaaaggttcacctgattccaaggcccgggcccagagccgttatgtgtgcaccacctgtgggagccgagccagctggcagggatcaagtagcggttttcatcctcttgtctctaaattatattttctactctatgtgatgcttttaaaaacttgctcttatgatgttggattcattcctcactgggacaaaacccaatttgctcttatttctggtcagcagtctgcagatgctcatctgattacatggagccttaaagagctctgtctgcttccttactgtgcctttcttgggccaggaccacgtgtgtagagatttgatggccctggtgtcagatgatggggtctgtctctctcctttcctggcaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtgagacctccaggggcgggtcacccctgggtgtgggtctggtccccaggaaacaccactgaggggcccctgctcttgttcaggacttgccacatcccacgtctgagggtatgatgacatttggagtcacatgctcctgcatttcatttccatacatgaatatcaaccatgcaggcggatttcagacaggcatttatggatttttttccctcttctaaacttagaaagtaatcaggagtctgtgacacaggaagccatacagggcagacgcaggaagtggaccccaaacctactcttccaggccccagtgtgaacagctgacctctaggccacagccctggtttggtccgctcccagtttggttctctgctaatagtgttcacatttttactttcagtgttttcataggatcactacattgtcacaaaccactaggagcttcagcttaaggtggcattattatgtttttataaaaggaatcacagaatagtcatttgccattataaatcagtgattcattttctgtgtttaacaggctgtttcctgccgtccttttccctttaaccatgtcccagtaagaaggctaaataaagggcagggacattgccagcagataacccagactgaggtgaggaataaacacatccaaggaaaatgactatggctattgctcacagtgatcgtttgggtctttcaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgagtgctttcccccgcacccagcactgactcagaaccaccaccttctgctttgctgtcggacttcaattcctacctgttttctgagtgcagtcctagcaggtgaagcaaggtgatgtccttgccaagaagttgcattcctgtctgctttgcatctgctactttgctgcagtttggattcagagcagaatggaccccactctgtcgaggtgacctgaagggaaacgccaggctctgtagcagcagaggcaaggttccaaggtgtaaaggtcatgctgctagcacattattaaaaatcagtctgggtgcaatggctcacagctataatcccagtactttgggaggtctaggtaggagggttgcttgaagccaagcatttgagaccagcctaggcgaaaaagagagactcagtctctacaaaaaaaaaaaaaattttttttttttttttgagatggagtcttgctctgtcaccaggctggagttcagtggtgtgatctcggctcactgcaacctccacctcccgggttcaagcaattctcctgccttagcctcccaagtagttgggactacaggcacgtgccaccacgcccagctaatttttgtatttttagtagagacagggtttcaccatgttggccaggaaggtctcgatcccttgacctcgtgatctgcccgcctcgggctcccaaaatgctgggattacaggtgtgagccaccgtgcccggcaaaaaaaagaaaaagttttttttgttttttttttttttgagacggaatctcactctgttgcctaggctggagtgcagtggcgcgatcttggctcactgcaacctctgcctactgggttcacaccattctcttgcctcagcctcccgagtagctgggactacaggcacccgccaccatgcctggctaattttttgtatttttagtagagatggggtttcaccatgttagccaggatggtttcgatctcaccgtgttagccaggatggtctcgatctcctgacctcatgatccgcccacctcagcctcccaatgtgctgggattaccggcgtgagccaccgtgcctggccaaaaagaaaaagttttaagtgccaggcatggtagcatgtgtctctagtcccagctactcaggaggctgaggcagaaggatcgcttgagcccaggagtttagggctgcagtgagcagtgatcacaccactgcactccagcctgggtgacagagtgagaccctgtctctttaaaaataaataaataaataaaaatcagacaccagggagatcccatgttgcttgtttttgtccctaggcttccatcatctggcctgtaccaccctcctccacagcacatccagaaaactttattcggccataatcctaccacccccaaagtttggaaacctaggttaaaagacagctgcttccaggacaggaattcaaattggtgattatcaatttcagaaaggtgacgcaaaccctgagaccaaaaccagtgtctcacaagaactgctattgaaagaacagaggcagtctgaattttttattaccgagcaaacctgtgatttacacccttttgagttaagactgaccagttattttttctttctaagtaaaacgctcctgtctatggactcaggtatggtgcttcagccccacatggaattaaattcagccttctggcagaataattggactgaatgagtcagacagaagtctccagaaagtgcatagcatgaacatggcacctccactgaagacttggttggagtaattaggaatctacaaaagatttgctacaaggaggttcaccacagtgcttattgaaatagcaaaattctgaacaacctataaggctaacaatgactgttggccaaataaaacacaagatggcatacagtgagactttaaatgatgctgtggaaatctattccttaacatggagaaattgctcactatatacacttaaatttaaaaaaaaagactgtggccaggtgtggtgacactcccagcactctgagaggccgaggcaggcagattgcttgagcccaggaatttgaaactagcctgggcaatacggcaaaacctcatctctataaaaaataaggctgggcgcggtggctaacgcctgtaatctcagcactttgggaggctgaggtgggcggatcacttcaggttaggagtttaagaccagcctcgccaacatggtgataccccgtctctactaaaaatacagaagttagctgggcatggtggcacatgcctgtaatcccagctacttgggaggctgaggcaggaggatcacttgaatccaggaggcggaggttgcactgagctgagattgcaccactgcactctagccggagtgacaaagcaagactccatctcaaaaaaaaaaattaaaattaaaaaattaaaaatagtagccaggtggggctgggtgtggtggctcatacctgtaattccagcactttgggaggccgaggtgggcagatcacctgaggtcgggagttcgagtccagcctgaccaacatagagaaaccctgtctctactaaaaatataaaattagttggacgtggtggcgcatgcctgtaatcccagctacttgggaggctgaggcaggagaatcgcctgaacccgggaggtggaggttgcggtgagccgagatcgcaccattgcactccagcctgggcaacaagagcgatactctgtctcaaaaaaaaaaaaaaaaagtagccaggtgtggtggcacacatttatagtcctagctactcaggaggctgaggtgggaggatctcctgagcctgggaggtcgaggctgcagcgacctgtgagtgtgccattgcactgcagcctgggtaacagagcaacaccctgtctgggaaaaaaaaaaacaaacaaaaacaggctgttagctttgatgcaaaataatgttttgttgttgttgttgttgttgttgttattgttttaagcaggctggccgggtgctgtggttcatgcctgtaatcccagcactttgagaggccaaggcaggcagatcacctgaggtcaggagttcaagaccagtcaggccaaaattatgaaacaccccatctctattaaaaaaatacaaaaattagccaggtgtggtggcaggcacctgtaatctcagctacttgggaggctgaagcaggagaatcacttgaaccccgggaggcagaggttgcagtgagccgagatcgcgccactgcactccagcctgggcaacaaaagcgaaactctgtctcaaacaaacaaaaaggctacaaaaccatatatagagtgtggctcccgtttttggaaaaaataagtatatataaaaaaactatagaaggatagaggagaatatccaccaaatattaactagtggtgactagatggtgggattctaggtgctcttactgtcttctctttttttgttctgaaaacaggtagtttttctgccatgagataaattatttgtgtagattgtttttagtgaaaaaaaaaaaaaaaaactaggctgggtgtggtggttcatgcctgtaatcccaacacttggggagaccaaggcaggaggattgcctgagtctaagagtttgagaccagtctgggcaatgtagtgagaccctgtctctacaaaaaattggaaagttagctagatgtggtggttcttgcctgtggtcccagctactcaggtggctgaggtaggaagattgcttgagcccgggaggcggaggttgcagtgagccaagatcacgccactgcactccagcctgcgcaacaaagtgagaccccgtctccaaaaaaataataaaaaaaagaaggaaaaagaataaataaaacaagaaaaaaaaaggaatacttagaaccttttctgatgccttgtgactttcagaatttaaaatcccccttgcagataaggccacccacggcggaaggccgggagcgagacggggctgaggggaccttgctcccattggagctgcagggcaggaaggggtgctgcggtcagcagagggcacccttcgcctgcgccgtgtgcagtgcctgcagtcactccctcattcccaggagtagccttgggtcagatgctggctcagatctataactgctcctgtctggtagccaggcctgcccagatgtgcaatggctggaataaagggttcttggaagcaatttgttacaggcaccctgtgggctgtggctggctgtggcacacgtgaaggttgtgtgtcagacctactccctggacatggcgcatggctgcacacaggcaccttggctgagaagatgcacagtcctggtttcactctcctcccctgccctgtcctgtctgcttccacccagctctgcaggccaccagcccccgcctctcgtggccacccccagcccagcatgtcctcagccgcacatctcctgtgtcgacaggtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggtaggggcaggggcacgagggggcctcccagaggcagagattcttcctcctcactcagcaaagcatgagagcctggcttcttgacattagaaactttatttcacctctacttggagctgtttgggcagtttttcaaaaattggaaaggcacaagaagagaggactggcctttgtgttttactgacctggtgagctgcttagtccaaggcagtgggtctgatggggccacagggcccctgggtggccctggactcccagggccattggtggaggtgttgggcaacctaagagtaaggcagggaaaagggaccctctgctggccttcatctgaatattgaattaacaaaaatagaagcttattttcaagtgtgacattagtcattcactaaggctctttttaaccttttatttatttattttttgagacagggccttgctctgtagccaggctagaatgcagtggtacatcatggctcactgaagcctcagcctcccaagtagctgggactccaggcgcaaacctccatgcccagctaattctttattttttgtagagaccggctctcaccatgttgcccaggctaactaaggctctttctaagtgcctgtgatgaccaagcacaatgccatgttgaccttgctttgtccagctttctgtggggcagcctccaaccccacccaagaccctcaaccatcagggaccaacccatgctcatgctcacagttcctggttctttgacgctggcgtgctagatatggtggaggctgctgggtgtctcccttgaacaccctgccccagggcagatcactgtagctcggtttcccagagccctgagtggccttggtccactgctgcttggaggcagagctggccgtgaccctgagcaaagcacaggaccctccccttatcccttcagtgtgtgctggctgtgttccccgtcatctgggaagacagccacattctgccagcacttgcttcgcatcttgtgacataagataatagttgccaacatggcgcccttcatccctgggtgctgtcaagccgtacaccaggcaggggcagcctcacccagctcacatcagcgagaccttggggcctctgttttggacggtggtgtttgacttcttgctgggaatctgatcattcttccaggctttctgccttcgggtcttttttgtggtttagtttttcgttttgtttttgagagacagagtctcactcggtggcccaggctggagtagagtggcacaatcttggctcactgcaacctccgcctcccgggttcaagcagctctcttgcctcagtttcccaagtagctgggactacaggtgtgcaccatcacgcccagctaatttttgtattttttagtagagactgggtttcactatatgttggccaggttggtctcaaactcctgacctcaggtgatctgcccgcctcggcctcccaaagtgctggaatcacaggcctgaaccaccgcgcctggcctgttgtttgtttttgagagggggtctcactctgttgtccaggcttgagtgcagtgttgcaatctcagcttaccacagcccccaacttcccagactcaaacaatcctctcacctcagcctcctgagtagctgggactacaagcacatgctaccacaccctgctagtttttgtatttttagtagagatgggggacgggggggcctcactctgccacccaggctgccctcgggtcttttatgatcgcatctcctcctccttacaggctgcagccttggatatagccatgattaaaatggtcgccccgtccatggcctcccgagtgattgatcgtgcgattcaggtgagcacagaccagacagttggcttatttgaaccatcaatactagatgccaaactctcctatcttcagccgcccagcctcccatagaccctggcagatgccctgtgtcacccactcaccatgcatgcaactttccttttcctcttcagaatgacccagcaaggtgggaggtgccatcgtacccccattttgaatgtgaggaaacaggcacagaaaagtgaagtgacttgtccaggtcactgagcttgcaagtagctgacctcaaattcacatgaacttgggttttcataagcccagagcccaggctctttcccatgcaggggggccgcctccttagatcctaacccccggccccagcacagggcagaaggcacctgcagagtgggcctggggagtctggaggccgtgggatggcaggtgtggccccatggaagccctctggaatattagtgattgtatcacataggtgccacagggaagtccgggaagatggttgttatgggccatcaagagcaggctatcattcctggggctctcggagacaagggctgacccagggccgcctccctccactctgtgtctgccaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacatctcggaggctttgtggactttctgtgtcatacaaagagaatcgagtggagaggttcccttcagcgccttcatgcctcctcctgcctgtgtttcctcgaggtccaggccatcatctcagccccatacatgctgggagcacagaggccacgggtccgataagtcccgagttggctgccttccctcactatgtagcccggggctctgtgctcatacatactttacccaggagctggcatgtgaggcccctgcagcctccacctgctccatagtcagaatatctgggcgaaggggaggtggtggcccattcgccattacactttggagcacaatctctcttctctgaggagagtggaaatgcttactcacttgcagtctgagctccttgagaaacccagcgacatgcagaggtgagccaggggcagtgaggccccagcctgctcgtctcataactcgtggtggggtagccaaaactcgtctcaggttagaccagacgggcaggaaccatcccccccggctgccaccttgcagaggtgaccctgtgggaactgccttccctgagaatggccagccaggatcagcaccatgaggggcccgtgaatgggctcctcagacccacatgcccaggggtctggggaggcaggtcccccttcaccacacttgagaaactgcttgttgctcaaggaagttaaaccccaaacaaatgcctgtcacaatgacagccacactggccaggagcccactgctaagctggcaggagcgcagcagctgagtgctccctcaggctccgggaggagaggttttcttcaaaaaaaaggaagtggtcgtggcctggcctgtctcatgggcctaagaatgtctttcgtggcctctgaggttaaccttgcctgttcagtaacgcagctgctgagaggaaaatgggagtcaggctgtgggtacccccatatctccctcagatcctctgccttgagggctagagaccccgggggccccaggaatgctgcctgcagacaggcaggtcccccccaggccctccacctctgctagatcattctgcccaccactgtcgagggagcctcagctctgggcccagcaggagtccaggccttggggaatgtgcaagtaaacaaaacaggacaactgctggcctttgggggtttgcatctcaagtaggggatggcggttagtgccccagaggcctgggcgtgtgatggggcaagcactgctggggctggaggctgaggggaggactctttccagaagaggtgtctcagccaaacctgcctgacaagaagaaagggcaggctgggcgccgcgggtcacacacataatgccagcacttcgggaggccagatggtgtctggatgccaagacctgtgctcgccaaggcctgatttcagataccgtcagatcattccacaacaatcctacagaggctgcaaagagacacttccaggcaacttgtctgggcagggccccttcaagacggcagctgggagtgacaccgaaagaacaggctccagtgatctctgctgcttgtacccattgtcagtcccccagggttgtcggtcaccacccagggcttcagagttccccagggatgcctcgggcgtgccaaggctgtcactcagagacccctcttgttggtatttctgctgccctccctgctgcgacataggtacagatttctccccttcgtccattttaccaaaatggatgcgcgttgggacaggtgagtcccggactccagcggcctggggcccacacctgcaagtaacctgggacagggtttcttttaatcaagttgactgagtggagaaatggcccaggggattttctgtcctatcagtgttagacggatgacacagtggtgaagagctgtcagaggtaaaggcggacactaaagtggtagggacaggttttatttatttttctgagacagagtctcactctgttgcccaggctggagtgcattggtgccatcttggctcactgcaacctccacctcctgggtttaagcagttctcctacctcagccttccgagtagctgggattacaagcatgcaccaccatgcctggctaatttttgtatttttagtagagacagggttttgccatgttgaccaggctggtcttgaactcccgatttcaagtgatctgcctgcttcaacctcccaaagtgctgggattataggcgtgagccaccgtgcccagcagggacaggttttaatcagtcataagccattgctttagagagcagggcccagcgggaactgagctccacttggatttgtgcggaggtgatgggaggggtggtggttgggaggggggctcaagagtcaggaaggggaaccagagagagcaggaaggagtgtggttggcgtgacacctgtctgggtttgctaactggcgcttagggttaggctcctgccctcccttggaggctgggggacagggtccatcttctagtgttgctggaacaaacagtaatttctttcagcagctttgggctttctcaggcaggtacgggcatcccacagatgtggtcttgagatgttggacaccatgtaacttaagtcttttcatgggagtatgggggtgtggacttaagcatttgtgctgaaagtctgcagttttaatatgccaagtttgaggtctagtggagatgggagttcagaggaaggctggcgagagcgtgctcaaggagagaatttttgtcaggactgtggctctagattcaaatggcccaaattcaaatgggtttaaatcctgactctgtgacagagtagctgggcaacctttggaaatgttccttcatcttagagacttagatctctcgttttatttatttatttatttaaattttttttaagagacagaggtctcaccatgttggccaggctggtctcaaactcctgagctcaagcaatcctcctacctcagcatcccaaagtgctgggattataagcatgcgccaccacacccggccagatttctcatttgaaaaatgagtagaccagtccttgcttcccagaatcacctgaggattaaatgggatgatgtgtggcttaccataagccacagcacacaccagctgttcgtgtgtggctggagtcaggagcgggacccgctaaagaggaggcggctgtgctcacattggagtgcaagaatgtggggcctcatctgggctgaggactagcctggaccacataagatgccatgcttctcacactcaactagcaaaggaatgcccctgcgatcaggttaaaatgcagagcgtggtgcggtgggcctgccttcctaacacacttgcaggtcatgctccttgttttgggacccactttgagaagcgagggtgagaagggcttgacttccctaacctgatccccaggggaggcagaatgagcagacaccgcctggctagaatcataagagctactgggtatttagtacataccaggtgccaagaactatctgtatattattattattattgttttttgagacagagtctcactctgttgtgcaggctggagtgcagtggtacgatctcagctcactgcagcctctgcctcccgggttcaagtgattttccagtctcagcttcctgagtagctgggactacaggcacgcaccaccacacctggctaatttttgtaattttagtagagacggtttcaccatgttggccaggcttgtcttgaactcctgacaggtgattgacccacctcagcctcctaaagtgctgggattacaggcatggccactgcgcctggccagttattttgaaccctataacaattggcagatccttttattctgcccctgctagagatgaggagacagaggttcaaaggaattgtgcaacttgcttaagatcacacagcttgtcagtgaattcaaacctaaattcagaagatcccagagctctttctactccatggcatggatcgttaagatcacctctgtgaggtactggcctcctcacctaggaaaggaggaagatgatgaggctcatgtcaccaaggagagcgtgctgtgccctcaagaagtgcatgagcttctgatgcttccagaataatctccgggatgcccccccgactgcctcttagggggtcaggctccatgatgggggtgtctgccctgtggccctggctgcctgtggagtgtcaagccagctgtgtgtccgagagagagagagattgtgtgtgtgtgtgtgtgtgtgtgtgtgtatgtgtgtgtgtgtacatatgcaaacaaggagggcagagctggggctcagggctgaccatatttttcctcctacctgtgagggcagatgtcttactgtgttttgttttgttttgcttttgagacggagttttgctcttgttgcccaggctggagtgcaatggcattatctcagctcaccgcaacctccgcctctcgggttaaagcgattctccttcctcagcctcccaagtagctgagattacaggcatgcaccactacacctggctaattttgtatttttagtagagatggggtttctccatgttggtcaggctggtctagaactcccaacttcagatgatccgcccgcctcggcctcaaagtgttggattataggctgagccactgcccccagccagatgtcttcctgttaaaatggggctttaaattcctcacctaacatcattgtttgcaacaacagcaacaaagagcttccatagacagagtcagtgtcccagaacggggactaaacaaccaaacatctagaatctcaccagtcagtgaccctgaaggagacctcagtcacaacctttgttggagagcaagtggaactagggttttttaaagcctgaaagcacatcagttgtgccctaacaatgaaaggtttcagagtagttgaaagctaggaatttgaatatcttagaggaagttaagtggcttgaggtgcttccaccgaaggtctcagcaccatgagaatgcctgtgcttctgccggccccattcctgccagtgagcccacagacaaggggcgatgaagaaccaggaaacagatggaaagaaacgtggaagagaggaaagcctcagactgtcagggtgaaatctaggttgagagttaagttttagttcattctttggagagactgagccacaaggagccataattacaatagcgtttcagcacatccaggtgatcttggtctgcagtatttggttgaggactgtgtgaaagcagctgaggccaaatgtggtggctcacacctgtaatctcagcattttgggaggctgacttgggtggatcacttgaggccaggagtttgagaccagcctggctaatatggtgaaaccctgtctccactaaaaatacaaacattaaccaggcatggtagtgcatgcctgtaatcccagctacttgggaagcttgaggcaggagaatcgcttgaacccaggaggcagaggttgcagtgaactgagatggtaccactgcactgcagcttgggcaacagagagagactccgtctcaaaaaaaaaaaaaaaaaaaaaaaaagcagctaaggaaggctactatggtcacaaaagacttcccagaagatgggacttgggctggatcttgatagggaagatttccataaggagagagggcaggacatgggtggaacaggtgcaccaacagtagggcaccagggatgagagagctgctggttaggattatggtgagcaccacagaccacagacaaaccagaataaacgaacctgtggaccagcgtgtcctgcactgagacacacaccacgcacaccaacagggacgaagcacgttgcccacattgtatcgatgtatgcgaatgtggataagtcagctcattttctccttcccctccccacaaccaagtttactgctgctcctggctcccccatcctggggaatagcacatggtaagaacctcagcacccactccactcctctcgccctcatctccacacagctacctgtcaattccaccttcacactctttctgccaactgagccctcctcatctctctgcctctggcctgcctccccactacaactgagtttccatgcagttctcagaggaatccctcgaaggcacatgtgcaacctcatcacttccaggctgaaagatcttggttaagagaaatattagtacaagctattaagacttaggaggctgccgggcatggtggcacatgcctgtagtctcagcattttgggaggccaaggtgggctgactgcttgagcccaggagttcaagaccagcatgggcaacataaagagaccctatctctacaaaaaaaaaaaaaaaaaattagctggtgccttagtccgttttcatgctgctgataaagacatacctgagactgggcaatttacaaaagaggtttaggccaggtgcggtggctcatgcctgtaatcccagcactttgggaggccaaggcaggtggatcacctgaggtcaggagttcgagactagcctggccaacatgttgaaaccccatctctactaaaaaatacaaaaattagccagtcgtggtggcacgtctgtaatcctagctacttggaaggctgaggaaggagaatcgcttgaatctgggaggcggagtttgcagtgagccaagatagcaccactgcactgcagcctgagtgacagagctagactgtgtctcaaaaaaaaaaaaaaagaaaagaagtttaatggacttatagttccacatagctggggaggcctcacaatcacggcagaaggcaaggaggagcaagtcacgtcttacataaatggccgcaggcagaaaaagagcttgtgcagggaaactcccgtttttaaaaccatcagatctcgtgagactcattcactatcaaaagaacagtgcagtaaagacctgcccccataattcagtcacctcccaccaggttcttcccataacatgtgggaattgtgggagttacaattctagatgagatttgggtagggacgcagtgaaaccatatcagtcaggcatggtggcatgcacctgtaatcacaactactcaggaggctgaggtgggaggatcaattgagcctgggaggtcgaggctgcagcgagttgtgattgtgctactgcactccagcctgggtgacagcgagaccctggtcttggggaaaaaaaacaagaagacttagaaagctacagtgatgaaaacagtgtcatactggcacacgcatacagagatcaatgacacagaatatacagtagttcagaaatagctacttacagttacttagtagtaaaaagatgactggcaggatgtatttgtgccatatatgatagacaaaatgttaattgcctggatacatataaagcacctacaaatcaatttcagaaagaccaacaatccaatagaaaagtgagccagagacatgagcagctagttcatagcagaggaaacatgcatgacttcatctaggcagagatgctcaagctcactcgtaaaagagaagcaaattaatgtggtagtgaaatgccactttttcgtctctcagattagcaaagctaaaaaaaaaatcctgaaacttctactggtgagggtgtaaggaaactcagacatgacaggtagtggggcataaattaaacttctttggagggtaatatatctgtatttaaattgtaaatattctttgttccatttctactaatttctttcttttcttttctttcttttttttttctttttttttttcttttttttttttttttgagacgtagtctcactctatcacccaggctggagttcagtggcacgatctcagctcttggctcactgcaacctctgtctcccagattcaagcaatctcctgcctcaccttctggagtagctgggattacaggcactgcgaccattcctggctaattgtgtgtgtgtgtgtgtgtgtgtgtgtgtgtgtgtgtgtgtgtgtgtgtgtgtgtttagtagagatggggtttcaccatgttggccaggctggtctcgaactcctcacctcaagtgatctacccgcctcagcttcccccccagagtgctgagattacaggcacgagtcatggtgccagcctcatttctattaatttcttaagcaaatcaagagcatacattgtggcattgtttgtagtggcaaaagattggaaacaacctaaatgtccatcataggaaattcatgaaataaaactacctcatgtatccagaggaataccatgaaactgttgaagagaatggggacatagtccttgtgtgctgtgacaaaacgatctccacacacagtattaagggaaaaaaagtacctggcacggtggctcatgcctgtaatcccagaactttgggaggccgaggtgggcggatcacctaaggtcaggagttcgagaccagcttgaccaatatgatgaaaccccatctctactaaaaatacaaaaattaaccaagtgtggtggcatgcgcctgtaatcccagccacttgggaggctgagacaggagaatcgctagaacctgggaggtggaagttgcagtgagcccacatggtgccagcctgggcaacaagagtgaaaccccatctaaaaaaaaaaagcaaggcgccattgggaaggggaagtggggcctgcatggctgaattcagagaaggaagggagtcttggttatcagattatctctgcagctgatctccaaacctatttcccttcttcctggcacaggggccactcatttcccagactcttttgcatggaggcatggttgtgtgattgaaatccagccaggcgagcaggctcagcccacagaaacctcccatgggccacccccatgccttttcttcctctggtttgtgtggaatggtgctgagcccccagggcgactttggtggaatctggtgttgaaatcagagtcccaccgccgggcgcggtggctcacgcctgtaatcccagcactttgggaggccgaggcaggcggatcatgaggtgaggagatcgagaccatcctggctaacacggtgaaaccccgtctctactgaaaatacaaaaaattagccgggcgtggtggcaggcgcctgtggtcccagctactccggaggcggaggcaggagactggtgtgaacccgggaggcagagcttgcagtgagccgagatcgtgccactgcactccagcctaggcgacacagtgagactccgtctcaaaaaaaaaaaaaaaaaaaagaataagcaaatcatgcaaatcatcctgttctaaactctgaaccgctgcttccaagaccgtccctgcccttgccctggccgcctctctccttgttaactgggctccattcattctttccatttctctaacacgtgccaggtggtctcatctcctggcctttgcccttgctgttccctgtcatcattcaggtctcacttgtcatttcctgaccatggtacttataaaagcagtgccgtctgccccatccatgtcacctcgttcatctccttcacctccgaaatgatctcgcttttgggtttacggccggtctcttcacctggagcatcagccgggaaggtcagggtcgccctggctcgggcctgttcacattggggtcaaaggcacacattgggggctcaaccaaggcgagctgcgttcgcggggccgggtctttccgcacaggcggagggcggtggcgggcgcggaggcgtcgcgcgagccagggggcagccacgggccgggggtacctagcgccacccgcttcgcttgcatcagctgcgcgccccatcccgaggaatggtagaggcagccccgcccccggcccgcccccgcctttccattggctgccgcgcggggcggggagcggggtcggctcagtggccctgagaccctagctctgctctcggtccgctcgctgtccgctagcccgctgcgatgttgcgcgctgccgcccgcttcgggccccgcctgggccgccgcctcttgtcagccgccgccacccaggccgtgcctgcccccaaccagcagcccgaggtcttctgcaaccaggtgagcccaccggccgggctcgcgctttgttttccggcccgagtcccccgcaggcccctaggaaggccccgcgccgccgtgggccttagtgtactcatctggggctcgaggggtttgcagaggctgacctggaagcacatctgccccctcctctcctgcaagcattttagccccttcgccgcctctgacagtccccgtcccatttccccgtgacttgggccccctctccgtcttcgcccagcctcggtctgttttccagggccaactctcggggttccgttctccccatggtccttgctttcgggtctccgcagggtccccaccctcacccactcagaagacgcgaccaagtccctctttgcaggaactttcctgtcttttccttagtcatcccctttaccccctgactcatgccctcatccaaggagttcaaaaggaaaaaccaggaaagaggtgatttgcagccacgttctccagttcaccatgggcgaggccacgctcggctgcttccattgctgggagtagggaatcctggaggaccttcggccccagggggccgaccccaaggggtgtctgcggcttccaacgccggcttcgaccaaaccaaggaggagctttccaggataaaactgattcctgtggtccatttattgattgctcaatcagtaatactttggaatattttttgttttgatctttgagtttggttaaagttctagacttcacagaggctgaaattggttatgaaagagtttgttttgtttgtgccagtgcatgttggctgccttctctgacttaagctttttctcctataaatggaaaggcgctctgagggttaggttcacacaggccctcatcaaccagtcacttcatagttaatcacagctcctgtcctgtctgcacagcctttgtgcagcactgttctaagcgtctacctgttttgcaatttaaggtaatttttacaacagcctcagtaggaagggactgtaattctccattttacagatgaagagactgagtcacaaagaggtttagtgactcacctaaagaccaaagtcagtggcatagttggggttcacagctgaacttccaggagtaagcccctaaccagaacattccatggtatgttgtgactctgggtgggaacaaagggaccaccgatcctctgggactattgctgatttgggatgctgtagagctggctcctagccagctgctttcaacagcacacctgctggtctggccctgagtgtggctgcaaatctggatataggtgatgggtaaaggcacatgcgtgtgattttaggggatgttacaaaggtcatttgcaagggaatttttaaaaggataaaataaaatcttttgcataacacaagctaaaaaggcagcagctatggctcccttggcagcctgtgcaagttcatgcttggaagacttgagcatcaaaagatctagcagaggccaggtgcagtagctcatgcctgtaaatcccagcattttgggaggccgaggtgggatgatccgttgagcctaggatttcgagaccagcctgggcaacatagcaagaccctgtctctagtctctactaaaaaagtaaattagttaggtgcggtggcacatgcctgtagtcccagctatatgggaggctgaggtgggatgatcccttgagcctaggatttcgagaccagcctgggcaacatagcaagaccctgtgtctagtctctactaaaaaagtaaattagtcaggtgcggtggcacatgcctgtagtcccagctatatgggaggccgaggtgggaggatcacttgagcctaggagttcgaggctgcagtgagctatgattgggccactacacttagtctgagcaacagaacaagaccctgtctcagaaatgtcctcaaggaacagccatcgccctaggaacccttctggccacaggatctgattaaaatctttatcctttatcacatgcagatgaggcagctgggtccagatatgcacccaggcccataggtaacacatcctgttctccagatttactctgtgggtgtaggctggaggagccgagtcaattccctgtggctgcttttctttatcagactttttgagatcattaaagtaacacatgcccactgtataaaattgcagaggactgacttacaactctctggacatggtcagtcaaggtgattcatgcctgtaattccagcactttgggatgccaaggtgggaagatcgcttgagattagatgtaaggctgcagtgaactatgattgtgccactgcactccagcctgggcaatggagcaagaacccatctcttaaaaaataaataaataaataaacctctctggataccccattttactccctccaagagcactgtgaacaggtgggtgtgtctcttgtagacattttgtttgcatttacaagtgcctgcagcaagagagagagagagagaatgcaagcacaccagacttttttttttttttaacataaatgagatgcaaccacttatattctgaagctcgccgtctcactgaacaatgtacctgggttatcattctgagtacgttcagatctcatttaaccctttccaaggaccacagagcattctactctggtggcgccgtgctggaactggacctcttagagccccctgggctgtttgcagtgtggccttattgctgactcagcagggaagagggatggtgcatacagcagtggactctgcacctcagctgcctcatctgtaaaatggggtaaaatggctgggtgcagtggctcacacctgtaatcccagcattttgcaagactgaagcaggcggatcacgaggtcaggagttcgagactagcctggccaacatagtgaaaccctgtctctactgaaaatacaaaaattagctgggcatggtggcgcgcacctgtaatcccagctacttgggaggctgaggcaggagcatcacttgaacctgggaggcagaggttgcagtgagccgagatcacactactgcattccagcctgggtgacagagcgagactccatctcaaaaaaaaaaaaaaatgtggggggtaaaattccatctgcatcaccgaattgctgtgaggaccaaatggggtgaggcttctgcagccacaggcagtgctggcttcatggccactggtgcctccatattgactgcagccttaagcaggagctgggataacagtgacgctgtggacttgcagtgtcttggtgatcaaactccatttgatatggatgctgttgtatttgcagtttgtttcctgaaggggtgagctagattgtggtaaagtagaatgggagtttggggtgaattaaaacttgcatctttattcttaccctctctttctgtttttgtttttgttttgagacagggtctctcactgttgcccaggctggagtgtagtagtgctcactgcagcctcaacctcccaggctcagtcaacaagttatcctcctacttcagtcttccaagtagctgagactacaggcataccccaccacacctgactaatttttgtattttttattttattttatttatttgagacagactcttgctctgttgcccagggtggagtgcagtggtgtgatcttggctcactctaacctccacctcctgggttcaagcgattctcctgcttgagcctcctgagtagctaggattacaggtgcccaccaccacgcctggctaatttttttgtattcttagtagagatgaggtttcgccatgttggccaggctggctggtcttgaactcctggcctcaggtgatccacctgccctggcctcccaaagtgctgggattaaggcactgcagccagccaattttttataatttttatagagatggggttttgccatgttgcccaggctgggtcttgaacttctaggctcaagcaatcttccctccttggcctcccaaagtgctgggattacagtgtgaagcactgaactaaagagagaactgacaggcaattaaggatggatttcccaaggctaggtgtggtggctcacagctgtaatcccagcactttcagaggctaaggtgggaagattgcttaaccccaggagttcgagaccagcctgggcaacatagcaaaactccatctctacaaaagcttaaaaaaattagctggacatggtggtgagcacctgtagtcacagctacttgggcggctgaggcaggaggattgcttgagccaaggagtttgaggcttcagtgagctttgatcttgccactgcactccatcctgggcaacactgcaagtatacataggcaccatacagaaatgttcattgcaacttcttttatgtcagtaaaagcttaggaaataagccagctcgagctccattgggaaatagatgaacacctatgttacagttataggaggaaataatcctctgcatgtagcagttacaaatcattggctcaacctgtacaaataatgtatctcaaaaacaatatgtcaaggaggaaaaatgtccagcactctacaccatatgaaaccatgaaaactgtacaaaactttatgttgtatgtagatagacagatctccataaaaaatgtgtaagaatgtgctggaaggaaaattctccttggtgtgagggtggttactgcctgagtgggcaggacaggataagggtagtgatgaacgaggactctggcttcatttaaatgtttgatttctttaaaaattggccaggcacggtggctcacgcctgtaatctccgcactttgggaggctgaggcgggcagattgcttgagcacaggagttcgagaccagcctgaccaacatggtgaaaccctgactctgctaaaaatacaaaaattagctaggcctggtagcccacgcttgtaatcccagctactccggaggctgaggcatgagaatcactttaacccgggaggcagaggttgcagtgagccgagatcgcaccactgtactccagcctgggtgacagagtgacacttcgtctgaaaaaaaactccccaaaaaacaaaaaaaacttaataccccatgagcagatattaaaagaaaaaagaaaaaatataatggtcccctgatgtgccacccctgcagataatcactgttaacggtatatctgaagcagaaatttgctttttcttgtttgcctgggagattcttacagaatgagccaaaacctgtgttttggagtgactttgtgctgactgaatctccctattgattgtacaggttgatgacttctttaggagtgtcctttgtttttgtttttgtttttgagatgtagtctcactctgtcgcccgggctggagtgcagtggcacgatcacggctcactgcaacctctgcctcccgggttcaagcgattctcctgcctcagcctcctgagtagctgggattacgggtgccgccaccatgcccagctaattttgtatttttagtagagttggggtttcaccatgttggccaggctagtctcaaactcctgaccttgtgatccacccgccttggcctcccaaagtgctgggattacaggcgtgagccactgcacctggcctcttttttttttggtttttttttttttttttgagacagggtcttgctctgttgcccaggctggagtgcaatggcatgatcataactcactgcaacctcaaactcttgggctgaagcgatcctcctgcgtcagccactagaggcactgggattataggcatgggccacaacatccagctaggagttttaagagcctctatagaaatagatttaggtggccgggcatggcagctcatgccctggcataagagtgaggcctagtgacagagtgagactccgtctcaaaaaaaaaaaacaaaaagaaatagatttaggcaggctgggtgtggtggctcatgcctgtaatcccagcaccttgggaggccgaggcaggcggatcacctcaggtggagaccagcctgaccaatatgatgaaaccccgtctctactaaaaatacaaaaattggccggtgtggtggcatgtacctgtaatcccagctacctgggaggctgagacaggagaaacgcttgaacccaggaggcggaggttgtggtggggcccagtgacaccgcccgcctcagcctcccaaagtgctgggattacaggcatgagccaccgtggccggcccgtgtttttaatcagagaacacaaatgggcattcaatacttcctgcctgcccagaatctgtgggacacacttgagtttcaggtgacagggctataataatgtttgtgctcctgaggtcaagctgagttgagaatttacatgttgtggacatgtgtatgtattccctgctccagtaatcatgattattcatcacctattttccatcaggccctctactgaggacttctacctgcatttcacctttcatcctacccgcaactctataagcctggtagtattgctgtcccgtcttgcgggtgaggaaactgaggctcagggaggtcaagttcacattaagtataactaagggcatgtgtgtgaaggttgggcagggcagaatttgaagcccactttcaaacttataacttaatgtgaacttgacctccctgaataatgatcagaccataagaatgtattaataaacatttaagggacaattgaatagaattttaaaatcagagaggaggagccatgtttgtattgttcacttttgcattcctggcacctagcaccttagcataggatcactgttgggtaaatatttattgaataatgaatggttgccatttacgaaaccatgtttacagttttgtgctccagaagtgaggtaaagggttgcttaatgagaacccagtatttctactcaaaaggaccttattgcaaagtatttggaagtttaaaagagtgggaacatggggacgcatagggagtggtgaaactggctcagggaaagtccattgcagcaagatagaggttgccaaaccgtaagcagaacaagttgaaaccgcgcctgtctggcaaacagtccaaagtggaattgaaactcccatctttgaagtggtgaaaaaaggccctggggtgggggagtggggcagagggctggcgtctgtctgcctgggttagtcttggttcgggagtgtcccgagcaagcctggggagatgactgcccctcgccttgatccccaactaacctggggttctggattatgtgtggggaagagggaatgtgtgtggcattccgtgtttgtcttgaactttactccctggaatcttgtaatacaagcaatggcatctgctttccatcggacataatcacctaaccgcagattagcaagtgaaagagcacatgccgttgggatcatcccaggctgcaaaaccgcgccattagcttgctcactctttgggaaaatacggtgttccagggacggggatttcctaggtaacatgtccagttctctcatgcatcaaagcttgaactgaaatctttctagaatgtatcctgcctccttaaatcagaactactgaacacagtttagcctttcattggagaccctgggcagatgattactgaacacagtttagcctttcattggagaccctgggcagatgataaccacccattgtcatgaggtctgggggtggtggccagaatttcattctctcctggccttggtctgacctccgcccccaaggtccagttgtcctgctctgggcactgaccctgccccagctcctgagcccctcgaccaccacaatcaccactaagtctctgcctggcatggagaacaagatagccaaggtgaagagggatcctgttaccctctaactcagtagttctaatttctacacagtaatctgccccatgtttggaaaaacgcatgtgaaagggttcgccacagctgttgctggaatggcgatcacttgtcctaaaagtgcatttgtaggaaatcgttaaataaaccatggcctgaccgtgttgaggaacgctatgtggcttaacatgaggcagagctgcctgtggaataacgtccaagagaaactgagaaaagcgagttagcaaacagcaagtctattacccccacttagaaaggacacggcagtgtcccggttctctggtctcctgggtcctcccagcatcaagtgcagatcctggcacacagcaggtagaatcgcgagccccccgctctcccctcacctacaccctgcagccactcctcctgtccccaggctcttcctagcagtcacccttcagacccctcagctggccaagcctcctcctgcttctcacttgcttggttttgcttgtttcctgcgccctctcctcaccaggacttcagctcccacaagccaggacttggctcttggactccctgtgctggagtggccagggctgtcagtgaaagcttatggaatgcgtgggtgaatgaatccaatttttacaaaacaaagtgagatgtatttattaaaatatgtaggaattagagtattttgatagaaaatctttatgttttgcctacagtctagattgaaaatgtcaactccagacatcactgtgcttctggaaactataaagaggaagtgggagctaggacatccccccaccacgccccgcccaagagcgtttacgtgtgttatgtaagtcgagcttcgggtttctggtcaggaggttataaagcatttggcccagagtctggcctggtgtttattcaggaaaactgctcctcacttgaagcagaactttggcagaaactcagtgtgagaacagttcctacccagccccccaccggggagggaagccactgagtctggctctgggagaagggaaatgggaaatgtaaaccggaggaggtttccagcgtcctacagcagacccaggtttatcttatcagtggagaagggaggatgggttgttgaaaatgcagcctggttcaacagtgaagggtgattgagaacattctgggctttgaaaggcaaacatgccagggagtggtctttccaggatcctaatctaaatcagaggggccagcccagcgaggaaggggtggggctggtggggttttagccagactggcccacctctccccttcctacttcctgatctttgcaaaataaagtttaaaatccaggacaatttagtatgctttggtgcagggaacaacataaagagtatagacctggccctcgctcctaagaatctttaagctacgagagagctgcaggatctagaacactgcaggaccccctgcgggcaaggtcctagcttaggaactgtacactcgttcttgcatttaaccttcacatcagcccccagaagtactcgatgaggcatctgggaagtgaagggatttgcccagggtcaaatctgtgagggatggagtcagaattcaaacccaggccgggcatggtggcgcacagctgtaatcccagcactttaggagtccaaggcaggaggatcacttgagcacaggagtttgggaccagcctggccaacatggtgaaagcccatctctacaaaaaatacaaaaaaaatcccacctttatttaagaaaaaaaattcaaacccagatctgtttggctttgaggttggtgctttttacaacattcagaataaaattttttttttttttgagactctgttgcccaggctggagtacagtggtgcaatcttggttcactgcaacctccatctcctaggttcaagcaattctcctgcctcagcctgtcgagtagctgggattacaggcaagtgacaccatgcccagctaatttttgcatttttagtagagacagggtttcaccatgttgtccaggctggtctcgaactcctgacctcaaatgatccacctgccttggcctcccaaagtgctgggattacagggatgagccactgtgcctggctcagaatcaaaatgtgaaatcaacgtgtgttgagtcagtaagtaaaccataaagatggagatttgggaatcagaattccaacctccttgaaggcagacctgggctatggctggaggttggagttgggaaaaacacaggccttggagtcccaaagacctggcttcaaagcctggctctgcctttgctgctgtgtgacctagagccaagtggctggactcttctgtgcccagcatcctctgctgtgaagtggagaggatgaagttcacctcctaggtttgctatgaggtttaaatgggaacaatccaagtacacagaaccgctggtgtggggctggttcttgaggggtagctagtgaatgttagccatgtccatgacacgcagagggctgagtggacttcctccctgggtgggggaggaagaagcttggggatagtacaaggccaaccagacctacttccacccagcccagcctagtgcttctctgtactctcctaaccctgctgacccaagtgctttgctgtgaggcagttgtgtgtgaggcgtgaaccctgagcctgtgctacagggggaaggagagaaggatgcctactcaatggctgcaagctgcctgcccgccccccacgcccgtgagcccccatcttccagcaggcagacccgggaactcccttctcctccacgggcaccccgaggaggagctgactttcagagtcggggagtaaacacccaggacctgctgcccaggcacggcatagtccaacttgaacttaggtctggcagtttcctggctttgaacctgagctctttattgccacacctgtccccacactggaaatgacccagccctcccgtggaaagaaagaagggtgccatttccctaaaaattaacgattgactaactaatatgaaaccacacaagcacgcctccagaaccccagttaatgtttacccatgttcttctccggtgccaagagcctttcctgtgggtgcacaactgcgggttccaccatagagattatgcggaacaaatttcagcctgggaatatgattcctgctaggcccttacctgaacgactccttcctggggcactctgtttccaccctgccatcgtcatggcgttgggcattcactccatgcttggcgcagagactgcagaccctcacatggctttataaaaagggggctctagggtgattcccaccctacagatgaggaaacaaagacacaggggtgaggtgcttgtcccatgtgacaaaatcaggagcaaaagagcccatattcggccaggcgcggtggctcacgcctgtaatcccagcactttgggaggccgaggtgagtggatcacctgaggtcaggagttggagaccagcctggccaacatggtgaaaccccgtctctactagaaatacaaaaattagccgggcatggtggcaggcatctgtaatcccagctactcaggaggctgaggcaggagaatcgcttgaacctgaaaggcggaggttgcagtgagccgggatcgctccattgcactccagcctggggaacaagagccagactttgtctaaaaaaaaagaaaaaaaaaaccctcacacctgtaatcccagcactttgggaggcccagacgggcggatcacgaggtcaggagattgagaccatcttggctaactcggtgaaaccccgtctctactaaaaacacagaaaaattagccgggcatggtggcaggcgcctatagtcccagctacttgggaggctgaggcaggagaatggtgtgaacctgggaggttggagtgcagtgagctgagattgcgccactgcactccagcctgggcaacagaatgagactctgtctcaggaaaaaaaaaaaagcccatattcgtccagattctttttttttttttaagagtctttttctgtcacccaggctggagtgcagtgatgcaatcacggcttactgcagcctcaacctcccaggctcaaatggtcctcccacctcagcctcctgagtagctgagactataggcacgcaaccacacctggctaatttttcactttttgtggagagagggtctcactatgttacccatgttggtttcaaactcctgagctcaagcaatcctcccaccttggcctcccaaattgttaggattacaggcgtgagccactgtgcctggccacccagattcttgtcttgaacctctgctcctttttgtgttttcttttttgagagagggtcttgctctgtcacccatgctggaggcagtggtgtgatcatggctcactgcagcctcaacctcccagactcaagcaagtgatccgtccatctcagcctcctaagtagctgggattacaggcgcatgcgaccacacttggctaatttttcattttttgtggagatggaggtctcactatgttactcaggttggtctcaaattcctgagctcaagcaattctcatgccttggcctccaaaagtgctgggactacaggtgtgagccactgtgccaggccaaatgtctgcttttgaccagtgagcctggccacccctccccagccctgttgtgagcctcactccaggctttgcttggcagctcggtattctttatggtccgagactctggcccagagtgaccatggatgtctcactggagttctaggccagggccaggacatgcagggatgctggggccaaagggacccccaaggaaggcaggcagagaggcagatgtctttgccttcacgtcacctgtagcctttgcctcagcactggtgaggtgaccatggaccctgccaggacactggtttaccaagcccgaagggaacagcttgctgggagatgtcttctctgcactccccaagaccatcgcccagtgcctggaaagcagagggcgaactctggcactttatgtatgtatttatttttattttttgagacggagtttcactctcgttgcccaggctggagtgcaatggcgtgatcttggctcactgcaacttctgcctcctgggttcaagcgattctcctgcctcagcctcccgagtagctgggactacaggcgcctgccaccacacctggctaattttttgtatttttagtagagatggggtttcaccgtgttggccagactggtctcaaactctggacctaaggtgatccgcccaccccagcctcccaaagtgctgggattacaggcatgaacaccgcacgcagcctcgcactttaataggtgactttaggtaataagtaaggacccttcctctgagcaaatggaggggctttggctctctgacattggcctcatgaggaaggaagtctttcccccagatgtggcttggttgggtgatggcctggtctgaattacattctagaggcggaaccgtcttgggacccgccctcctccctgaccccgttttttatcacttcctttctggttcaccagtaactctggccacctttgctttttctcaaatctaccagacttattcctgccctggggcctttgcacttgctattccacagcctggactgctggtcctccggctcttcctgtggacccctccttttcatcattccggactcggtcaaatgtccactcctcagggtgacctgcccctaccaccacggctggagttctctaccccccaccttagtcaccttctctggatcctcttcttcccttcgccttcatctgtacagtctgaggtggtcttctgtgtttgattgcctctttatttcctgggcaccatgagagcatggtctttgttggcttttggctgtactgtgtcctcagccctagaactgtgcctggcccatcgcaggtgttcattaagtgtttgctgagtgagtgaagtaataatctagggctgggcatggtgactcacacctgcaatcccaggaccttgggtggctgaggagggagtatcgcttgagtccagcctggggaacatagagggacctcatctctacaagaaatacaaaaattagccaggcgtagtggcgtgtgcctgtggtcccagctactcaggaggctaaggcaggaggatcacttgagcttaagaggaagaggctacagggagccatgatcacgccactgcactccagcctgggcagtggagtgagaccctgtctcaaaaaagaaaaaaaacaataaaaagaataatctaatttagttctcacaacaaatttgtgtgggagtggaatagaatgaaggtggttgcaaattgtttgccattccttctagggagaaggggaggctctctcctcaacctgggactctggactgagcctgtgactcactttgaccaacagaatttggtggcagaaatgaggccaagtgacttctgaagctagatcttaggaagcctttcagcttccacctgggtctctaggaacactgtctcaggggaagccagctgccatgtgggaagtcggactagcttgagccagccatgcagtcaggaagcccaagcagccatgtggtgccagacgagtaagtgcagaagccatcttgcacatccagcctcagaggtggatgactattggccccagctgtcctcacactgtagccacacaagggaactctgcccagatgagcccaaccaggggactctactgtgggagataagaaatcattttaagccaccaagttttagggtgctttgttacacagcaatggataactagaacaagtatgaacattctcttcattttttaaagaaaccaaggcactgagaagtcaagtgacttacccaaggtcacttggcagagtgagcattctggcctagattgtctgcaaggcctgtgcttttcatttgtaggctacaccactctgaaattaattcatatttgctttttcttgtttttttttttccttacaatactggtagtcagtattaggttgacagctggtcctgagaacttctttccttctcattgtagattttcataaacaatgaatggcacgatgccgtcagcaggaaaacattccccaccgtcaatccgtccactggagaggtcatctgtcaggtagctgaaggggacaaggtgagaactggtgacttaccttgggggagggatggattcgtcttctattttatacgtttttgtgtggtgaaagctttaccatatatgtgtattactttcacaagtaacagataccagtgaaaaattccgagtaaattaatcaatagaaacttgtctgcagacaacggtgttaattcacttagtgtagaactatagacttagaagtgaattcggcaaatatctaatacagtgtctcctttccagacctggaagttgaaggtcagagatggaaaccttgctgggtagaatttgggtctcctaagatctagctcctgtggaggtttgaattgtacagactgtaggaaccaatcgaaactgataatattctgtttaaaatttttaaattagactcttagtaaaaatattttgtgtttttggccgggcgcagtggcgcaggcctgtaatcccagcactttgggaggctgaggtgggaggatcacttgaacccaggaatttgagaccagcccggggaaacatagtgagataccatctctaaagtaaacaaagaaacaaataagtaatttaaaactaagaaaatacaggccaggcgcagtggctcaagcctgtaatcccagcactttgggaggccaaggtgggcagatcatgaggtcaggagtttgagaccagcctgaccaacatggtgaaaccccgtctctactaaaaatacagaaattagccaggtgtggtggcatctcttgagtaatcccagctactcaagaggctgaggtaggataattgcttgaacccgggaggcggaggttgcaatgagccgagattgcgccactatactccagcctgggcgacagagcgagatttcgtctcaaaaaaaaaacaaaaaaaaagaaaatacagaaattatccggattctcattcccaccaggacttcatgaaaggaggggaaggtcatgttattcaaccccattgctgaagtctggtgctcatcagggctctgccgggctaggagcattgtttacggggcaggttttctgtgcagcgatatgctgatgaccttctggatgtgtttgtattcggacctggttattactgagaagacctgagttttccaggaaggcttgagttttcctgtgttttctaggaagatgtggacaaggcagtgaaggccgcccgggccgccttccagctgggctcaccttggcgccgcatggacgcatcacacaggggccggctgctgaaccgcctggccgatctgatcgagcgggaccggacctacctggcggtgagtcctcagcccttctccccctcagatcccatgtggtgaataggctcgcagcatcctgtgaacagccaggaaccaagcatcctgtgaacagccagggaacacacatctgacacgggactgatgggaatggcataggatggacacctttagggggcacctctgtactaaccagaggagcctttcagtgtctcctttgtttttttgttttgttttgttttgcttttttgagatggagtctcactctgtcgcctaggctggagtgcagtggcgacatctcggctcactgcaacctccacctcctgggttcaagtgattctcctgcctcagcctcccaagtagctggaattacaggcacaagccaccacgcacagctaatttgtgtatttttagtagagacaaggtttcaccatgttggccaggctggtctccaacccttgggctcaagtaatccacctgcctcagcctcccaaagtgctgggattacaggcgtgagccaccgcacctggcctttgatgcggcgggtttggctaagcaagaaggatctgggggaggggagaggagctgtgtcagggaggccttcccaggagagagacccctgggaatggacacctctccctcggcccctccatggtgggccttctccctggctgcaagaggagaagaaaccaggaggcaatctcctcccagccacaattgattctgcacacagaagccagagcaaaccttccagaaggcagattatacatggcactctgctcttatccctgcatggcatgcggtgtccttaggataaaatcctcaacatggtctgtaagaccagcctgtaacatggcaagatcctgtctctacaaaaagttaaaaaactagctgagtatggtggcatatgcctgtagtcctagctacatggtaggctgaggcaggaggcttgcttgagcccaggagttcaaggctgcagtgagctgttgtggtgccactgcgctccagcctgggcaacagagtcagatcctgtctcaaaaaaaaaatgacccagcctgttctagttccatcatctgagtcatgctgcactgcagtcctcacattcacatgtgctcctgagcctgggctcccatgcttgatggccaagcctctttgagcatcagcgcttgcacctgcctgggatgctcttcgccctgctgccatctgtaccatcccctttgcccagttgccccctacatatcattcaggttctagcctaaagggctcatctctggctgatgtttctagacagggctgggcagcctggctccctgctttctattttttagcattcttttattattattattattttttgagatggagtctcactcttcacccaggctggagtgcaatggcacaatctcggctcactgcaacctctacctcccaagttcaagcaattctcctgcctcagcctccccactagctgggattacaggtgtgcaccaccatgcccagctaattttgtatttttgataaagtcaaggtttcactgttttggtcaggctggtctcgaacacctgcctcggcctcccaaagtgctgggattatagctgcaagtcactacatccggcctctagcactcttaacacatgtgactgaggacttgtgtcattatgcacagtctctttgctctgtaagctccacgctggtctctatcccagcacctggatatggtagagagcagaagctaaaagagtgtgtttatgaaatcactgagtgagaaattggtggctcatcctgcctggcccccttcctcctcctccctgcctttggagagaccatggcaatagtccagagatgctagtgacatttggggcacaaagcggactctcaccctgggcttgcaccagcccttctcagtcccagccttggcgccctctgtcagccctttgttttcctctcattcctgcacccatgtctctgctgaccttgttttcttctcaggccttggagaccctggacaatggcaagccctatgtcatctcctacctggtggatttggacatggtcctcaaatgtctccggtatgggctcagctttcctgttctttgttctggcaggggaaaaggggaggcaacgttgttaggaggtaaaaattaaattacaaaaattcaaaaggggcagagcgcggtatctcatgcctataatcccagcactttgggaggctgagccaggtggattacgtgaggtcaagagtttgagaccagcctggtcaacatgatgaaaccccatctctactaaaaatacaaaaattagctgggcatggtggcgcacacctgtaataccagctactcaggaggctaaggtagaagaatctcttgatccctggaagtggaggtcacagtgagccaagatcacgccactgcactccagcctaggtgacagagtgagactctgtctcaaaaacaaaaacaaaaaatgaataaattacaaaaattcaaaaggatcacaggagtcagagaaggctactctatttagactccagctcatgggaaaatccttcaatatcacaaattgtgattagtcataaatgctttcttttgttcttgagtcacttttggtactttctgtgttatttggaacttgtccattttatcgaggttatctaatttgttggtgtacaattgttcacagtattctcttataatcctttttatctctgtaagatctgtagtgttgtcttcattttcagttttacttatttgggtcttctctctgtttcttagcctagctaaaggtttgtccattttgtaaatgttttcaaagaaccaaacttttggttttgttgattttattatttttctattcaagaaaatattgtcttttgtctatctccgtttcagtctttatttccttccttttactagctttgggtttggtttaatcaaaaatgtttgattgattgattgattgattattattattattttttgagatggagtctcgctctgttgcccaggctggagtgcagtggtgcgatctcagctcactgcaagctccgcctcccgggttcatgccattctcctgcctcagcctcctgagtagctgggactacaggcgcccgccaccatgcccggctgattttttgtatttttagtggagatggggtttcaccgtgttagccaggatggtctcaatctcctgaccttgtgatccaccctccttggcttcccaaagtgctgagattagaggcgtgagccaccacgcctggcgattgattgataattttaattttttttttttgaggcagggtctcactcttgcccaggctggagtgcagtggcacaatcatagttcactgcagtgttgaccttctgggctcaagcaatcttcccacttcagcctcctaagtagctgggaccacaggcgtgcatcaccatgcctggatactttttaaattttttgtagagacgggggtcttgctatgttgcccaggctagttttggactcctgggctcaagtgatcctcccacctcggcctcccaaagtgctgggattacaggcatgagttactatgcccagcaaacataaacatttcaatgaccaaggaacaagggctttgttaaagcccatgtgttggagctgccagaaattcactgaggccaggcacagtggctcacacctgtaatcctagcactttgggaggctgaggcgggtggatcatttgaggtcagaagtccaagaggagcctggccaacatggtgaaaccccatctctactaaatatacaaaaattaaccaggcagtagtggcgcatgcctgtaatctcagctactcaggaggctgaggcacgagaatcacttgaacccaggaggtggaggttacagtgagccgagatcgtgccattgcactccagtctgggtgacagactgaggctccatctcaacaaaaaaaaaaggaaagaaagaaattcactgagcccaacttaaacgatagagtcaagaggtctctaatgcaaaaggccattgagtctcactcacctccctgcttgcttcattctcctcagctacactggctttgagggccagtttttacattgggacctggtagcccacaccacctgttcttgtacctccatgcctgattccagccaggctaagctgtcatcttttagttgtaatgccatattcctgagggaggaccctgagtggctggccttggttctggccagctgtggccaagggtggacagatcatttgtgtacataatggctgcctccctatgacatgtaaacagaggtggtggggaggaagcagtgccagaagagtagaggttggacaagaaaacagttgggccgggcgcagtggctcactcccataatcccagcagtttgggaggccgagctgggtggatcacctgaggtcaggagttcgagaccagcctggccaacatgatgaaaccccgtctctactaaaaatacaaaacttaggctgtgcgcggtggctcatgcctgtaatcccagcactttgggaggtcgcggcggggggatcacgaggtcaggaaatcgagaccatcctggctaacacggtgaaaccccatctctactaaaaatatatatatataaaaaattagctgggcttggtggcaggcgcctatagtcccagctactcaggaggctgaggcaggagaatggtgtgaacctgggaggtggagcttgcagtgagctgagatcgcgccactgcactccagcctgggcaacagagcgagactctgtctcagaaaaaaaaataaaaaataaaaaaattaaaacttagatgggcgtcttggcaggcatgctacttgggagtctgaggcaggagaaccgcttgaacctgggaggcggaggttgcagtgagctgagatcgcgccactgcactccagcctgggagacaagagcgagacttcgtctcaaaaaaaagaaaaaaaaaaagaaaacagtcggtatccttcacaacaggtgcacacagccagggcaatcacgcctccccggggacactgggcaatgtccagagacatttttggcagcctcgactgcgaggggaagggtactactggcatctagtggatagaggtcagagatgctgctcaacatcgtacaatgcccaggacagtcccacaacaaagaattctccagccccagatgtcagcagtgccaaggctgaaaaactccctctgcaaggacaccccagagagagcagcctggtacatctcagttggggccacatgctttcctgaattttggcattctgcttttgtgctgatgaaataacttctggggcttgcaaaacacatgtcatgtagactgtgtttgtatagatctgggggagggaagctgcaatgcctgggcttgcatagattggcaaccccctagctagctttcttccagggtcacaaacccatgttcaaacccaggtcactagccaggtgctaatggctcgagcctgtaatcccagcactttgggaggccaaggcaggaggatcacttgagctcaggagtttgagagcagcctgggcaatatagggagacccacatctctacaaaaaatttaaaaacattagccaggcatggtgacatgtgcctgtagtctcagctactcaggaggctaaggtgggaggatcacttgagcccaggaggtcaaggctacagtgagttatgattgtgccactgtactccagcctgggcaactgagcaagaccctgtttctttctttcttttcttttttttttttttttttgagacagagtctcgctctgttgcccaggctggagtacagtggcgtgatctcggctcactgcaacctccgcctcccaggtttaagccattcttctgcctcagcctcccgaggtgctgggattacaggcacccgccaccacgcccagctaattttttgtatttttagtagagacggggtttcaccaccttggccaggctggtctcgaactcctgacctcgtgatctgctcacctaggcctcccaaagtgctgggattacaagtgtgagccaccacacccagcaagaccctgtttcttaaaaaaaacaaagaaggtcaggcatggtggcaggtgcctgtaatcccagctacttgggaggctgaggtagagaatcgcttgaacctggggggccgaggttgcagtgagcccagatcacaccactgcactccatcctgggagacagagcgagacgctgtctcaaaaaaaaaaaaagaaaagaaaagaaagaaaaaaaaaaaatctaattcctgggcatgagccccagagagtgggattgagtagattggaaatggactcctgggatctggtgttttttacaagaaccccaggcgattctgaggcttgggggttagctacctagagtagattttcgtgacctttgcagtcacttgtctctctctgaataagccaaaagcaaagacagttttcagaaagactcagctggaccagtttgagtcttctctttctgccagggtttgcaggggtccctgacaatcattgattcgagcttgaacgtttctttgtttaaaggtattatgccggctgggctgataagtaccacgggaaaaccatccccattgacggagacttcttcagctacacacgccatgaacctgtgggggtgtgcgggcagatcattccggtgagtccagcctccctggagtttcttcagggtgccctgagatttggcagtctgccagactcattgcagaggttctggggtggtgtcggaaggcagcctgggtggcaggtaagaagatgggctctgacaaagccaatccggtttgagtctcagcactgccactcgtgaattctgtaaccttgggcaagtcacttatcccccaagcctcagtttccccatctgaaaagtggaaatgaacatagtgcctgtcttagggaggtaattagggcttagcatggtgtcacggacataaaagcacggataaatgtgagtctgtcatcgttgtgcaccgcctgcctcatccattcatcttaaaaccacgatggatggagttaggggaggacacgcagggttcagagaactcggtgctgcttctgccctctggggttgccaccttctgctacccagtgtagttctctgaggaagcttggatttcgagggctgctgttgtttgttgcagtggaatttcccgctcctgatgcaagcatggaagctgggcccagccttggcaactggaaacgtggttgtgatgaaggtagctgagcagacacccctcaccgccctctatgtggccaacctgatcaaggaggtgcgtggcttatcctggtcttaacctctaaatgcccttgttgaggcttgttctaaaggagttctgagaagggtctcaggggtccctaaacagggaggtgtgtttgtggagcccccatcaccatgtgaaccagagtggctccctcttagcttttttccacattggacttcactgcaagatcccctttgaagaattaaaaatattgctctaggccaggcttggtggctcacgcctgcaatcccagcactttgggtggccaaagcaggagggttgcttgagttcaggagtttgagaccagcctgagcaacatagcaagaccccatctctacaaaaaattaaaaatcagctgggtggcatgcacctgtagtcccaactacttgggaggttaaggcaggaggatcacttgagcccaggagtttgaggctgcagtgagctgtgatcacaccactgcactccagcctgggtgccagagagagactcggtctcaaaaaacaaacaaaaacccactgttgttctaagtgaatgctgtcaggggaggggcaaagacacagggaaccccagcgaacagactccttctccgtcccatttagaattcccatgtagtgccccatacaattagcttctgaccacatgtgtccttggcagactgtcccaccctctctgagaaaggatgtgtcttcccctggttgagcccttcagaataggagggtgactcccaatgtcccctggctgtttgctcacaggctggctttccccctggtgtggtcaacattgtgcctggatttggccccacggctggggccgccattgcctcccatgaggatgtggacaaagtggcattcacaggctccactgaggtaaggtgaccctggcctcaagcttgcagcctccttggcccaagctccccctgtcctcagtggacgacatgctcaaggtgagctcccgggtgtcaagcggaggccttttcctccaggacgaccctgtaggtaccaggaggggtggggcagggttgagcccttcgtggtctggttgccacactagctgcccttgggaggggccagtgtcccatgtggactaaggaggccaggcctggccagactccacatagcccagagctgaccgcttgccccaaatcaaagcatcttggccaggtcagactccttgaccaggactgccattgtggttaaaaattagccttgtgtggtggtgtgtgcgtgtggccccagctacttggaaggccgaggcaggagggttgccagagcctgagaggtcaaggctgcagtgagctgagatcacgccactgcactccagcctaggtgacagagcgagaccctgtccaaaagaaaaaaaaagtgaacgtctatttggtgaaattctctaggtctctcgtggtccagttgctcactcaagctgtgggggactctgttctgtgtctatagagtgctggactcttttctcccggcactgagagcttgttcctgtctttctgtccccacagattggccgcgtaatccaggttgctgctgggagcagcaacctcaagagagtgaccttggagctgggggggaagagccccaacatcatcatgtcagatgccgatagtgagtttccagctggagaaggcctggccttgaaggtagccctggccacctgtgttgtggctccagccgatcctgtcgcccccccagtgcccaatggcgttggttgctgtccctcgggcctcaggataagacgccagcgcagggcctgcatggcctggccttggcctgtccccagcctctccctggctgctctctgcatcatcaggctaggccacgcccctgctatctgactcatccacttgccgccatcacgccctttgtcctggttggcagtgggctccgagagcacccctcatctccctgtatctgtctctggcacccagcaggcatcaacccttacagtggtgggaacaggctccattgggcaggcggccaccagggccagggtcctcctcctcactgtcacctttctgtctcctgcccacttcccgcagtggattgggccgtggaacaggcccacttcgccctgttcttcaaccagggccagtgctgctgtgccggctcccggaccttcgtgcaggaggacatctatgatgagtttgtggagcggagcgttgcccgggccaagtctcgggtggtcgggaacccctttgatagcaagaccgagcaggggccgcaggtgagccaggcagtgccgcagggtctgggtgtctagagccagcatgagaagcagagagggcatcgggctcagatcagttgggactgggttcaggtctcagctctaccacacagcagctgtgtgcctttgggaagctatgttccctccctcagccttcatttccccatcccgagccgtgccctgcctcattcacagggtggctgtgatgtagaaattaatcctgggaagcactttgtaaattgcatatatgtaacaaataccaggagtgtctgcaaaagggagtgtgtgtttccaagaccttggtcatcagtagaagtgtatccaccagaagatacacagctctgtgaaccttcgtgtctgagagccatggtatggctagtatagggactttatttcacttcatgttttgagctgtttgattttatttatttatttatttacctatttatattttagagacaaggtctctctttgttgcccaggctggagtgtagtggtgcaatcatacctcacctcagccttgaattcctgggctcaaggagtcctcctgctttggcctctcaaagtgctgggattacagacatgaaccaccacacctggcctggattttacttttgagcagttgtaggtttatagaaaaatagagctgaacgtacagagggtgcccatatattccttcgcacctccctgttccaccagtttcccctttattcacatcctgcatgagtgtggttcatctgttagtattgatgagccaatactggtaccttattattcacttaggtctgtagtgtatattcgggtttttttttttaatttttattttttttggagacagagttttgttctgtcacccaggctgcagtgcagtggcacgatctcgactcatgcctcccgggttcaagcaattcttgtgcctcagcctcctgagtagctgggactacaggtgcgcaccaccacgcctggctaattttttgtgttttagtagagacagggtttcactctgttgcccaggctggtctcgaactcctgagctcgggcaatctgctgtcaggcacccagcctcggggtcattttttgtgttgtacttactatgggcctagacaaatgtatcataatgtgtatgataccatcattctagtatcatataaatatatttgtgccctgaaacccccgtcctccacctattcttccctcttttcctcccctgagccctggcaggcaaccactgatttttttttttttttttttttttgagacagagtctcgctccgtcaccaggctggagtgcagtggcgtgatctcggctcactgcaacctgtacctcctgggttcaagtgattctcctgccccagcctcctgagtagctgggacttacaggtgcatgccaccatgcccagctaatttttgtatttttagtagagacagggtttcaccacgttggccaggatggtctcgatctcctgacctcgtgatccacccacctcagccttccaaagtgctgggattacaggcgtgagccattgtgcctggccgatctttttattgtctctatagttttgccttttccagattgtcttatacgaatcatacagtaggtagccttctcagactggcttctttcttttagcagtttgcatttctgattcctcagtggggagccacagccatgtctgaggatggactggccttgccatgggacagggttatgtgcccaacatccccctctttgattttttttagagacagggtcttgttctgttgcccaggctggaatgcagtggtgtgatcatggctcactgcaggcttaacctcctggcctcaagtgatcctcctgcttcagcctcccaagtaggtgggactacaggcacacgtcaccacacctggctaatattcatattttttatagagatgaggtcttgctatgttacccaggctggtcttgaattgctgggctcaagcaatcctcccacctcagcctcccaaagtcctgggattgcaggtgtgagccactgtgcctggcctccaacatctctatctttaatagctttattgagatataattcacgtagcataaaatgcaccattttagtgtacgattcagtgatttttagtatattcacaactttgtgcaaccatcaccactaattctataatattgtcattgcctcccctaaatatcctgtacccattagcagtcactccccattcctccccctaccaggcccaggcaaccaccaatctatgttctgcctatagatttatctattttggacattttatgcaaatggaatcctacatggttctttgtgtctggcttcttccaagtagccatgttttaaaggttcatccatgttgtaataagaatgtatcagaacataaaaggccaagtaatattccattgtgtgaatagaccacattttgatttttctattaatctgttgacagacttgattgtttccaccttttggttactgtgaatagtgcagctaggggcactaacatttctttctttcttttgagaccgtctcgctctgtcacccaggctggagtgcagtggcatcatctcagctcactgcaacctccacctcctaggttcaaacaattctcctgtctcagcctcctgagtaggtgggactacaagtgcacgccaccacgccctgctaatttttgtatttttagtagagacagggtttcaccaagatggtcaggctggtcttgaactcctgacctcaggtgatccacctgcctcagcctcccaaagtgctgagattacaggtgtgagccaccgcacctgtcctaacatttcttttcttttttttttttttgagacagagtcttgctctgtctccaggctggagtacagtggcacgatctcggctcactgcaacctccgtctcccaggtttgaatgattctcctgcctcagtctcccgagtagctgagattacaggcgcccaccaccatgcccagctaattttttgtatctttagtagagacagggtttcaccatgttggccaggctggtcttgaactcctgaccttgtgatccgcccacctcagcttcccaaagtgctgagattacaggcttgagccactgcacccgtcctaacatttctttttgtctcatttctctttgtggctaattattaagataatataaacttgcattaataaatttaatgagaaagtgtttaggctatgtgtggcagctcacatctgtaaccccaacactttgggaggctgaggcaggagaatctcttgagcccaggatttcgagatcagcctgggcactacagcaagacctcatctctactaaaaaaaaaaaaatgcaaatcatgaccagcctggccaacacggtgaaacctcatctctactaaaaatacaaaaactatttgggcgtggtggtgggcgcctataatcccagctactcgggaggctgaggcaggagaatcacttgaacccgggaggcgcaggttgtggtgagccaaaatcgtgccaccgcactccagcctgggtgacagagtgagactccacctcaaaaaataaataattttttttttaaaaaaaagcaaaaaaaaattagccagatgtagtgatgcgtgcctatactctcagctacttgggaggctgaggtgggagcccaggaggtcaaggctgcagtgagcagtgatcacaccactgcactgctgcctgagtggcagagtgaggccctgactctttttaaaaaaaggtatttaatgtaaaaaataagactttgttgcatttcttttattctccattggtaaccactcatgcacacacagttatgctgttgtatgtttattttttaaaaaataggctgggtgtggtggctaacccctgtagtcctaacacttgggagggaggccaaggtgagtcaattacttgagcccaggagttagatactagcctgggcaacatagcaaaaccccatccctactaaaaatataaaaattacccaggtgtggtggcacacacctgtggtccagctactcgggagactgagatgagaagatacctgagctcagggagattgaagttgcagtgagccgtgattgtgccactgctcttcagactgggcaatagagtgagaccctgtcgcccttctcccctaccctataaaggagtatataagtgcatattgttctacaagctttacttctttttttttttttttttgagacgaagtctctgttgccagagctggagtgcaatagcgcgatcttggcttactgcaatctccacctccctggttcaagcgattctcctgcctcagcatgtgccaccatgcccagctaatttttgtatttttagtagagacggggtttcactatgttggccaggctagtcttgaactcctgacctcatgatctgcctgcctcgtcctcccaaagtgccgagattacaggcgtgagccactgcccctggcccaagctttccttctttttacagagtatcttgggccatctttctgtgtcagttagttcacagatctattagtgatgacaatatactggatgcaccgtaataattttaaccaacccctctactgatttatacttagaattgtttccatcttttgcctttacaaaatgctcccccagcctgggctacaaggcaaaaccctgtctctactaaaaatacaaaaattagcccagcgtaggggtgcatgcctatagtcccagctactcgggaggctgaggtgggaggatcatttgagcatgagaggcagaggttacagtgagtggagatcgcaccactgcactccagcctgggtgacagagtgagaccccatctcaaaaacaaaaatacaaaaaaaaaaaaatactccctagtgaatatccttgttcatttctctttgtgcatatgtagaataaattcctagaagttaaatagctgggccaaaggatctgagtatataatttttgagcaatattaataaaccacttgctctaaaggctgtaccagtctgtcatccttctaacagtatatgtaacggtctcttgctatcagtgtattttcttcctaaactttttggtaatcttatagttgaaaagtaaagattgatttgatgtccttttctccggtaggctgaggaagttgggccttttttgtgttttctgctattggccctgtgtgtttcctcttctgatcttgctttcttatgaccttggtccatttcccagttgtcttgttgcctgcataattctaagcctgaagcctaggagaggtctgaatccgatgtctccataactctgggttccttctcccacaggtggatgaaactcagtttaagaagatcctcggctacatcaacacggggaagcaagagggggcgaagctgctgtgtggtgggggcattgctgctgaccgtggttacttcatccagcccactgtgtttggagatgtgcaggatggcatgaccatcgccaaggaggaggtgagcacttggggccagtgctctggaaacattcttggcgggaggtgaggtaaacagttcagcctggcatcctgatgctgtcacccatctgctggcttggggccagatctcaagttatacccagaaccagtgcccataacacgctattcatagtatgtatctgatcttgtccctcctcttcagcttgtaccctctgtctgggagatcgtctgcattcctcagcatggcctgcaggccttggtgtcctggccctcagagccaggagtctaggaatgacattgtctgctccttcccatgaccttttttctttcagtcagattcttgctctgttgcccaggctggagtgcagtggcataatcatggctccttatagccttgaactcttgggctcaaatgatcctcccacctcagccttctgagtagctgggactacaggtgctcaccaccatgcctggctaattttaaaaaaattttttagtacaggctgggtgcagttgctcacgcctgtaatcccaacactttgggaggccgaagtgggtggatcacctgaggtcatgagttcgagaccagcctggccaacatggcaaaaccctgtctgtattaaaaataagaaaaaattagccctgcgtggtggcgcttgcttgaaatcccagctactctggaggctgaggcaggagaatcgcttgaacctgggaggcagaggtttcagtgagccgagatcgcgccactgcactccagcctaggcaacagagcgggactctgtctccagttttagccacgcctggctaatttttgtatttttagtaaagacagggtttcaccatgttgatcagactagtctcgaactcctgacttcgtgatctgcctgcctcggcctcccaaagtgctgggattacaggcatgagccaccacgcccggcttattttttctcttctcgttttgagatggagtctcactctgtcgccaggctggagtgcagtggtgcaatctcagctcactgcaacctctgcctcccgggttcaagcgattctcctgcctcagaccctactagtagctgggattacaggcgcacaccaccacgcccagctaatttttcttattttcagtagagatggggtttcaccatgttggccaggcttgtctccaactcctgacctcaggtgatccacctgcctcagcctcccaaaatgctgggattacaggtgtgagccatcgtgcctggccaaaaattttttttttttttttgagtaaagacagggtctctctgtgtttgccaggctggactcgaactcctagactcaagcagttctcccaccttggcctcccaaagtgctgggattacaggcatgagccacaatgcccagctgacttaaattctttgacactaaatctacgtgtcacgtgtgaataacatacctggcaggattgtttagaaatgggatactgtatgtaaagcccggggcgcacaggaggaagttggcccctgttagctccattccctctgtgttctgctgagcttgatggctgttgtcttcccctggaactgttagagcatggctgggggcttatcccccaatctggaatcatctgttctgctctgagagagctcgatggcaggtgcctccgtgttgccgaaccctcctacgctgctctctcactccagatcttcgggccagtgatgcagatcctgaagttcaagaccatagaggaggttgttgggagagccaacaattccacgtacgggctggccgcagctgtcttcacaaaggatttggacaaggccaattacctgtcccaggccctccaggcgggcactgtgtggtaagagcctcccagcagcccctcacaacccaacagagattcctcaaagccagggcctactggaatctggtggtcaccatcctggaatttggggagctgggctcagtttctcctgggtcagggtgtgatgtcgatttgagaggtcctgctacctcacctccgaaggatcaagcttctctgtggtgcaaaggccctgcacctgaacttggcaggcagcggagtggtggggctcctccccagctgcctcagggcaggagaccagagcagagggacccatgattgtgacactgatcctaaaagcttagcctctgcttcacacttagcccccactaggatggctatatttttattatttatttatttttagttttattttttcagacagaaaaaaatattctacccaggctgaagtgctgtggggtgcgattatagctcactgcagccttgaactcctgggctcaagcaatcctcccacctctgcctcctgagtagctgggaccacaggtgtgtaccaccacacctggacaattaaaaaacatttttattttttgtagagatgagatctcgccatgttgcccaggctgggctatatgtatatatattttaaagtattggtaaggatgtggagaaatcggaaccctcctatgttgctgatgggaatggaaaatggcacactcattgtggaaaataatttgggagctcctcaaaaagttaaacatgaagcccccatatgacccagcaattccactcctaggtatttatccaagagaaagaaaaacgtgctcccacataaaaacgtgtatatgaatcttcacagcagcattatttgtaacagccaaaaggtgaacacaacccaaatgtccgtctgtagatgaatggatacagaatgtgatctgtccatgcaatgaaatgtggctcagccacagaaaggaatgaagtagctgtatgagtctgttctcacactgctggtaaagacattgcagagaccgggtaatttataaaggaaagaggtttaatggactcacacagttccacgtggctggggaggcctcacaatcatggtgaaaggtgaaaagcatgtctcacgtggtggcagacaagagaagagaacttgtgcagggaaactcccctttataaaaccatcagatcttgtgagacttactcactgtcacaagaatagcatgggaaagacctggccccatgattcaattacctcccacaacacgtgggaattgtgggagctacaattcaagatgagatttgggtggggacaaagccaagccatatcagtagccatgcatgcaatagcatggattaatcttgaacataacattgagtgaaagaacccagactgtctgggtgcggtggctcatgcctgtaatcccagcactttgggaagccgaggtgggtaggtcacttgaggtcaagagtttgagaccagcctggccaacatggtgaaaccttatctctactaaaaacacaaaacttagctggctgtggtggcaggtgcctgtagtcccagctactcgggaggctgaggcaggagaatcgcttgaacctgggaggcggagattgcagtgagtggagatcatgccactgcgctccagcctgagcgatagagtgagactccaaaaaaaaaaaaaaagaacccaggcacaaaaggccacatgctgtgtgattccatttacagtattataaatatctagaataggcgaatccatagagatagaaagtatgttagtggttgccaggggctgggggagggaggaatggagagtgcctgcctcctgggcacagggcttctttcagtgtgatagaaatgttctgcaattagacagtggtgatggtcacacaacactgtgaatatgctgtcaaccagtgattgtacactttaaaatggtgaattttaggctgggtgcagtggctcacccctgtaatcccagcactttgggaggccaaggtagacggatcacgagatcaggagatggagaccatcttggccaatgtggtgaaaccccgtctctactaaaaatacaaaaattaggcctgggcctggtggctcacacctgtaaggccgtggtggttcacacctgtaatcccagcactttgggagtccgaagtaggtggaacatgatgtcaggagttcaagaccagcctgaccaacatggtgaaaccctgtttctactaaaaatacacaaattagacgggtgtggtggcatgcacctgtaatcccagctacttgggaggatgaggcaggagaatcgcttgaacccgggaggcagaggttacagtgagttgagatcgtgccattgcactccagcctgggtgacagagcaagactctgtctcaaaaaaaaaaaaaaaaaaaattagccgggcgcagtggtgggcacctgtaatcccagctactcaggaggctgaggcaggagaatcacttgaactttagaggcagaagttgcagtgagccgagatcgcaccactgcactccagcttggcaacagagtgagactctgtctcaaaaaaagaaaagaaaaagggcagggcgctgtggttcacacctgtaatcccagcactttgggaggccaaggcgggcggatcacgaggtcagaagatcaagaccatcctggctaacacagtgaaaccccgtttctactaaaaatacaaaaatttagccgggtgtggtggcgggcacctgtagtcccagctactcgggaggctgaggcaggagaatggcgtgaacctgggaggcggagcttgcggtgagccgagatcgcaccactgcactccagccagggcgacggagcgagactctgtctcaaaaaaaaaaaaaaaaagaaaattaaaaataggccaagcgtggtggctcacacctgtaatcccagcattttgggaggccaaggcaggcatatcacgaagtcaagagtttgagaccagcctgaccaacatggtgaaaccctgtctctactaaaaatagaaaaattagctgggcatggtagcatgcacctgtaatcccagctactcgggaggctggagattcgcttgaacctgggaggcggaggttgcagtaagctgagatctcaccactgcactccagcctgggcaacagagtgaaactccatctcaaaaaataatctcaaaaaataataataataaataaaaataaataaataaatggtaaatttcaaattcaaataaaatttaataatttttttaaattgcaaaaaaaaaaaatgaaagaaaagaaaagaaagccatccaggtgcagtggctcataccagtaatcccagtgctttgggagcctgaggcaggagaattacttgaggccaggagttcgagaccagcctgggcaacatagtgagaccccatctctacaaaaaataaaagataaaaaaattagccaggcatagtggcacatacttgttatcttaactacttgggaggctgaggcaggaggatcactgaagaccaggagttggagaccagcctgggtaacataatcagaccctgtctcttaaaaaaaaatttattgccaggcgtggttgcacgtgctggtagtccagctactcaggaagctgaggcaggagaatctcttgaaccccagatgtggaggttgcaacgagccaagatcatgccatggcaactccagcctgggcaacagagaaagattctatctcaaaaaaaaaaatttttttttaagttaaaaataaaataaagactttggggcaatacagggggtcctgggagtgtaacccataacccccaagagtgatttctgcaatctcgtttcaaattacagggtcaactgctatgatgtgtttggagcccagtcaccctttggtggctacaagatgtcggggagtggccgggagttgggcgagtacgggctgcaggcatacactgaagtgaaaactgtgagtgtgggacctgctgggggctcagggcctgttggggcttgagggtctgctggtggctcggagcctgctgggggattggggtctgttgggggctcggggcctgccagaggttcaggacctgccggggactcagggcctgctggaagttcaggacctgctggggatcagggcctgccagggatttagggtctgctgggcgggccaccttttggcctctccctcatgcttgaggccatcagtgtttcctactaatttcccattttaagcctgagaagtgacaagagagggtaaagacccagcctctgctctgtcccatgagaaatactgagggacgtgcccccatcaggcctatgcggtcatttgctgggcttcgttatacgccaaggcctgtaggcctgagaagagggagagacttcagggggcggagcggagaggaaaagcttctagtaagaatcttttcagattttcaccaggcgcggtggcttttcaccgggcacggtggctcacacctgtaatcccagcactttgggaggccaaggtgggtggatcacgaatgaggtcaggagtttgagaccagcctgaccaacatggtgaaaccttgtctctactaaaatacaaaaattagccaggtgtggtggcgtgcgcctgtaatcccagctactcaggaggctgaggcaggagaatcgcttgaacacgggaggcggaggttgcagtgagtcgagattgtgccattgcactccagcctgggcaacagagcgagactccgtctcaaaaaaaaaaaaaaaagaaaagaaaaaagaattagctattaggttggaatggagcaattcccacagtaataaaaatatttaaaaataaataatacaaacataagctattaggcatgagatatcaaggcccataaccatatgcatctcctttgatttgcaacttcaatgactggaatatagcctgaaggacccatcagaaatacaaagaaagcgttccttccataaatattcatcactgctttatctctaagaggggaaaatcagatgtaaacttaatgcccaataaattatggaacaccccaatcaaggagtaacaggtatctgttacaaatgtttttgtagaatatttgatatgaaaaatgcttagcctttaaagtaaaagcagtatacaaactaatatatcatcaatataagcccaatttttggaatttatgtacatagatagatactcagatacatttacttataaatataaaaaaagaaaggaaaaactggagcgtggtgttgcatgcctgtagtcccagctactcgggaggccaaggtgggaggatcgcttgagccacaagtttgaagctagcctggaaaatgggttgagcaggcctttccaggattggaatcaccaggctggagtgtactggtgccatcacagctcactgcagcctccacctcctgggctgaagtgatcctcgcatctcagtctcccgagtagctgggactacaggtgcacatcaccattcctgactaatttttgtatttcttgtagagatggggtctcactatgttacccaggctggtctcaatctcctgggctcaagtgattctcctgccttggtcccaaagtgctgggattataggcatgagctaccacacccagcctggctctcagttttgtaagtcgaaaaacttggacaggccaaattgaagagtcatgttcgccaatttcataagcgattaatttggcaatgtagcaagataccatcttattaaaaacaaaatggccgggcgcggtggctcacgcgtataatcccagcacttctggaggctgaggtgggtggatcacaaggtcaagagatcgagaccatcctggccaagatagtgaaaccctgtctctactaaaaatacaaaaattagctgggcgtggcggcacatgcctgtagtcccagctacttgggaggctgaggcaggagaattgcttgaacccgggaggtggaggttgcagtgagccaagattgcaccactgcactccagcctggcgacagagtgagactcaaaaaaaaaaaaaacaggccgggcgcagtggctcacacctgtaatcctagcacttttggaggttgaggtgggcagaccacgaggtcaggagatcgagaccatcctggctaacatggtgaaacctcgtctctactaaaaatacaaaaacaaaattagctaggtgtggtggcaggtgcctgtagtcccagctactcaggaggctgaggcggaagaatggcgtgaacccagtgggtggagcttgcagtgagccaagatcgcaccactgcactccagcctgggcgacagagcgagactccgtctcaggaaaaaaaaaaaaagaaaaaacaaacaaacagggaaatatacactgaagtgaaaatgatttactgtgaatactaattatagtttaaccagaaaacataaacacaagtgatgtttaaggaagaggcaaatgggttgagctagcctttccaggattggaaaagaggaggctcagggcaagcctgccagctgtggagcaggtgagaaaaggcaaacgggactcattcagggccacagtgccaagcctgagactggagaggccgaggacacaacctgtgttcctgaatagctcactggaatcaactaaacgtgtttacttgtttagtgtggaaactttccaatctatgcaaagaataggtataatggtagaatgaggccaggagtggtggctcatgcctgtaatcccagcattttgggaggccgagatgggcagatcacttgaggtcaggagttcgagaccagcctggtcaacatggtgaaaccccatctctactaaaaatgcaaaaattggccaggctggtggcatgtgtctgtggtcccagctgcttgggaggctgagacaagagttgcctgaacccgggaggtggaggttgcagtgagctgagatcgcgccactgtactccagcctgggcaacagagcaagactctgtctcaaaaaacaaacaaacagaccgggcatggtggctcacgcctgtaatcccagcactttgggaggccgaggtgggcgaatcacaaggtcagaagatccagaccatcctggctacggtgaaaccccatctctactaaaaatacaaaaaattagccaggcgtggtggcgagtgcctgtaatcccagctacttgggaggctgaggcaggagaatggtgtgaactcgggaggcggagcttgcagtgagccgagatggtgccactgcactccagcgtgggagacagagcgagactctgtctcaaaaacaaaacaaaacaaaacggaaaaaaaaaaacagtagaatgagcctctgtatccccaccataaagctatgacaaagatcagctcacagccagtcttgtttactgtataccccacccacttcccagtgggtacacttcatccactgcccgagcagagtccacaacagcaggaggtggccatgtgggtggacagcctgtgctgggctttgagttatgacatcggataaaaggtccaacttcagttggtgagtcttaaatcttggcacatgactagtgttaaggaggcgatgtccaggatggccacgtgacagggtggtatctaagctgatatacctgaaggatgagtggaagtagagatggtgaggggaggaagagaagaacgtactaaacaaagagcatagcttctggaaaagctgtgatggcgagaaatatggctcttccaggaactgcaggaaggttgctggtggtggaagatgtagtggttagtggggagagagcaaggccagaatgcacaggcccttgttggccatgatgtggggtttgatgtctttgataatggagtttgatctcagctatgggagcattttaagtagaagaattaggtggctcaatttttttttttttttttctgagccagagtcttgctctgttgctcaggctggagtgcagtgctgtgatcttggctcactgcaacctccgcctcccgggctcaagcgattctcatgcctcagccacttgactagctgggattacaggcgcctgccaccacacctggctaattttttgtatttgtagagatgaggtttcaccctgttggccaggctgatctcgaactcctggcctcaagtaatctgcctgcctcggcctcccaaagttctgggattacaggtgtgaaccactgtgcctggcccactcaatttgtatttttaaaagattgctctgcttaatctatagagacagaaacttattactggtcatctagggcatggggaatgggtagtggctgctcatgggtgcaagattgcttttggagatgatgcagatgttctaaaactggagtatggtgatgattgcacaacttaaaatattctaaaagcaattacacttgattgtgcataaatcatatctcaagaaagttgtttaaaaatttaagaaagcggccaggcgcggtggctcacgcctgtaatcccagcactttgggacactgaggcaggtgaatcacctgaggtcaggagttcgagaccagcctgaccaacaaggtgaaatcccttctctactaaaaacacaaaaattagcaaggcttggttgcaggtgcctgtagtcccacctactcgggaggctgagacaggagaattgcttgaacctgggaggcagaggttgcagtgagccgagattgcgccactgcactccagcctgggcaacagagtaagactccgtctcaaaaaaaaaaatttaagaaacctcactctgcttgccctagggagaatggaccatccagtatgaggagggatgagggagctgtcaggagactgctccaaggagaaagatggtggtttggattggagtggtgcagtgcaggtggagaaaagagggtatatgtgacaggaagccaggagtaggattggcgactctggatatagagaggaaaagcaaaactaggaatcaaagatggcacccaggtttccaaggaggggttgagtggtgacgccagtcctgtgatagggaacactgaatgaagtactgtggttctctttagggttgtgtttggggtacctgtccaaacccaagaggtgatgtggagaacacatctagggagatgggcttggagctccaggggcaagacccagatttgaaatagaaattctgacatcattggcctataactcttcatcaaaatcatagttacaggccacgtgccatggctcacgcctgtaatcttagcactttgggaggcccagacaggcggaacgcttgagcccaggagttcaagacaagcctgggcaacatagtgacaccccatctctaataaaaatacaaaaagttagctgggtgttatggtgcatgcctgtagtcccagctacttgggaggctgaggtgggaggatcgcttgagccaggaggtcaaggcagtagtgagctgtaattgcacccctgtactccagtctggggagaaaaaaagaaaagccctttctgctcacacttagtcagctcctagctgaggggacctacagatcacagggaagcaggaagatctaacggcttctctgtcccccttacaggtcacagtcaaagtgcctcagaagaactcataagaatcatgcaagcttcctccctcagccattgatggaaagttcagcaagatcagcaacaaaaccaagaaaaatgatccttgcgtgctgaatatctgaaaagagaaatttttcctacaaaatctcttgggtcaagaaagttctagaatttgaattgataaacatggtgggttggctgagggtaagagtatatgaggaaccttttaaacgacaacaatactgctagctttcaggatgatttttaaaaaatagattcaaatgtgttatcctctctctgaaacgcttcctataactcgagtttataggggaagaaaaagctattgtttacaattatatcaccattaaggcaactgctacaccctgctttgtattctgggctaagattcattaaaaactagctgctcttaacttactgggtaactctttgtccatctcaataaccaaaggaaggtgggcatggtggctcacgcctgtaatcccagcactttgggaagccgaggcgggtggatcactcgaggtcaggagtttgagaccagcctggccaacgtagtgaaaccctgtctctcactaaaaatacacaaattaggcagtcatggtggctggcacctgtaatcccagctacttgggaggctgaggcaggaaaattggttgaacctgggaggtggaggttgcagtgagtggagatcatgccactgcactccagcctgggagtcagagcgagactccatctcaaaaaaagtaaataaatgaaatagcctaaggaaatgctggcaggcagtaatgatatggcacactggatatgatttctgcccctcctctgctgtgggtaaacagcttctgtttcatgcatttacttttttattttaattacaccaataagaatgtgcttgaatgtttcatgcatttaatttgtttcatgcatttaacttctggcctgtttacctgtagcaggctctgagatgtgctctagagacagaacctaaacatgatgcccaagagaggggagagatactgaatgtccaatgttctcaaattttttttttttttttttttgagacagggtcttgctctgccatccaggctggagtgcagtggcacgatcatagctcactgctgcctcgacctcctgggctcaaatgatcctcctgcttcagcttcctgggctaatgtttgtattttttgtggagatgggactttgttatgttgcccaggctgttttcaaactcctggactcaagtgatcctcccgccttagcctcctaaggtgctgggattacaggtgtgagccactgtgcccaattcagttctcagtaaaaacttgatcaggccaaatgaaagtgacatgggccaatttcataatagattgatttggaaaccagatgtcaatttacttactttaagtgagatctgtatcttcagtaaccagacctcttgagtctcccacccagaacactatcttcctctagtcaagatacctggcaaaggccgggcacagtggctcacgcctataattccagcactttgggaggccaaggtgggtgggtcacctgaggttgggagttcgagaccagcctgaccaacagggagaaaccccatctctactgaaaatacaaaaaaaaaaaaaaaaactagccgggcatggtggctcatgcctgtaatcccagctactcaggaggctgaggcaggagaattgcttgaacctgggaggcagaggttgcagtgagccaagattgctccattgtactccagcctgggcaacaagagagaaactccgtctcaaaatataaataaataagaaaaagaagaaatggaagctgggttcaagagggcaatcagcagtctctaccatcatgtgaaacaccactctgtgatttgagtcttgacaatgtattttctttttttttttcttcttttttttttgagactgagtctcggtctgtcgcccaggctggagtgcagtgacgtgatcttggctcactgcaacctctgcctcctgggttggagcaattctcctgcctcagcctcctgagtagctgggattacaggtgtgcgccaccatgcctggctaatttttgtatttttagtagagacggggttttgccatgttggccaggctggtgttgaaggcctgacctcaggtaatccacccacctctgcctcccagagtactgggattacaagtgtgagccaccgtgcccggccaactgtagggaccagccccacagggtcggtgggtttttctccccatgtgcggagacgagagattgtagaaataaagacacaagacaaagaggtaaaagaaaagacagctgggcttgggggaccactaccaccaagaggcggagaccggtagaggccccgaatgtctggctgcactgttatttattggatacaaagcaaaaggggcagggtaaagagtgtgagtcatctccaatgacaggtaaggtcacgtgggtcacgtgtccactggacagggggcccttccctgcctggcagccaaggcagagatagacagggagagagagagacagcttacgccattatttctgcgtatcagagacttttagtactttcactaattttgctactgttatctaaaaggcagagccaggtgtacaggatggaacatgaaggcagactaggagcgtgaccactgaagcacagcaccacagggagacggttaggcctccggataactaatgattaatgatattcatatataatcatgtctgtgatctagatctagtataactcttgttgttttatatattttattatactggaacagctcgtgccctcggtctcttgcctcagcacctggatggcttgccgcccacagccaacaatgtgttttcaatatgctccccaaactacagcaaactcctcttaactcgggatttagggtgatgccctacttatgcctaactttatcaccagcttaaccctcatctcattatataggatgatattacttctaggaagattttctatgtatggagggtgcatcatttaagagtattttaggccaggcactgtggctcatgcctgtaatcccagcattttgggaagctgaggtgggtgatttgcttcagcccacgagttcaagatcagcctggccaatatggtgaaaccccatctctacaaaaaaatacaaaaattagctgagcgtggtgatgtgtgcctgtggtcccagttactctggaggctgatgtgggaggatcacttgagcccaggaggtcaaggctgcagtgagctgtgattgcaccacttcactccagcccagagtgagaccccatctctgaaaaaaacacaaaaaacaagaaaagaatactgcaaagaaccttggtaggggtgaattggaaaaagtagagaaatgtaatatttctttcctgctgtactcactgtaactgtgagaggatcggctcttttaaccaacagataagaaaggaaatattagctatgaagaaatgtctatcaagttgattttgacaacctagacacattaatctccttgcacttttagtgacaggaacccattagaaccttaagcagctgtctgaagtaaaaacaaagctctcaggtgatgaaccacctaatctccctgggtattcggatgtgggtcagtcacaggagtattaggtgtaaagccgctgcttctgggtagagcctccacttgtggctgcacagagggcacagagagcttttccttcagcccggagaagcttcctaagtgtgggcgccaccttgtgggacatacattgaactacgacgctatttctccaagaattaacaggacagcccctcccaccggtgtccttccaacgatgttgcatacaatttggctgtacatttggcaggcagtgtaatgagggaatcaaagaccaggatcacatactggaaagaattgaaaacagagactcccaacaaaaacttgtacacggacgttcacagcagcactattcacgacagctcagagatggaatcaacccaaatatcagtcaatagatgaatggacagacaaaatgtgacatatccatgcagtggaatattatttagccataaaaaggaaggaagtgctgatgcatgttgcgatgtggatgaaccttgaaaacatgatgctgagtgaaagaagccagacacaaaaggagaaggactgtatgatttcacttataggaaatatccagaacaggcaaatctatatagagagaaggtcgattgctgggggccctgggaagggaccaagggggagtgacttctaatggtggggtgcccttttggggtgatgaaaatgttttggaaccagatacaggtggtggttgtacaacattgtgaatttactaaatgcaaccaaattgctcacttaaaaacaacaaattcaggccaggtgcagtggctcacacccgtaatcccagcactttgggaggccgaggtgggcggatcacatgaggtcaagagttcgagactagcctggccaacatggtgaaatcccatctcggccgggcgcggtggctcacgcctgtaatcccagcactttgggaggctgaggcgggtggatcacgaggtcaggagatcgagaccatcctggctaacacggtgaaaccccgtctctactaaaaatacaaaaaattagccaggcgtggtggtgggcgcctgtagtcccagctgatcgggaggctaaggcaggagaatggtgtgaacccaggaggcggagcttgcagtgagccgagatcgcgccactgcactctatcctgggtgacagagtgagactctgtctccaaaaaaaaaaaaagaaaccccatctctacccaaaatacaaaaattagctgggcatggtggctggcacctgtaatcccagctactcaggaggctgaggcaggagaattggttgaacctgggaggcagaggttgcagtgagctaagatcgcaccactgcactccagcctgggtgacagaacgagactgtctcaaaaaaaaaaaaaaaaaaaagtggccaggtggtgccatggctcatgcctgtaatctcagcattttgggatactgaggcgggtggattacctgaggccaggagttcgagatcagcctggccaacatgatgaaaacccatctctgctaaaaatacaaaaaattggctgggcttggtagcatgtgcccagctacttgggaggctgagacaggagaatcgcttgaacctgggaggcagaggttgcggttagccaagattgtgccactgcactccatgggtgacacagagagactctgtctcaaaaaaaaaaaaaaaaaagtaaatgctatgttatgtgaatttcacctcaactgaaaaaaacagggtcccagagctggtcaggggaacttggacaaaccacacaacttctgagcttccatttcctcacaatctctgcagtcacttccaactctcatttggcttattctgtgaaggataaaacagagctgacatttgttcatttgtattgattttatttacatttttcaaaaggaaatagatgcagatggtatagaaagtttcagtgaaatgtaaatctgatgcccaatcctgtggccccaagaagtattaactgtgcacccactacatgccaggaactgtacttggagccttctcaagagcttcttaacaatattttcattttttatattttttaatgacagggtctaactccgtcgtccaggctggagtgcagtggtgcgatcatagctcactgcagcctctacctcctaggctcaggtgattcttctgcctcagcctcccaaatagctggtactacaagcatgtgccaccacagtcagctaattatttttggagagtcagggtttcactatgtagctcaggctggtcttcagctcctggcttgaagtgatcctcctgccttggcacatagaaggggttacaatatacatatattagagtgagagcatagatgtgatgcctggcgatatggcttacttatgagacagcacctgacctacagccatctatgactcctactgtatcttccatgccaggagtaagggtgaggatacctggcaataataaaaataataacctgagagtctaatggcttattttttgtagagatggggtctcactgtgttgtttaggctggtcttgaacttctgggctcaagtgatcctcccacctcagcctcctgagtagctgggattataggcgtgcactaccatgcatatatatatatatttttttttttttttgagagagagagagagagatggagtcttgctatgttgctcaggctggtctcgaactcctggcctcaagtcatcctgctggcttggcctctcaagtgctaggattacaggcatgagacactgggcacagccctaatagcttatttttaaagctatatcaaaatgtcatgcacctgaacatttgaagtaacctctctgatagtacggatatttatcccctcaaaatctcatgttaaaatgtaatcttcagtgttggaggtggggcaaggtgtgaggtgttaggatcatgggggtggatccctcatgaatggcttggtgtcctcccccatggtaatgagttcactcaagagctggttgtttaaaaggtgacgtggacctaatccctgttggactgaacaaaaggggacgaacacagcaataaagataaagaccaaagagtatatttggaagaaggggtcagggggctccttgcttctagtgaaaaagggccctgagctttagtgccctttgtatttattgggtaaaggagatagggagaagggggggtggttgtcggtcagcagcttgattcacagcaggctcacaagattgcattctttgaacagtaggctctagatgtctcagtagataacctcaaagagcatggcgccagggagtgattgccctcagcgaaccttctggcggctgaagcagaagtgagtttgcccacattctgcatttatgataaacagtttgctgtttgatcatatagcctcagtggaatgctgagttggtcacaacccatgggcattcagctctctacatttccccctttctgtttatgaattaattgaaagaatgtaaggccaggctgggcagctctcattttctgattggcagtccatccaattttacagactatgaacagaagacagagacaaaacaacattattccaaggactacatataagatgttaatgtggtgctttagacaggtccaagggttgaggctctccaggccttgctggaatttggtctagtcttctaaagaaggctgaaactcttgagtttgtttatttaaatcaagaattttgttttgtaattcaccgatatcaaaggtgatgttggatgtgcaagctccctgcaaatgggctttcacaaggtcccatggatactcactttggttatattctaagttggttacacaaatatgagtgtgattaaaatgatggtgcaattgctgttgcaattgcaagctttgtacttgttctcctaactgtagagccgtggatttcaacaatgccacttcagtttgtaactcagtgttaattttattctgaagtggccatgcttggttggctatacgcatccagttttccatgtactgagttgtttgaatagaactatgcaaagctacagaggacatcacaacggaagttattaatgtgaccaaggaaacaatagcaaaaattatcatgcctaaggctctatgggcacaatgagtaagttgagttagaagatgtttcatgaagtgcaaagcaggtgtggtagcccaaggctgggacagattaacaggaatccatagcccagggatgcgacccaaaattatcaaagtagagacattatgtgtttgcaatgtgctatgattaatgcagtgacataactggcaagatttacaggtcaattggatattgtttacctggagctggtccttcttagttgccaaaaaagacataaggattaaaaagacaaaccataaattgagtggtgatattctttacaaatgtaacattaagactgtgttgcttactattgctatcactggatagtatcccgccattcataaatgggagtgctgccttccataacatctcttggattggtcctttcctccctagataatgccactgaggaagaggcgggctaaagcctgctccatgtcaagcaatctgggtggcagactgggattagatcccggtgtggtataaagaagaagcattaaaatcttgccaccaatgccagcgaagtttgtgccatgatttctgattttcatgttttccatatagttgacctttaggtccccaatccacaatgtctccagttaacatagattgttttctagccagtgggtcaagacattgggtccatgtcttggggggtagtaactatcgaagggaatccattccatatagtcagcacgattagggtgattgggccgggaatggttggttagcacacctgttacattaatagaaccaagacttaataggcacatgacttttccataatgactcaaccattcttgagcttgaattataagacagctacagttaagcgatgtctttgtagtgatacacaaggggagtccttctagtggggtggtataattaatgacattgttctgagagtctaactgttctattttaaggggagttaggggtcctggagcccatacttgctgatcacgataaatctcaggaggagtgtcactccaaagcataggttgtactactaggggattgggaacatatgcccaaaatgtttttgcctctgcacagggaaaacataccacacaggacattatggctaacatggccaagaacatggaatcagggtgttttgcctggctctgatgctccagtagtttcccagcttcctgagtggtattcttgagttgcccccaggttatgggggttgatgtcgtcatgactccggtcggccttctctccatctttgcactctggctcagctggctcatggctcataccagagggaccaggcccatagttggccaccctgggttcctctagtctcccgttccatggtcacatgcaccttgagggcacccacacggcttgtccatctcccataaaaacacaagcataccctcatccccacgtcagtaaatccaacagacctttccattgtcttttttccgggggatttcaataacactttcggataaactttcctcttttcctctaacacttgccaatgtctttctgctggagtcttaccatctgtaccaggagtcaaaaaaatttaaagaaaataaggctaagtgtagttttgtttgaggtgtaactggtctcctatccctcttttctgtttttccctttttttttttttttttttttttttttttttgagacagagtcttgctctgtcaccaggctggagtgcaatggcacgatcttggctcactgcaacctccacctcctgggttcaagtgattttcctgcctcagcctcccaagtagctgggactataggtgcgcgtcaccacgcccagctaatttttgtgtttttagtagagacggggtttcaccatgttggctagatggtctcgatctcttgacttcatgatctgcccacctcggcctcccaaaatgctgggattacaggcatgagccaccgcacctggcccctttctgttttttcaacacgtgttgtaatgtttgatgtgccaactctataattccttgtcctctaggattataataattccttttttatgggttatagctcaaagctgtaagaattttgaaaagcatgactagtataagctggtccattgtcaggttttaattgtttagttatccccatatgagcaaatgatgacaaacaatgttgccgtacatgaccagctgtctcacctgtttggcatgtagcatgcagcatatgagaataagtgtctataattagtgaacatagctaagtttactaaaggctgctacatgtgtaacatccatttgccagatttcatttggagccaaacctcatgggttacaaccttctacaggtgtggctccagggacatgctggcaagtaggacaggcttgtattatagccctagcttggctgcgagagaaatggaacatgcgagtagggcagaagtactttggtgcagaggcttgagcttgctgaaacacagaactaatcagtttatctgctctatcattacctagagatagtggtccaggaagttgtgtgtgagagcgaatatgagaaatatgaaaaggagatgaaggagagccaatagttgtttgaagtcttagaaacaaattaagcagttctgggtctagtgtatttttaattgtagcagtttctatgcaactggctacatttacaacataagttgaattacagacaatgttgataggatctgcagctgtcagctgtaaaacctgaatgactgcaattaagtctgagcgctgagctgaaaccccagaggtcattattgtttgagtatgtttaggtccataaatagctgcatgagctttagaagagccatcagtaaaataagtctggccacctgaaataggcttgtgatgagtaatcacaggaagaatgaaagaatggactttataaaactgcaaaactttgtctgagggatagtggttgtctatggcacccacaaagtctgcaaaagtgatttgccaggcagttgacatttcccaagctgtggactgttgctgagagtctaaaggaacaataattttatctggatcatatcccataggcatctttgacctatgcctgcccatagtcacaatttgtgtaattaaagaaagatagacttgcaaagttttgactgattaggtagaaagagccattctattacggttacagatttgtctaagcattggcctaaaagtcctgttggagagtgagggataggaagaacaaacaaaagcaaaggtttttgtggctgtagccatgaggcatgtcattgctgtagcatctgctctacaagttgtaactccacttctgcctctttggtcaattgctgtggggaatttaaggaagaatctccttgcagggtttgataaagatgtgtaagttgataagttgcaatacctagcattggtcacagccaatttatatctcctaataattattgaaaatcatttaaagtctgtaacctgcctttatggagaactactttctgaggccgtacactattggggaacctgccccgatattcatgtaggttcttttctatttttcctaagcattggccagcttgagaaataaagggacagagtacaaaagagagaaattttaaagctgggcatccgggggagacatcacatgtcggtaggttccgtgatgccccacaagccgcagaaaccagcaagtttttattagggagtttcaaaaggggagggagtgtgcgaataggtgtgggtgacagacatcaagtacttaacagggtaatagaatatcacaaggtgagtggaggcagggtgagatcacatgaccacaggaccaaggcgaaattaaaattgctaatgaagtttcgggcaccattgtcattgataacatcttatcaggagacagggttttgagatcaaccttctgaccaaaatttattaggcgggaatttcctcttcctaagaagcctgggagcactatgggagactggaatctatttcatctctgcagcctcaaccataagagacaggtgcacctgggggggctgtttataagcctatacctccaggtgcgtattctctttctcagggatgttccatgctgagaaaaagaattcagtgatatttctcccatttgcttttgaaagaagagaaatatggctctgttctgcccagctcaccagcggtcagagtttaagattatctctcttgttccctgaacaattgctgttatcctgttcttttttcaaggtgcccacatttcatattgctcaaacacacatgctgtacaatttgtgcagttaatgcaattatcacatggtcctgaagtgacatacatcctcctcagtggacaggattaagagattaaagtaaagacaggcataggaaagcacaaaggtattgactggggaagtgataagtgtccatgaaatctttacaacttatgtttagagattgcagtaaagacaggcataagaaattacaaaagtattaatttggggaactaataaatgtccataaaatcttcacaatccacattcttctgccatggcttcagccagtccctctgtttggggtccctgacttcctgcaacagtacactcccctccataacaatagttcctaagtattagtatggggaagttgtttgcactttctctggagcaattttgagattccatttaattaaagcctgttttgtttctctgaataactgatgtaaaatttgatctgtaggagcggccaaaagaatatcatccataaaatgaatgatatacacagtgggaaacatatttcaaggctcctttaatgctcttcccacaaaatgctgacataatgtaggactgttaagcatgccttgaggtaaaactttccattgatagtgagaaacaggttctctatgattaatagaagacacagagaaggcaaattgaggcttatccttctcgtgttatggtatagtaaagaaacaatccttaagatctattcctacaagaggcctgtctcttggaatggctgctggggaaggtaaaccttgctgtaaggcacccattggtttaatttgcgcattaataactctcaaatcatgcagtagtcaccatcttccagacttttttggaataacaaataccggtgaattccaggggctgacttctctatatgtcctgcattcaattgttcttttaccaacagatgaagttgatctagcttctcctgtgttaggggccattgatccacccacataggtttgtcacaaagccattctaatggtaaggcagtgggtcgaggagaaatatcaatgatccccatcagaaatcctgacatccttgcccttttctgtttctccagttatagatatcgggttagggtttccttgtaggaatttccctaaaccttttccactctgatatcccatgtccttcaacattttaaatcctgggttatgaaagttttcatttgtaagtctcatatcccatgctgtaagtaattcttgaccccataaattgatagctatatttgcatcataaggctggaaagtacatgattgtccatccggaccaagacaaggtaaaatctcagcactctgttgaacacttttagctgctcctactcccactagggatgtggaggttagtctgagaggccatgctgggggccagtccttactggatattactgacacatcagctcctgtgtccataagcccatacaatttctttcctttactttgtactacacaggtgggtctattataagctataggttgtgaacatagatttctcatgtagttgtgctcccaaaccctttatttcctcgtttctccttttatggagaagggtgtaatttgcagggaataagcaataattgagcaatatattcttccggttcaaaaacccaaagatcttgtgacattaaaactacttgaatttctccttcataatcagagtcagctactcctgggactacagtaatgccttgcaagttaaggcagcttttgcctaaaattagtctatgtatcctgctggtaaaggtccccaaatgccaatgggaactttgataggtttgtctccaccaattaatgtaattctttctctgactggaagatctaatcctgcacttcctggtgttcctggggtgagggaatcaatgttcctcctgggacccacccctgaagtggggttgtggtctgaactgggaatgccctcattgtttgaggggcccgggtccaggcccccttctcgtttcctgacaggtggttgcagttttgatgaaattttgagcggcattgaatagcccagtgatttcctttgttacagtgaggacagagtcctggcgtttttttccgctgggccaggggggtggagggcaccacattataaggtcctttctgccctgagatcaggcagcattcctttttaaaatgtccagtttttccacaattataacattttcccactttagggtttgaccgttggctccttttagatttgtcaactactaaattagccattgcttgagctaaaattgcagagcaatgaagctcagtttctacatcctgacaagttctgagaaaatttcccaagttttgtacacctcacaggtgccagtgcacgtttacaatctgcgtttgcattctcaaaagctaaagttaaggttagcatttctgtggcagcggtatgaggaatttgatgcttcactgcctcttgtaatcttgcaagaaattgcacatagggttcctgtgacccttgcatgagatgtaaaaaggattgtactgggactctctcttctggaattgtggcccaggcgtgtttagcagcctgtgcacactgctgataagcaggatctgggagtgccatttgacattccaggtctgaataaagggccattacctaacagcataccctctgtaatgtctccgtgtccagaagcatgattctgtctagcctggtctgcacacatttcttgccaatttaaattccaagtcaggtatgcagtagcagacaaacaagtgcaagccaaatgttttacatcaaagggtagaaggcgcatagcaccaaatacagattctagcaatcctaaggtgaatgggctctgtatcccattattaattacacttaatttttcattccttcaacaacgtaaactctagtggggtgtgttcatgaataaactgctgtggattgtttggatcaggccttatggaaataggaaaagtgcaggcagcagagcataaaattctttgtattgaggtctctatttcggctactgaaggaggcggtacagatgtttctgcaactggagggggcggtataggccaatttttatcctccctctcctgttttttattttcaattggtgctgtgggtgggacaacagattctttcagatttttagactcagaacatgactcctgctgtccagcagaataaaaaggatataatggcagaaggacagtatgaactaaactcctagtggagaaagcagaagaatcaactttaagacctttttgatgagcctgttttaatccttctcctgctctgtgccaattttctacatcaggagtgcctgcctgtggaaaccatgggttatgcgtaataacctcctgcagcatcttagttaatgtctgagaattaacctgagcaccagattgtttcaacaaaactttaagcaactgcacgttttttttttcaacagacaaattctgccccatgttacctgattcagaaaaattcccattcccagtacttctttttttttttttttttttttgagatggtgtctcgctctgtcacccaggctggagtgcagtggtgcgatctcggctcactgcaagctccacctcccaggttcacaccattctcctgcctcagcctcccgagtagctgggactacaggcgcccgccaccacgcccagctatttttttgtattttttagtaaagacggggtttcaccgtgttagccaggatggtctcgatctcctgacctcgtgatctgcccacctcggcctcccaaagtgctgggacccagtacttctttaagagagcactgaccttatattgctcccagtacctcgttagggcactgaccttatatctgctgccagtggactcatcccagtgtccccattcgtcttgtcaatttcagcttctctgcttcagcagaccttcttcgttcatgtcctcagagtccctgttctggggtgccactttgatgcgtgaatggaccttggtggactgaacaaagggggacgaatgcgagaataaagataaagacaaaaaagcatatttggaagacatggtcgggggctccttgcttctagtgaacaagggccctgagctttagagccctttgtatttattgggtaaaggagatagggagaagggtggggggtggttggtggtcagcagcttgatttacagcaggcttgcaagactgcattatttgaacagtaggctctggatgtcccagtagataacctcaaggcatacagtgccggggagtgattgccctcagcaaaccttctggtggctggagcagaagcaagtttgctcacattctgcattcatgataaacagtttgctgtttgatcatatagcctcagtggaatgctgagttggtcacgacccacgggcattcagctctctatgaaaaggagcctggcatctctcttgctccctcctgccatcggatatgccagctccccctttgccttctgacaggctttctaagcttcctgaggcttcaccggaaacagaacagatgctagtgctgtgcttgtacagcctgcagaaccatgagccaaatcaatctcgtttctttataaattactctgcttcacagctgggcatggtggctcacatctgtaatcccagcactttgggaggccgaggtaggtggattactgaggtcaagagttcgagaccagcctgaccaacatggtgtaaccccatctctaataaaaatacaaaaattagccaggcatggtagggcatgcctgtaatcccagctacccaggaggctgaggcatgagaattgcttgaacccaggaagcagaggttgcagtgggccaagatcgtgccactgcattccagcctaggcaacagagccagaccctgtctcaaaaaaataaaaataaaaaattacccagcttcaggtattcttttatagcaatgcaaaacagactaacacactgtctttttttctcagctgtaaagtgagaataatcattgtgaaatgagatattaaaattctttggaatcatgcctcctcagcagctttacaaggctaccatgtggagttgttcagtgggtatagagtttcagttttgcaacatgaaaaagttcttgagactggctgcacaacagtgtggatatacttaacgttactgaattgtactcttagaaatcgttaggatgaagctgggcacggtggcttatgcctgtaatcccagtactttgggaggcagaggagggtggatcatctgaggtcaggagtttgagaccagcctggtcaacatggtgaaatcccgtctctactaaaaatacaaaaaattacttgggcatggtggtgggtgcctgtaatcccagctactcaggaggctgaggcaggagaatcgcttgaacccaggaggcggaggttgcagtgagccgagattgcaccattgcacgccagcctaggtgacagagcaagactccatctcaaagaaaaaagaaatggttaggctggtacattttatgctatgcattgtttctcagaataacaaaatttttaaggaaatgaccaccacgtgagatacctaaaaagctgtcccaggagagggatgatatttattctgtgagctctgagaggggagacaggagccagttagcaaccactgagtactccagccggcccacaaagccccagcatggatgctgcacctgagtgaggctggccttggagacctctgggccccttccagctcagaggtctgaaggatttgagctgagtcaggtcagcagatgctagaactttccattcacagactgtccagttttgctatatttgaggaacagaaacaggtcagaaagcagggcatgctctcatactactaggaaaacataatgtgatgcaacctttattattatcatttatagtattatttttaaattttgttatttatttattattttatttatttttttttgagatggattttccctcttgttgccccagctggagtgcacttgcacaatctcggctcactgcaacctctgcctcccagtttcaaatgattctcctgcctcagcctcctgagtagctgggactacaggcgtgtaccaccatgcccagctaatttttgtatttttagtagagaccgggtttctgcatgttggccaggctggtctcaaactcctgacctcaggtgatccgcccgcctcagcctcccaaagtgctgggattacaagtgtgagccaccgtgcccaatctttttatttattttattgagataaggtcttgctgtgttactcaggctggtcttgaactcctggccttccagagtgccaagattacaggtgtgagccaaggtgcccagaaggcacaacctttctggcaggcattcacaactaagaacttaatccaagagcacaattggccaagcgtgtgacgttagagaagagcactgttgttgtgaacttcaaccaatgaagatggcctgagaaaaacctgtgacagcttggcagaattcagaaggatgagacatcactccaactgagccacgaaaatatggtctggaggcagggaacataagcccaattcacacttcagctatgacagaaaatatcctctccatttacatagggcgtacaccgagtaaatgactttgtaactttacttcattctcttcttttacatagggtgtacactgagtaaatgaccttgtaactttacttcatcctctttatttacatatggcgtacaccaagtaaatgactttgtagctctacttcatcctcttcatttatgtaggacatataccaaggaactgatggaaacttctagagggtatttaaaccccaaaacattctgtaatggggcccttgagcccctatgctcagcctgctaccacactgtggagtatactttcattttcaataattttcttcatttctttccttgctttgtgcgttttgtccaattttttgttcaagacaccaagaacctggacaccctccaccggtgacacaaccatcaggcaataggggtacacctgggaaggacaagggacagttagtgcagtgaggaatgggaggcagggccgagtctctctgagctgggaggctgctccttctggcctctccaaagcctcactgcttccatttcccgaggcagataaggactgcctcagcctgggacaaaacgacctctctgtgtccacagccacccacaattggcataatgttccagtctcacttcccaggagcctctgaagggcccagcttgggtcagatggccattcctgggccagtcagctatggccaggggatggggtcacatggcacccacatgaagcaaggcctatcccttaagtaggggctgttgagtgacaggaaccgtggaggtgttgacagccgctcctcaaagtatggtcctagactgagcagcagcacttacatcactcggcagcttcttagcaatacagaatctcaggccccaccccacacctaaggaatcagaatctgcttatttatttatttattttgatgataggtgcatgccaccacacttggctaatttttgtatttttagtggagtcagggtttctccatgttggccaagctgatctcaaactcctgacctcaagtgatccacccgcctcagcctgccaaagtgctggaattacaggcgtgagccaccgcacccagcctgtagcccacatattgatcctgtctgttctttttttctttttattattattattattattatactttaagttttagggtacatgtgcacaatgtgcaggttagttacatatgtatacatgtgccatgctggtgtgctgcacccattaactcatcatttagcatcaggtatatctcctaatgctatccctcccccctcccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacttgtgcatgtgtctttatagcagcatgatttatagtcctttgcgtatatacccagtaatgggatggctgggtcaaatggtatttctagttctagatccctgaggaatcgccacactgacttccacaatgcttgaactagtttacagtcccatcaacagtgtaaacatgttcctgtttctccacatcctctccagcacctgttgtttcctgactttttaatgattgacattttaactggtgtgagatggtatctcgttgtggttttgatttgcatttctctgatggccagtgatgatgagcattttttcatgtgtctgttggctgcataaatgtcttcttttgagaagtgtctgttcatatcctttgcccactttttgatgggattgtttgtttttttcttgtaaatttgtttgagttcattgtagattctggatattagtcttttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaacccatcatgaattaatttttgtataaggtgtaaggaagggatccagtttcagctttctacatatggctagccagttttcccagcaccatttattaaataggaaatcctttccccattgcttgtttttctcaggtttgtcaaagatcagatagttgtagatctgtggcattatttctgagagctttgtcctgttccattgatctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaattttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctcttttatttcattgagcagtggtttgtagttctctttgaagaggtccttcacatcccttgtaagttggattcctaagtattttattctctttgaagcaattgtgaatgggagttcactcatgatttggctctctgtttgtctgttactggtgtataacaatgcttgtgatttttgtacattgattttgtatcttgagactttgctgaacttgcttatcagcttaaggagattttgggctgagacaatggggttttctagatatacaatcatgtcgtctgcaaacagggacaatttgacttcctcttttcctaattgaataccctttatttccttctcctgcctaattgccttggccagaacttccaacactatgttgaataggagtggtgagagagggcatccctgtcttttgccagttttcaaggggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttagttctgtttatctgctggattacatttattgatttgcatatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcacaaaatgagttagggaggattccctctttttctattgattggaatagtttcagaaggaatggtattagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcttgctttctctcgtgggcatttagtgctataaatttccctctacacactgctttgaatgtgtcccagagattctggtatgttgtgtctttgttcttgttggtttcaaagaacatttttatttctgccttcatttcgttatgtactcagtagtcattcaggagcaggttgttcagtttccatgtagttgagcggttttgagtgagtttcttaatcctgaattctagtttgattgcactgtggtctgagagacagtttgttataatttctgttcttttacatttgctgaggggagctttacttccaactatatggtcaattttggaataggtgtggcgtggtgctgaaaaaaatgtatattctgttgatttggggtggagagttctgtagatgtctattaggtccgcttggtgcagagctgagttcaattcctgggtatccttgttaactttctgtcttgttgatctgtctaatgttgacagtgggtgttaaagtctcccattattattgcttgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgtttggtagatctttctccatccttttattttgaccctatatgtgtctctgcacatgagatgggtttcctgaatacagcacactgatgggtcttgactctttatcaaacttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagtggctggtacaagtttttcctttccatgtttagtgcttccttcgggagctcttttagggcaggcctggtggtgatgaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatctgaatgttggcctgccttgctagattggggaagttctcctggataatatcctgcagagtgttttccaacttggttccattctccctgtcaatttcaggtacaccaatcagacgcagatttggtcttttcacatagtcccatatttcttggaggctttgttcatttctttttattcttttttctctaaacttcccttctcgcttcgtttcattcatttcatcttccatcactgataccctttcttccagttgatcacatcggctcctgaggcttctgcattcttcacgtagttctcaagccttggctttcagctccatcagctcctttaagcacttctctttattggttattctagttatacattcgtccaaaattttttcaaagttttcaacttctttgcctttggtttgaatttcctcctgtagctcggagtagtttgatcatctgaagccttcttctctcaactcgtcaaagtcattctccatccagctttgttctgttgctggtgaggaactgcgttcctttggaggaggagaggtgctctgctttttagagtttccagtttttctgctctgttttttccccatctttgtggttttatctacttttggtctttgatgatggtgatgtacagatgggtttttggtatggatgtcctttctgtttgttagttttccttctaacagacaggaccctcagctgcaggtctgttggagtttgctagaggtccactccagaccctgtttgcctgggtatcagcagcggtgtctgcagaaccgtggattttcgtgatccgtgaatgctgttgtctgatcgttcctctggaagttttgtctcagaggagtacccggccgtgtgaggtgtcagtctgcccctactggggggtgcctcccagttaggctgcttgggggtcaggggtcagggacccacttgaggaggcagtctgccccttctcagatctccagctgcgtgctgggagaaccactgctctcctcaaagctgtcagacagggacatttaagtctgcagaggttactgctgtctttttgtctgtgccctgcccccagaggtggagcctaccgaggcaggcaggcctccttgagctgtggtgggctccacccagttcgagcttcctggctgctttgtttacctaagtaagcctgggcaatggcgggcacccctcccccagcctccctgctgccttgcagtttgatctcggactgctgtgctagcaatcagcgagactccttgggcataggaccctccgagccaggtgcggggtacaatctcctggtgcgccgtttcctaagcccgtcggaaaagcgcaatattcgggtgggagtggcccgattttccaggcgctgtctgtcacccctttccttgaccaggaaagggaactccctgaccccttgtgcttcctgagtgaggcaatgcctcaccctgcttcggctggcgcatggtgcactacacccactgtcctgcgcccactgtctggcactccctagtgagatgaacccagtatctcagatggaaatgcagaaatcactcgtcttctgcggtgctcatgctgggagctgtagaccggagctgttcctattcggccatcttggctcctcctccccatctgttctttttttcttgagacagagtcttgccctgtcacccaggctggagtgcaatggtgtgatctcagctcactgcaacctctgcctcccgggttcaagcaattctcctgcctcagcctcccgagtagctgggattacaggcacgcactactgagaggtgacagtgtgctggcagcccttgcagccctcgctcactcttggcgcctcctctgcctgggctctcactttggtggcacttgaggagcccttcagcccaccactgcactgtgggagcccctttctgggctggccaaagccggagctggctccctcagctttcagggaggtgtggagggagaggcgcgagcaggaacccgggctgcgcgcggggtttgcgggccagctggagttccaggtgggcgtgggcttggcagtccccacacttggagtggccggccagccctgccggccccggcaatgaggggcttagcacacgggccagtggctgcagagggtgtgttgggtcccccagcagtgccggcccaccagtgctgtactcgatttctcgccgggccttagctgcctcccgtcggggcagggctctggacctgcagccccccatgcctgaacctccccccactccctgggctcctgtgtggcccgagcctccccgacgagcaccaccccctgctccacggcacccagtcccatcaaccacccaagggctgaggtgtgcgggcgcacggcactggactggcaagcagctccacctgcggcccgggtgcaggatccactgggtgaagccagctgggctcctgactggtggggacttggagaacctttatgtctagctaggggattgtaaatacaccaattggcactctgtatctagctcaaggtttgtaaacacaccaatcagcaccctgtgtctagctcagggtttgtgaatgcaccaatcgacactctgtatctagctgctctggtggggacttggagaacctttgtgtggacactttgtatctagctaatctagtggagaggtggagaacctttgtgtctagctcagggattgtaaacgcaccaatcaacaccctgtcaaaacagaccaccactcagctctctgtaaaatggatcaatcagcaggatgtgggtggagccagataagagaataaaagcaggctgccggagccagcagtggcaacctgcttgggtccccttccacactgtggaagctttgttcttttgctctttgcaataaatcttgttgctgctcactctttgggtccacactgcctttatgagctgtaacactcaccgcgaaggtctgcagcttcactcctgaagccagagagaccacaaacccaccagaaggaagaaactcggaacacatccgaacatcagaaggaacaaactccggacacgccacctttaagaactgtaacactcaccgcgagggtccacagcttcattcttgaagtcagtgagaccaagaacccaccaattccggacacactaccatgcctgagtaatcgtatttttagtagagacggggtttcaccatattggccaggccagtcctgacctcgtgatccacccatcttggcctcccaaagtgctgggattacaggcgtgagccacggtgcccaaccttatttatttttaattttttaattttaaaaaattttttggagacagtcttgctctgtcgcccagactggagtgcagtggtgtgatcttggctcactgcaacctctgcttcccgggttcaagcgattctcctgcctcagcctcctgagtagctgggattacaggcaggcgccatcacgcccggctaatttttgtacttttagtagagatggggtttcaccatattggtcagactagtcttaaactcctggcctcaagtgatccacccacctcggcctcccaaagtgctgggattacaggcgtgaaccactgtgcccggccaaatttagtactttaaaaaacatttaaaagtctgtttctgtgggtcgggagtttgggtatggcttggctgggtgcgcctggcatagtctctcacggggccacgatcaagttgtgggctggggatgccatcagctaaaggctcaatttggtgagtatcctttctaagctcatgtatgtgtgggtagtccttaggtactcactggcagctggtaagagatgttagttcctcgccatgtctgtaatggactgaatagtatattgccccaaaattcatgtttgcacagaagctcagaatgtgaccttatttggaaatagggtctttgcagatgtaattaagatgagatcgtgctggatgatgttgggccctaaatccaacgactgttttattaagaggagaggacacagagagacacacagggaaggccatgtgaagacagaggaagagcctggagtgatacagccaaagaatgccaaggactgtctggagccaccagaaggaaggagtcttccctgtagccttcagagggaacatggctttgttgacacttttttttttttttttttgagacagtctcacactgtcgcccaggctggagtgcagtggcgtgatcttgactcactgcaagctgtgcctctcgggttcacgccattctcctgcctcagcctcctgagtcgctgggactacaggagtccgccacccgacctggctatttttctgtatttttagtagagatggggggtttcaccgtgttagctgagacggtctagatctcctgacctcatgatctgcccaactcggcctcccaaagtgctgggattacaggcatgagccaccgtgccccaccacttttttttttgagatagagtctcgatctgttgcccagactggagttcacaggtgcggtctccgttcactgcaacctctctgcctcccgggttcaggtgattctcctggctcagcctccagagtagctgggattacaggtgcctgccaccaccactggctaatttttttatttttatttttagtagagacagggtttcaccatgttggccaggctggtctcgaactcctgacctcaagtgatctgcccgctttggcctcccaaagtgctgggagtacaggagtgagccacagtactcggcctctgctgacacattcattacagacttctagcatctggagctgtgaggataaacttctgttgttttaagccacccaatttgtgatactttgttacagcagccttaggaaccaagtgagctggcttccctaagagcagataagtaaaagagtcagagagggccccaatggaagccagagtttttctgctacctaatcttgaacatgacatctgttcactgaaagcaaaccacttgatccagaccacatgcagggcgagaggactacataagatcataaataccaagatgtgagcatcactggaggctgtgaaccagggctgccacaccagcaaaaaacagaggaatttcattggaagaaaccgctttcttcagggttctgccttctccattcattgattccttcgacaaataaatttattaagtacctacaatggactgggtattagggacatatgaccaataagacaaataagattctttcccttgttgagattatttagttacaggataataggaacatctgatttagattaggaaaggagggtatgggcaaggcatgcctttctgaaaaaacattatcaagaattggccaggtgtggtggctcacgcctgtaatcccagcactctaggaggctgacgtgggcggatcacctaaggtcaggagttcgagaccagcctggccaacatggtgaaaccctgtctctactaaaaatacaaaaattagccgggcgtggtggcgggtgcctgtaatcccagcaactcgggaggctgaggcagaagaatcacttgaactcaggaggcggcggttgcagtgagccgagatcgcaccactgcactccagcctgggggacacagtgagcctccgcctcaaagaagaataaagttgaagaatgagtagaaaccaggctgtgtgtgtatgtgtgtgtgttatgagggaagcatgagtttctaggtagtgggaaagcacgtgcaaataagtcggtaagttgaacagctagactaaaagctgcttgagagcagggaccttgtctcttcattgctgcatctctattatacgacatcatctctgcatctctattacaagacatagagcctggcagagagaaattcttactggatgaaatgaatgaataaatccaaggcatcttctataggttagtgcaaaaatgactgcagtttttgccattatttttaaatggcaaaaaccacaattacttttgcacgaatatttcctgttacagatgtcaactgaagtcatttaaaaattttctcccaaagttcatcgcgggatcattgctcttattcatattaggtagcataggcaaagctgctagaacaaaagactcaaagtaagtaaacggtcaacacaagtttatttattctcacataacaatactgagtggatatttaggtcagtaaggcacagttctcctccacttaggaatctcccatcttcaggccttgccttctccagagcctggtcaccatctgcttccagttggcagaaggagtaacagcacaggggagcacctgttggaggtctgtatgggccaggcctggaaactgcacacctcttctggtcactttccgctggggagagcataggcacagagccacacttaaattttactttgaggaatgcagtgtaggtgtatgtccgacaaagaaaacaataattcggtagacaaataagtctccactccaatattcaattacttacttaacttatgctctggtatgtctcaaattaacctagatagaaatgaactctgaatcttccacttccatcaagtttttcactcactcaatggcatcattatccatccagttgcttaagcatacatttgaaagttatccttggtctgtttcttatccttcccttccacatctaatccttcaggaagtcctgacaatgttacctccaaaatatgtcttaaatccatcttctcagccaggcacggtggctcacgcctgtaatcccagtactttgggaggccaagggaggtgaatcacttgaactcaggggttggagagcagccggggcaatgtggagagacccaatctctacaaaaaaaatacgaaaaattagccaggcatggtggcatgcgcctatagtcccagctactcaggatgctgaggtgggaggatcgcctgagcccaggaggtctaggttgcagtgagctgtgatcacgccactgcactctagacagtgggaccgtttaaaaaaaaaaatccatcttctctacacctttaccgccacctccttagttcagacagtgtaataatctctcatctgcattattctccaatagcctcctaatagctctgtttccattcttgctttcctatattctattctctacaaagcagagtgatcttttaaaacaaatttgttcacatcactctttactttaaaaccttacaatagcttagaataaaatccaaagtcctgattatgacccccaaaggccacatatgatgcagcccctgcccacatctccaacctcatcctttttatacttttttttttctttttttgaaatagagacggggtttcgccatgttggccaggccggtctcgaactcctgacttcaagtgatccgcccgccttggcctcccgaagtgctgggattacaggcgtgacccaccgcgcccagcctccaacctcaccctttatcagtctcctcctactcgatctactccagctacaatgaccttcttgctgattcttgaacatatttagcttatttccaccttaaaatttctacccatctgcccagaaatctttccttggatttccaatagccagccctttctcattcctcaggggtctcagcttaaatgttacctcctgagattccttccttaatcatctaatacgaagaagtccccacatccagttattctcttacctcagcatcctgtttatgttcttcttagcatcagactcgggctttttcctgtttattacctacttcgttttcctgaaagatccatgtgccggtaccatgtgttgttcctactgtttctccaatgtctagtagatttggcacatactgatgtgcaattaatacgtgaatgaagaaccattgacagacgattagtcaaaagctcttgcaaagccctttgataggttatcggtggagagtagggagcacaaacctggggtcccattctagcttgaccacttctcggctgtgcacaaactagtctagctctcctgagcctcagttacctattttgcaaattagggatgggaacatccatacctcacgacgccaaacggctaccttgtaaagacgaaaggaggaaatgcaggaaataactccacgtaaggttaatgctccgtaaacagagctgctactgctattatatattctatacaatcctgcgcccttaacggcaggaccctttcagtgcttcagtcctgtcttctctctcctgggttgacctccacagatcctctcagaagagcgttttccaggcgtgaatctccgcagagtggagataaaggctgaggccccaacgcacgcgcactcacgcgagtccgggcctatgacgtcattagcgcagcgccatcgccgcggaaggcccaggggcctgtcctgtatgcggcgtgtcttagggaggcccaggcggacgcctgcaagtcgggtgcgcggttcgggggcggctcggaaaccccagcggaaggcagcaaggggcgcgtggggccgtggagtcacgaagctgggcggcaggaggggcggcctggagctcccgcggggcacagcgcgtgcgtgagggcggccggcggggctgcccggcgcgggtgtcccggcgatgtgtggcgctgaggcggcggcgggagcagcggcgccgagctctgcttcggcttcggcttcggcttcgcggcggtgcaggcggcggaggcggaggcgcaggctcttctttaggacctggcgagcccaggtctaagcggcggccccgcgaggcccttgcacggcgccccgggtcgaggccctccccgcctcgccctaccccaggagcctgcctccccagctggggatgaggctaggaggcggccgcgtggggcccagcacaaagacctgtccccaggggccgccgcctccgccgctgctgctgccgccagcctagagccgcccgccgaagcagagccggcgccggggtcctcatccccaccggtcccgaggggcggctgctgcccgtcgccacgaggcccaggggcccgagtgccgagccctttgctccctcggccgcgcggggacagggctgctgagcagcctccgcctctcccggctgtgggggccccactgagtatgtcggaggagagcgacatggacaaagccatcaaggtaagggggaggtgccccctcttcccccgcgttgtcctgtggcgttcttctcggctctagcctcaaaaagcagggagattttgcagtgagaggttccatcgactaccgggtttcggcctcccccggattccgtggatcgcgctttacagccctggggccaagggttatgggtgtgggtgtaggtgtgtgtccgactcccgccagcttccctggtgagtgtgatttgtgctcagctggaacagaggtgagtggcctggagacactattaagtgtcaatgaatgggacgaagagagccctactactactactacacgtttcgatcactccccaaggccgccagcatttgcttccggatggtctacagaacttggagagttggaatttatccatccctcccgatttgtttgaaatcagccttctggaaatctgcagttggaaaaaggtggttcgccgtacaaaacctgtcctttggggaataggttgtcctcacttttccgtgtattctcccctttttctttttcctcttctttctcctaggaagcattgagtttacttaggaaaagttaacagttcctgtgacttaactgcacttaaaccaaaagaaaagcaaatgtgtgttcgaaaattacacaaataaaataagttttctaaaacctgtttttaactttttttttttttaaaggcacattttgcccactcagggccagttatctgtcttgacagctgtagctaagaaattagtcttatgaaaattaaacattgacgcttaaagtttgatgtattatttacttatttgtagtgttaagtcagcccagtgcattgaataatttcattttatcttgaaggacaggcatctattggcagcttggggttattttccccttcaagacagttactagtaatgattaagaatttacatttctaccaattctttaggtggtgtatatagtttctcaaaatcatcaagtcattccaaagaaacttaaccctttaaaggaggcatcaacatataacatatacattaaggaagaccaggttttttgtctgtttgtttgtttttgagacggagtctcactctgtcgcccaggctggagtgcagtggcccgatcttggctcactgcaagttccgcctcctgggttcacgccattctcctgcctcagcctcccgagtagctgggattacaggcgcccacccaccacgccctgctaattttttcttttgtttgtatttttagtagagacggggtttcaccgtaatagccaggatgggctcgatctcctgacctcgtgatctgcccgccttggcctcccaaaatggtgggattacaggcgtgagccaccgtgcctggcccaaggaagacgaggttttaaatcataaagattctaaaagactgccttgacatatccttcttttgttttgggttttgtttttttttttgagtcggagtctggctttgtcatccaggctggagtgcagtgggatgctcttggctcactgcaacctccacctcccaggttcaagtgattctcctgcctcagcctccccagtagctgggactacaggcacgtgccaccacacccagctaatttttttgtatttttagtagaggtggggtttcactgtgttagccaggatggtctccatctcctgacgtcatgatttgcccgcctcggcctcccaaagttctgagataacaggtgtgagccaccgcgcccagccttggtttgggttttattggcacagaggcatgatatgccgcctgaagttatttaattgggttgtgaatcaaagcgtatgtggccagtttttaaacattgtctcctgtgtgccagatggtgtcctagacacaaatggtacaagccagactcctagatgtccctactgtcatgtagcttatattctagagggtggggttactgctaggtggttttaattaagtgtggaaagggtgaggagtactgtgttaaatagggtagtccgaggaggtgacactgtagagttctgatggaaatgcgagagcaagccaccactgtctcagggaagagtataacaggcagtgggaatagcaaggacagaccttgaggtagaagcaggtgtagtgtgatgtaggaagagcaaggtggctggaatgcagtgggtcagtggagatgatgtagagcagcaatgggaagcaaggcacttagggccttgtaggccatcgtaagaactttgggtttgaccctgattaaaaggggaactataggagagttttgaacagaagagagacatagttccaggagataagtatacaaatagggcagcaatgtcacttagtggttgttatagcttctctaggtagactcagttgaaatctcaccctatgtttttttttgatacagagtctcactctgtcacccaggctggagtgcagtggtgtgatctcggctcactgcagccgcctcctcccaggttcaagcaattcttgtgccttggccctccgagtagctgggactacaggcgcacaccaccacgcccggctatttttgttgttattgctattttgttgttattgttgttatattgctagaaaagatggggtttcaccatgttggccaggctggtctcgaactcctgacctcaggttatctgtccgccttggcctcccaaagtgttgggactacaggcatgagctaccacgcccagcccagcgtttctattttattagccgtgtgtctgagtacgacatcacttcacttctgtctcgttagtttcctcatctgtagatgggataaaagcactcccagcttatagggttttttgttggtttgtttgttagtttttgaggattaaatgagcagatatacccaaatgtgcttataataatacctaggccaggcacggtggctcacacctgtaatcccagcactttgggaagcctaggcgggcggatcacctgaggtcaggagttggagaccactctggccaacatggcgagacccccgtctctactaaaaatacaaaaattagccgagtgtggtggcacacatctgtaatcccagctactcagaaggctgaggcaggagaatcgcttgaacctggggggcagaggttgcagtgagctgagatcatgccactgcactccagcctgggcgacagagttagactccttctcaaaaaaataataatacctaacagcaagagctcaatgaatattagctcatagcaacttaagggtgctttagaaagagttgtttttttcacttgactcttgcccagcccaattttcttaaaatttttttagcttttcttcactcagaagtactcaataggtcatggtgaatctacgctaatttgggcatttccagccaatacctattggtggacttgaaaatcagtactgattaggatgtactgctttggaagcaagccagcattacatcaaataaaaaacatttggtctgtggcattgtgttgtattcattgttttgctttttggggggtgttcagcagatggtgagcactgagacaaacctgtagtgttcagctggaaagctattttcctggcctccagccacaacactttaactcttgctgccagactacctgagagtgggttgattggactttaagatctcatcctcccttatccacggttttgctttccacaattttagttacatatggtcaactgcagtctgaaaatattaagtggaaaattccagaaatcaataattcataagtttctttttctttttttttttttttgagacggtcttgctctgatgcccaggctggagtgcagtggcgtgatcttggctcactgcagcctctgcctcctgggttcaagcaattcttctgcctcagcctcccgagtagtagctgggattacaggtgtgcaccaccatgcctggctaatttttgtatttttagtagagacggggtttcaccatgttggccaggctgatctcgaactcctgacctcatgatccaccctcctcggcctcccaaagtgctagagttacaggtgtgagtcaccatgcctggctctcataagtttcaaattaagcactattctttgtagtgtaatgaaatctcttgccatattgcctgggacatgaatcatcccagcatgttcacactgtatatgcttcctatcctgtagttacttagtagtcatcttggttatcagaacaaacagtatgtatagggctcactactatccaagatttcaggcatccactggaggtcttggaacatatcctcccttatctgtggggactactgtactcttaaaaactttaggataaggggctgggcgtggtggcttacgcttgtaatcccaacactttgggaggctgaggtgggtagatcatttgaggtcaggagtttgagaccagcctggccaacattgtgaaacccccatctctactaaaaaaaacaaaaaaaaattagctgggtgtggtggcaggtgtctgtagtcccagctactcgggaggctgaggcaggagaatcacttgaacacgggaggtggaagttgtagtgagctgagattgctccactgtactccagcctgggcgacagggtgagactctgcaaaaaaaaaaaaaaaaatttaggataaggtcaaatggctgtaagtggaggctctatcttctattccctgtatcttctattacctgtatctctagtcccatagccccatgactttgctacacccaaggcacttagctaaatctggagagtgggcattttgggattagggattcttacatattgttttctattatgtatagcgagtcgttaatatttgatggagtttgtgaaaatccatttccttagtttttaaaattaaaaaaaattgtatagtttgtacatcataaaaatacccccaatataaatgtacagttcagtacattcagtgtaaatgttcagtaatttttagtaaatttatagaggcatgcagccatcatcacactctggtgtataatatttccatccctgctagaaagttccttctgcctggttgcagtcagccctgttcccattcctcgccccttacggccactgatttgctttgtcactatagtttttgccttctccagaaattatttccttaatagcttaccaattttatgtgtttgatttcttagcaaatttctcaggttcatccacgttagtgcatgctttagcagttcattctttttattgagcagtagtctttattgcttatccattctcagttataggacatttagattatttctagtttttagctgttgtgaataaagtgataaaactgtacaagttttgtgtgaatatatgtattcatttcttcagtgtagatagctagatgtggaataactgggcagtatagtaaatttatgtttaactttttaagaaaccaccgaactgttttccaaagtggttgtaccattatacattcccactggcagtgtttgaaagtcctgtttttttctaccatcttcacaaatattaggtattttcagtcttcctattttagtccttctggtgggtgtgtagtggtattatgcttttaatttgcatttccctaacgactaatgctgttggacatctttttgtgtgcagatttgacattcatgtttcttttctggtgaagggtctgttccaatcttttgccccatttttttttttttttttttgagatggagtcttgctcagtcgcccaggctggagcacagtggcacgatctcggctcactgcaaccaccgtctcccgggttcaagtgattctcccgtctcagcctcccgagtagctgggattacaggcacctgccatcatgcccagctaatttttgtattttagtagagatggggtttcaccatgttggccaggctggtcttgaactcctgacctcaggtgattgcccaccttggcctccaaaatgctaggattataggcatgagccactgtgctcggcctctttttgcccgttttagaattgcttttttttgttttgagatggagtctcgctttgtcactcaggctggaatgcagtggtacgaccttggctcactgcaacctcttcctccggggttcaagcgattctcctgcctcagcctcctaagtagctgggattacaggcatgcgccaccatgcccagctaattttttgtatttgtatttttatttttttatttattttttgtatttttagtagagatgaggtcttcaccatgttgaccaggtggtctcgtacttctgacctcaagtgatccgcctgccttggcctcccaaagtgctgggattacagatgtgaaccaccatgcccagcctaaaattgatttctttgccttattgagttataggattatttatttatttttttattaatttttttagagatggggtctcacaatgttgcccaggctggtcttgaactcctgggctcaagcgatctgcctgcctcagcctcctgaagtgctaggattactgcacctggccaagagttcttttttttttctttcttttttttttttctgagacaaagtcttgctgctcttgttgcctaggctggagtgcaatggcacgatcttggctcactgcaacctccacctcccgggttcaagtgattctcctgcctcagcctcccaagtagctgggattatgggcatccaccaccatgcctagctaatttttgtatttttagtagagactaaaaattttagttttgccatgttggccaggcttgtcttaaactcctgaccttgtgatctgcctgcctcggcctcccaaagtgctgggattgcaggcgtcagccaccgcacctggcctagagttctttataaactgaataaaagtcatttatcagctatgtgattggcaaatattttctcccagtctgtggcttatcttttcattttataatggtgtcttttgaagagcaaaaggttttaaattttatgaagtccagtttagcacatttttttctttttcttttattttgttaggacagtctcactccatcacccaggctggagtgtagtgatgcgatcacagttcgctgcagccatgtccttctaggcttaagtgattctccctcctcagcctcctgagtagctgggaccacaggtgtctaccaccatgtttggctaattaaaataacttttttttttgtagagacacgggtcccactgtgtagcccaggctggtctccagctcttgagctcaagcagtcgtcacactttggccttccaaagtgctagaattataggcatgaaccaccacgactggttgtgaaatatccttttttttttcatagatggagacttgctctgttgaccaggctggagtgtagtggcgtgatcttggctcactgcaacctctgcctcccaggttcaagcagttctcctgccttagcctcccaagtagctgggattacaggtgggtgccaccatgcccgcctaatttttgtctttttaatagagacggggtttcaccatgttggccaggctggtctcgaactcctgaccttgtgatctgcctgcatcggcctcccaaagtgctgggattacaggcatgagcaactgtgcctggccaaaatacctttttatttcatattgaagatgcagcttttacgtgggtgcgagagtgctataagaaaggcataactatagactctaatatttttcgagaaaaagtcattgtgtcttaaaaggaaggtaaaggatctaaagttggagaatttaatgccagcaaaggatggtttgataactgtagagaggtttggcttaaaaaaatgtcagggtaacaggagaagcagcttctgctgaccaagaggcggcaaacaagttcccagatgccattaagaaaatcattgaggagaaaggatatctgcttgaatgggtttttaatgcagacaaaaatgccctgttctggggaaaacaatgccacaaaggacatttatgagtaaggaagagcagtgagtgccaggatttaaggcaggaagagctaggttaactgccgttttgtgtaaacacagtcaagtttatgatcaggactaccctggtctataaagctgctaacctctgagccttcaagggagaagataaaacaccagctgccagtctgtttttaccaaaagaaagcctggataatgagaacccattttcttttttttttttttttttgagaggagtctcgctctgtggcccaggctggagtgcagtggcacgatcgcggctcactgcaagctctgcctcctgggttcacaccattctcctgcctcagcctcccgagtagctgggattatagttgcctgccaccacgcccagctaatttttgtattttagtagagacagggtttcagcatgttggccaggctggtcttgaactcctaacctcaagtgatccgcctgcctcggcctcccaaagtgctgggattacaggcatgagccaccgtgcccggccaggactgccttttaaagtttttttgacacaatgcccctggccactgagaatcccatgagttcaacactaggctttgaagtggtctacttgtccacaaacagtgtctctaatccagcctgtagatcaggaggtctcaaggactttttgagaaagagtctggctctgttgtccaggttggagtgcagtggggtgatctcagctcacttcaacctctgcctcccaggttcaagcaattctcatgcctcagcctctcgagaagctggaattacaggcatgctccacaatgcctggctaatttttgtatttttaggagagatgaggtttcaccattttgcccaggttggtctcgaactcctggcctcaagtgatctgcctgcctcagcctcccaaagtgctgggattacaggcttcagctgccgcacctggtccaggactttcaagactcattacatgggatactctggaaaagattgttaacaccaaggaagagaatcctgatagaatgtagtgaaagtctagagggattacaccactgaagatgccattgttatggaaaaagctgtggaagccatcaggcctgaaacaataaattcctggtggagaaaactctgtccagatgtgcgtgacttcataggatttatgacagagctggttaaggaaatcatgaaagagattgtggatatggcaaaaaaggtgaagggtgaagagttttaaggtacagatcttggagaaattcaagagctaatagacaccacacctgaggaattaatagaagatgacttgatggagatgagtgcttctgtgccagacagtaaggaataagatgtacaagaaacaggggcaggaaaaaattgacattagacaatttgccagaagggttccaattattcaagacttcctttagctttgtttatggaatatggaatggaaccttctgtgatactggcactgaagtgaaagcaaatggtggaagaaggattagtattgtatagaaatgtttttagagaaatggaaaagcaaaaaagtcagacagaaatgaggatgtatttttgtaatgttacaccagatgtgcctgcctctcctgccttcctttccatgcccttcacctcttctacctctgctgccccaagacagcaagaccaaccaactccttttctttctttccctcagtctactcatcctgaagatgggtgaagacctttatgatgatgcacctccacttaatgaatagcaaatatgttttctcttatgattttcttaataacattttttctctatcttactctattgtaacaatatagtatgtaatacataaaatatgtgttaattgactttctgttgtcagtatggttaacaggctattagtagttaaattttgggggagtcagaagttatgtgcagatttttgactgcccagggtgtcagtgcccttaaccttcacgttgttcaagggtcaagtatattatcttatctattaacgtagtagagctttccatttctttagggcttcttcagtttctctaagcagtgttttctagtttccagtgtataaatctataaatcttgccttttgataaatttattctttttttttgagacagagtctcactctgtctcgcaggcttaagtgcagtagtgcaatctcggctgacggcaacctctgcctcccaggttcaagcaattctcctgcctcagcctcctgagtagctgggattacaggcttgcttcaccatgcctggctaatttttgtattttcaatagagacagggtttcaccatgttggccaggctgatcttgaactcctggcctcaggcaatccacctgccttggcctcccaaagtgttgggattacaggcatgagccactgtgtccagcctgataaatgtattcctgttttcttcttcacgcctgtaatcccagcactttgggaggctgaggtgggcggatcacgaggtcaggggatcgagtccatcctggctaacacagtgaaaccccctctctactaaaaaaaaaaaatacaaaaaactagccaggcgtggtggcaagcgcctgtagtccctgctgcttgggaggctgaggcagaagaatggcgcgaacctgggaggtggagcttatggtgagccaagatggcgccactgcactccagcctgggtgacagagcgaaacttcgtctcaaaaaaaaaaagaatggaattgttttcttcatttcatttttggattgtttgtcactagtgtatggaaatacagttgatttctgtatgttgattttgtattttgtatccttagtacatttgcatactagttcttatagatcccttaggattttctacatataaaacaaaatttttttgttttgagatggagtctctctctgttgcccaggctggagtgcagtggtgtgatcttagcttactgcaacctccgcctcccgggttcaggcaattctcctatctcagcctcctgagtagctgggatgacaggtgcctgccaccacacctggctaatttttatctgtttagtagagatggggtttcatcttgttggtcaggctggtctcgaactcctgacctcaggtgatccacccgccttggcctcccaaagtgctgggattacaggcttaagccactacgcccggcctggctgacagttttatcaggaatgggtgttgagtttttgttaaatattttcccttcatctattgagttaattatgtggtttttgttctttattcttaatatagtatatggtaatattacgttattttcagatattaagccaatcttgcattcctggtataaaccccactcagacccacttagtctggtgtagaatcattcttacatgttgctagtttcagtttgttaatattttgttgaggattgtttaatctatattcatgatagatactttcttgtgatgcctttttcgagttttggtatgaatgtaatgctagctttatagaacaagttagaaagtataccctcctctatgggatcattactatgaacatagtaaagattttcttttctttttctttttctttttcttttttttttttgagatggagtctcattctgttgccaggctggagtggagtgcagtggcatgatctcagctcactgcaacctccgcctccctggttcaactgattattttgtctcagcctcccaagtagctgggacttgaggcgtgcgccaccacgcccagctaatttttgtatttttagtggagatggggtttcaccatgttggccagatggtcttgatctcttgacctcgtgatccacctgcctcggcctcccaaagtgctgggattacaggcatgagccaccgtgctcggccagtaatgattttcaatatgaaataaaagggtattttacagccaggtgtggtggctcacatctgtaatcccagtactttgggaggccaaagtttggaatacattatttcgttaaatatgtggttctcagtggaatgggcagggattttacctcttgggagacatttggtaacatctggagacatttttggttatcacagttggtagcgggtgcttctggcacctagtgggtagacggcaggaatgctgctgaacatcctaaaaggccaaggcaaccccacaacagagaactatctggctcaaaatgtcagtggtgctgaggttgagaaacccaacaaatgtgtagtatttaccactgaaaccaatgtgcctagactttgtttcatgggaagatactcagttattaattcagttttttttacttgttacaggtctattcaggttttctttttcttcttgagtgagttttggtaatttctttctagaaatttgtccattttatctagtgctttaatttgttggcataaagtcgttcatggttttcccttttaatactttgatttctgtaaagtcaattgtgatgttccctctttcctttctaatattaataatttgtgtcctgccctttttgtattggtcaattcagctaaaggtttgttaactttgttgatcttttcaaataatcaacttttggttttcattgattttctctatttttctgtattctgttttatagctctctgctcaaatctttattattttcttctttctgcttgctttgagtatagtctgctctttttctacattttaaaggtagaaggttaggttagtgattgtgatcttttctaaggtaggcatttacagctataaatttctgtttcagcaccacttcaacttcatctcattatttttggcaaattgtgtttgcattttcattgagataaaatattttctaatatctcatgttaaatcttctttgacctcctggttatttataagtgtgttgtttaggccaggtgcagtggctcacgcctgtaatcctcgcactttgggaggccaaggcaggcggatcacgaggtcaggagttcgagaccagcctggccaatatggtgaacccccatctctactaaaattacaaaaattagctgggcatggtggtgtgcacctgtagtcccagctacttgggaagctgaggcagaagaatcgcttgaacctgggaggcagagattgcagtgagccaagattgcgccactgtactccagcctggtgacaaagtgagactccatctcaagaaaaaaaaatgcgttgtttaatttcttttttttttttttttcttgagatggagtttcgctcttgttgcccaggctggagtgcaatggcgtgatcttggttcaccgcaacctctgcctcccaggttcaagcgattatcctgcctcagcctcccgagtagctgggattacaggcatacaccaccatgcctggctaattttgtacttttagtagagactgggtttctccatgttgatcaggctggtctcgaactcctgacctcaggcgatctgcccaccttggcctcccaaagtgctgggattacaggcgtgagccactgtgtccagtcgtgttgtttaatttctgaatatgtatggatttcccaactttcccttctgttcatttctggcttaattccatggtggttggagaacttcatataatttattttcaattcatttagttttttttatgatctagaatatggcctatcataagccatttcagattaagactaactttaaattaatactaatagtttcagtaaaatatagaaaatgctccagtttagctccattgtctccctcttctttttttttctttcttttttttttttttgagacggagtctcactctgtctacccaggctggtgtgcagtagcatgatctcggctcactgcaacctccacctcctgggttcaagtgattctcccatcccagcgtcctgagtagctggaattacaagtgtgcaccaccatgcctgtctaatttttgtatttttagtagagatggggtttcaccattttggccaggctggtctcaaactcctgacctcaggtgatccacctgccttggcctcccaaaatgccagggttacaggtgtgagccactgtgctcagccttctccctcttcttttgtgttactgttgtctatgtattatatatgtatatattacaaaccagaaaatacagtgttgtagttatttgtttatgcagttaaatcttatgtgttttaaataagagagaaaggaataaaatatatttacagccttttatgttaacctacagtatatttaccatttttgttattcttcattttttccctcttgatccaagttactatctgatgtaaattctctgttgattttctggatatgtatttttgaaatgcttttatgaggattataatatgcatctttaatttatcacagtccactttgggttaaaattgactaaagtctggtaatatacagcacctttgctccaaggtagctctatttcctcctttctcccttgtgttcttattgtcatgtatatctttatatgttataacctatcttatgtatatttatgaaattaagagaagaaaataattttttccatgtttacctgttctagtactttctgttccttcttgtggatccaagttttcttttttcttttttttttttttgagatggagcctcgctcccgttgcttaggctagagtgcagtggtatgatctcggctcactgcaacctccacctcccgggttcaagcaattctccttcctcaccctccgtagtagctgggaatacaggtgtgtgccaccatgcctggctattttggggttttattttgtatttttagtagagacgaggtttcgccatgttggccaggctggtcttgaactcctgacctcaggtgatccctcccatcttggcctaccaaagtgctaggattacagacgtgagccaccgtgcccggcctgatccaagttctcatacagtagcattgccattctctccaaaggacttcctttggtagttcttgtaggccaagtctactagcagtgaattctttcagtgtttatttatttgataatgcctttatttcactgttaatttttgagggatagttttgttcaatatagaatttatgcttgacagttgttttttcagtactttcattatgtgattctactgtcttctggcttgcattgtttctgatgaaaagtcagccattatttatattgctgtccatgatttgtcattttttcccttcgtacttacattattttctctttctctttcagtgtttttttttgtgtgtgtgtgtttgtgtgtgtgtgtgagacagggtcttgctctgttgcctaggctggagtgcagtggcatgatctcagcttactgcaacctcaatctcctgggctcaagcaaccctcctacctcagcctacccagtagctgggaccacaggcacaggcatgcaccactacaccaggctaaattttgtattttttgtagagacggagttttgccatgttgcccaggctggtcttgaactcctgacttcaagtgatcctcaccctgcagcctcccaaagtgctgggattacaggcgtgagcaactgcacctggtcttgtctttcagtgttttgactgtggtatgtctaggtgtggttctttttgtgtttatcttatttagagtttgttgagcttcttggaggccataggttattactgttcatcaagttggggaaggttttgcctattatttcttcaaatattcccacctcccccatcttcacccctctttggctctcccattacacatatgttggaacgcttgacattattctacaggtctcatttttctttaatcttttttctgtctattctttggatttgatcatttctttctatgtattttcatgttcactaattattctgtcacctgaaaatctgttgagcacctctttttttttttttttttttccaaaacggagtcttgctctgtcacccaggctggagtgcagtggtgcgatcgcagctcactgcaacctccgcctcctgggttcaagcaattctcctgccccagcctcctgagtagctgggattacagcacctgccactgtgcctggctaatttttgtatttttagtagagacggggtttcactgtgttggccgggctggtctcgagctcctgacctcatgatccgcccgccttggcctcctaaagtgctgggattacaggcgtgagccaccgtgctcagcctgttgagcacctctgatcagtttttcatgccagtcattataatttttaactctagaatttccatgtggttcctcttcattttttctgtttctcggctgaaaatctctatttatcattattttttacttcgtcatcagttttctttaattctttggacgtttaaaatagttgcttttaagtgcaactacttgctcaatctagtatctgcatccaatcagagatggatgctattgatttctctttttcctgagcttaggtgacactttcctggtttttacaagtctagtaattttggttgaaaactggacatttagataatatagcaactctggattctgagttttcccccctgtggcttgttatatttacagttaattgcttagaattaaaccagaatctatttttcctttggtgtgctaatgtctctgcttagttttaaattattattagttttttcgagacggagtctcactctgtcaccaggctggagtgcagtggcatgatctcagctcattgcaacctccgcttcccaggttcaagcgattctcctgcctcagcctcccgagtagctgggattacaggcacccgccaccacgcccagctaatttttgtattctcagtagagatggggtttcaagctggtctcaaactcttgacctcgtgatcctcctgccttggcctcccaagtgctgggattataggcgtgagccactgtgcccggtcaattttaaaatttttattttcagctgggctcagtgtcctacgcctgttatcccagcacttctttttttcttttcttttctttgcttttcttttttttttttttgagactgagtttcgctcttgttgcccaggctagagtgcaatggcatgatctcagctcactgcagcctctgcctccctggttcaagcgattctcctgggttagcctcctgagtagctgagattacaggtgcccaccaccatgcccggctaattttgtaattttagtagagacggggtttcatcatgttggtcaggctggtctcgaactcctgacctcaggtgatccacccgcctcagcctcccaaagtgctgggattacaggcgtgagccaccgtgcccagcgaatcccagctacttgggaggctgaggcaggagaattgcttaaacctgggaggtggaagttgtagtgagccgagattgcgccatcgcactccagcctgggcaacaagagtgaaactccgtctcaaaagaaaataaaatattttcattttttcttcccagcctggcttttggtgggttgtccctgtatctgtttaacttagttgtcagccagtgatttgggcagaggttctcaaatactttcagcccctgaggcttttaccctatcctgatcaacttacagtcaaatgctctactgctgagctatacccccctgatcaatgtgtatgtgggtttggagaaactctaaaaaattgctgctggctctaaagtctcctttggttttcagtttttcctggttctcttaggtataatttcccagtcagtgatggtcatgtgaagagcttaactcagactttctatggctctgtttcaggattttcccattaaatctctggatgttctgcccatctaacaaagacaactgccaaagctgttcatttccatccacattcaccacttttagctggtagatccatgaattttcttcctcaccccaaattgagtccaccccctagagcagcagaactgctgattttcatagctggccccatgttgggaaaactagcattgtcaccagctgactatgctgtaagcagtggggatagaggagtagaaggatggcaggatcctaggctagaaagcttactatttttacctgaacctctagcagattttcaagaatctgtacttctcagtttgtttgatttacactgtattgaaatagttctttctgacaattttaatttttaacttttccattgtggcgaggaattgcctaccacttcatgctgtgaatacaagaatttctatgcctgtaatcccagcacaggcatggaaattcttgtattcacagcatgaagtggtaggcaagtgaggccgaggcaggcagatcacttgaggtcaggagttcgagaccagcctggccaacacggtgaaaccctgtctccactaaaagtacaaaaattagctgggtgcagtggtgggcacctgtaataccagctactcaggaggctgaggcaggaaaagcttgaacccaggaggtggaggttggcgtgagccgagatcgcgccactgcacaccagcctgggcaacaagagcgagactccgtctaaaaaaaaaaataatttccattttttcttagtttttgagcttcagagaatgactagggtctgccttactagagataaaggtaagaatagaggactaatgcccaggccacttctcaaacaagtagtattagaatcccctttgtgtcaggtagtttttttgttttttttgttgttgttgttttgtttgttttttgagatggagtctcactctgtcacaggctggagtgcagtggcgtgatctcggctcactgcaacctccgcctcccaggctcaagcgattctcctgcctcaacctcccaagtagctgggattacaggcgccgccaccacacccggctaatttttttatttttagtagagatggggtttcaccatgttggtcaggctggtctcgaactcctgacctcatgatctgcctgcttcagcctcccaaagtgctgggattatgggcatgagccaccatgcccggcctgcatcaggtagctttaaaaaaatcttctcaggcgattgtgatgtgcagttattgttgagatccagcagtttagaacagtgtttagaaaagcaagctttctctgtaaagggtgatataggaaatattttaggttttgcggtccctgtggtctctgttccaacccctcaactctgttgttgtagtgtgaaagcagccaaagacagtatgaaagcgagtagatatggctatattccaatacactttatttgcaaaaacaggcaatggctgaatttgctgaccccttgtcttggagaattctcaaaaatgattttattccaagtgtttgtatccttgttaatttaaggtagtgtgtatatttcttagcacaacccagcctttgcatttgtcattgatgtctttgaagaattagtccataatttccttcagtagaagtgttttaattgaccatgccttcctaccttctcctttgtcattaaaatatgtgagaaaatgtgccagccgtgggcaatctagttgaaaggtgtgtgttaacttttttggcccagttgggctcagtgaagccttagctggctagtgtttatggcaccatcaacaaagatggaagaattaagcctgggaaaaaggacaggaggtataaaaaatggggtccagaaattcagctgtaggagagcctggtagtggttctcctaccttctgcaaagttcagtgtcaaaactccaatcagagtctctacaagttgaactttcttggctgtccatcaggtagagtactaacttagtaagtacagtggagggccgggtgcagtggctcatgcttgtaatcccagcactttgggaggccaaggtgggcggatcacctgaggtcaggagttcaagaccagcctggccaacacagtgaaaccccatctctactaaaaatacaaaaattagttgggtgtggtggtgcgcaactgtaatcccagctacttggtaggctgaggcaggagaatcgcttgaactcgggaggcagtgaggccagatcacgccattgtgctccagcctgggcgacagagcaatactctgtctcaaaaaataaaaaaataagtacaatggagaatttggtcagacaacttatttttacatccgaggggttgggcatatgaactctgattataatgaatagttcagtagaacaaatcttattttccatagagtctactgtgagtgtatgattccattagttgagtggaacagtttttaccacgatgcttaaattctgcttcaactccctccttcccactactctattcccctgggtctcgtcagatactcctaagtcaaacaggtcatgtagcagataagtgaaggaagtaggcaggttaagtgggtaggtttgagttctgttgaggaggtggtgagtgaagatggagcctaggacctctctgattgggcagtacttgttcctaatctttatgctggggcctgggcagttacccttaatagatggaaaggtgcttagggtaggggatggtagaggacgccagagccatagattatagcctagatagtgcccataactcactgtgtgaccttgacaagctccataatcctgacgcacagtttttcagaagggagtttgtatagcgatcttttgggtcctcctaactcaatatcccttcatcacaaggctttagtctgcctttctagggattaattcctttctagtcattcattccatagttatttactgtatgctgagaacctttaccaagaattggacacagaaaggggtggagatgaagactttccaagcctggcacattcactggatagaggccttgttttcatacctgaacttagcctggtatactagctgctcagtgagtgtgtattacgtaagcaaatatcctattcctgtatactagcgagcgggattcttgtgctacatagtctatcagattttcattgcaacaaaacaacgtgaaagtcttatggattttgatttttttttttttttttgagatggagttttgctcttgtcgcccatgctggagtgcaatggcgtgatcttggcccacagcaacttctgcctcctgggttcaagccactcttctgcctcagcttcctgagtagctgggattacaggcatgcgccaccatgcctggctaattttgtatttttagtagagatggggattctccatgttggtcaggctggtcttgaactcccacctcaggtgatcctcccacctcggcctcccaaagtgctgggattacaggcatgagccactgtgcccggcaggattttgatttcttaaggtctgcagttggtttcctattttacctgtggaagcctgcaaaaatgaattttagactatcacaatttaaatatgtgactttcttgcctgtaaccccagctatttgggaggctgaggcaggaggattgcttgaagtcaggagtttgaaaccaacctgggcaacatagcaagaccctgtctctaaaaaaagaaaaaagaaaaaaattagccagatgctgtggtgtgtgcctgttttcctagttacttgggaggctgaggtggtaggatcatttgagcccaagagttcaaggctgcagtgagaaatgatcacaccactgcactccagcctgggtgaccctcggtcttctcggctcactgcagtctccacctcctgggttcaagcaattctcctgcctcagcctcccgagtagctgggactataggcacgcgccaccacgcccagctaattttcgtagtttttagtagacacggggtttcaccatgttggccaggatggtcttgataccttgacctcatgatctgcctgccttggcctcctaaagtgctgggattacaggtgtgagcccggccgagaccctgtctcttataataaataagtgagtgaatgaattaattaattaaattcttttttatctaaaagcatatggcaacagaggctaacatgcaatagttagccaagaattccattacaactttcattaaactgtagaggctctatcctaaactgttgaaagttatttatatcagaaatatacttacataatgaaattgacagaatatatctgtacacaaaatggtggtgttggaaattagatgtttactatgatattgattagttactattttttttgaacttttaagtctcagtttattcagttattccaataatgtaatcaacttgttcagggatataggcctctacagcttggcagcatatatctgactagtctttctagaatctcataaaatatacttgaccattgtagcaaagaggcatttagtaattgatgcattttgaaagagtatcttcctctcagaaccccccaaaagcattgattgtctatggaaatgtaccttatagatgagctgaataatttccttttatcgtgaagtctttgctttcttgttggaaaattgggaaacaatgtctgagtcattgtcatttagacaaaatgtcataaagccctgtagaacacaaagttctgcttatcagattctcttagaagatgagctgttgagtgacaggtcttctgttgtcccatctctgcttattcagtttgttaactgaggaatcattctctgtcctctccctttttttatattaataggaaacttccattttagaagaatacagtatcaattggactcagaagctgggagctggaattagtggtccagttaggtaagagatccatatgagaaactatggcaaattgttggcatgtgcaaactctgagaagggccatttgaaatacatcttgaattagacacatcaggtgtgccagatttgaggaataggctgaatttaacaagtacaggtttttatgttaggctttttctcatgtatttaggaattagttaagagtgactgagtcgcatggtctttttatagagtcatttaagatgtcgagactggccaggcgcggtggctcatgcctgttatcccagaactttgggaggctgaggcaggcggatcatgaggtcaggagatggagaccatcctggccaacatggtgaaaccccgtctctcctaaagatacaaaaattagccaggtgtggtggtgggtgcctgtaatcccagctactcgggaggctgaggcaggagaatcacttgaaccagggaggcagagattgcagtgagctgagatcatgccactgcactccagcctggccacagagcgagattctgtctcaaaaaaaaaaaaaaaaaaaaaaaagggtgtcgagactgtggggccactgtgagagtcacctatagccagctgaggccattattttttcattgacccacagccccaaaagcatggcttagaagctgaggcctgagcattggctgctgggcagaggggtgagatgcttctttcccccacctgctacccttgggggcaagtttgttctggatgcacctggccatatccttgatgagaagtacaaatctcaaagaaaaagcttgttaaattaattttcattctaacatatatgatctctgattgattttttttctccaaatctagagtctgtgtaaagaaatctactcaagaacggtttgcgctgaaaattcttcttgatcgtccaaaagctagaaatgaggtatgctttattgcctcgacttaattaaatagttgaagtgcctaagaattgttcttttgcaagtaaggcagcttcctagagagaatacagtgatgcataaaaagttttatgtccaaactttacctctcttccccattcatgctatcttagtaaagtagtcctagatctgtcaatatcaaaggccattgagtcatttcctttcagccacctcttgttcttttaaaattaatgtgattcttgtaccctcatgtattcagatttacctcagttttgcttattgaagaaggtacttaaaggtggagataaaatagcacaaggaagagtcaggtgaatggtgtataaaagtgatgctacaggaggactctgaggatgtttctagtttgtttcttctttttgagacagagtttcactcttgttgcccaggctggagtgcgatggcgcaatctcggcttacggcaacctccgcctcccgggttcaagtgattctcctgcctcagcctcccgaatagctgggattacaggcatgcgccaccacgcatcttgtatttttagtagagacagggtttctccatgttgatcaggttggccttgaactcctgacctcaggtgatccatccgcctcggcctctcaaagtgctgggattacaggcgtgagccactgtgcccggcctttagtttttaaaaatatacattgggtttgtttttgtttctgtttgaaaccgagtcttgctctgtcacccaggctggaatgcagtggcacgatcatggctcactgcagccttgacctccttaagctcaagtgatccttctacctcagcctcctgagtagctgggaccacaggcatttgccaccatgcctggctaattttgtttgtattttttgtagacatggggttttgcatgttgcccaggctggtctcaaactcctgggctcaagtgatccactttggcctcccaaagtgttgggattacaggtgtgagccactgcccctggttatacattggttttaaactatctggatatggtaatgacattctaataacatgtgcaatgaaggacttcttttgcataaagaaatgcaaataatttctaaaatgaaatgaattgtttgccagattttcatttgcaaataaatggaacagtaggaagtaaatctgttggtgagtttttattcatggaaaaagcattaaggagataatctttgaaaacactgggtttttacatcattctaagtgataaagtttttattgtaattagcttgtacctagtatggtcagtttttggagagaaaatgttggtatcccctacctattgatacatttcctctgttctctttaaggtacgtctgcacatgatgtgtgccacacacccaaacatagttcagattattgaagtgtttgctaacagtgtccagtttccccatgagtccagccctaggtaagactacacagtgtcatcatcaaatgcccacatgtaggccaatgtgtagtggagctgtcctctcttttatgtgctccctccccttccctctccttcttcctcctaccctcgcttcctctgcccttccttctccccctccatctccctttttgtaatttggaaaatgtcaagcatttgtaaaagcagacagaattatgtaatgaatcctcaagttctcatgatccatcctcaacagtaatcctcttgtggccagtctaatttcatctatgcccctaccactcttcacatcccctgatgattctgattactttctcatttcaagaaagcatttaatgtagaatttaaacagattctatttcaaatcagtgaaaggggcccaaatattattctaggcagagtcttagaggctgataaaacaaaaagcctttattattgcttagtctaactttccttttaaagaaagaaatcaacattattcttttagttaccaaatgtttggcaagcatattgggtggcattctaagtctctttgttaaaattcaaaattaaataaggtatggtttttttggggaagactgagatgtaaacccatcatcatagcagtgcaataggcactaaggacaggcatccctaaaatattctaagcttacaaaggagaggagctgctaactatagtctgggaggagaggtgtctcacaaaggctgtgtggaagctaggacttgaaggaagggtaggaattttccagatggaaaaagaagatagaattttaaaaacaaatgggaaatcaaacaaatgggaaaaaaacgcttatttttcacaactgtgctctgttggtgaaagcatttggatggaagctggaagcatatatgaaagaatggtagccaaaaatcacattaaaattttttttttcagaacatgagaatttttgctcttagtaactgtgttaccctggacttaggaagttgttacacactttgtagatgcagtatctttaggtcagcttcttaatgtttcagggttttttgtttctttttcttttttttttttttaacttaacaaaatcaaatgctttcaaacagggcccgactcttaattgtaatggagatgatggaagggggagagctatttcacagaatcagccagcaccggcactttacagagaagcaagccagccaagtaacaaagcaggcaagttaaccccaggtaccaatcaaactgccaccaaagttggttaacaagcacaatttcattggggggaagaaaagaaaacttaaagaaaagctctatttgacttctcattgcctgctttgttatgtaatcagaaaagatgttttgacaggagaaatgtgaccccttttatacttgggggtgggggtactgtgttcttaattggttgtcaactgtttcctgaggctgctgtgagatttcaataaactctggaaggaaggcatcttaactgctttgtagactgcagttatctttaggcatgtagctaccaagtactgttattggactttgcaataaaatgctgctgataccacctgaaagattgtatggtataaaaatgtattttaagagaattgtacataagatgcttcctgcatgtgagccacctttctgtgatttcttcagatttaataatatcctaagatctttgtaattctgaattattcctggttatattctatgttgacatcacattttattgctgtagaaatgatttatgtcacaaacaatactaggaatccagctgataatcacttcttgcagaggtgaaaagctaaaccctcaaggcttatcttcataccaggcaagcaaagcaaagagaattaggaagcacagcccaattgcttcttaataaaaagttcttccaagtttcccatgaaccttaagcaattttggatgcctcctttctggtagggaggaactgatacttggattgctgagaaaatgccatatggagagttaaagaacaagtaaaatctgttctttctgtttgatttttaaaattatacctttaattttttcaaatattaggattaaaggatgagctctgataatcttctataaaataaaaccccttcaaatccacataaacaggcaacattttcaacaagcatgatgagcaaaatgagtttccagtatgaattggaaaaacccagtcagctgatttcttgaccctcagctccctggagagtgccattcttgtctgagccctgctgtgggaactgcgcctgctgaccattgctcagcttaggtgtttcttctgcagtgtctgtcatacctcagatgaatgaaagtgggagcatttcatttttcccatttcttacaggatttacccatcagtttattctgacaaagaattgctgtaccatcatatttttctttctgtctgacaaaatacaagttgcagttaaactaagcttaatccattctgtttcttggtattccaagtttttcttaatttctgctttaaaattgaaagtgaacgcagtcttaatgaaggcttgttttttgacatcctgagttctctacgccaggtgtattaaagagtggtcttttctaagaagcgactgtttcattgtgtcttttttcagatagctttggctctgcggcactgtcacttgttaaacattgcgcacagagacctcaagcctgaaaatctgctttttaaggataactctttggtgagaagactgtttttctgcattttagtgctgcaactcttaacatagttcaggagtgggtgtgtttggagcgctctgaattcatggtgaaaaagctttaagccaaagtgcttcaaacagcttatttcttcaactcgttcccttgctagaggctcagagaagctgtactactgtactcccggcattgataattttggatgatactgatatgtatttgtgggacttaatgattttggatattatttggaggacctttgggaaggggcaggaatctgtatgctgttatatattatctcgtttcatttgctgttttccctttcagctctgtcccctgccccatgtctcaccagataagttgctctgtctatcatgaagcttatggcagatattaaaagtgaagtagcatcccagattgatgagaggtgatgggcttatagagtgaagggtccctaggccaagaccttgacgttagtgctgcccttacaagttctaaagcaaaaatagctgtgtgagtgggtaggaattccttacttctgcattactaaggacagttcctcagtgtgaatcattgtctccagacctggggacatgttattttcataagttcgcatctcagctggaaagaaacttgttagatctcagggtaacatgtcttacacctggattttcctttaatgtttactgagcactctggagcagtgactccttttttttttaatttcaggatgccccagtgaagttgtgtgactttggatttgccaagattgaccaaggtgacttgatgacaccccagttcaccccttattatgtagcaccccaggtaagcatgtgcggtttctgtcctaagatctgtcaccaagctgcccatcaactcgtgttccttctattctacagcacaagtaggcatatattacagatgggagggggagaacttagctttagaaacctacagattgctttatttggtgtagatcttttattcttttaaaatcaactttagccaggtgcggtggctcacgcctttaatcccagcactttgggaggctgaggcgggtggattacaagttcaggagatggagaccatcctggataacacggtgaaaccctgtctctactaaaaaaaatataaaaaattagccgagtgtggtggcgcacacctgtaattcgtgctactcaggaggctgaggcaggagaatcgcttgaacctgggaagtggaggttgcaaggagccgagatggcaccactgcactctagcttgggcgacagagcgagactccgtctcaaaaaaaaataaataaaataaaataaactttattgaggtatgatttagaagtatgatttacatacagtaaaatacctccacttcaaggagagtttgatgagttgtgacaaatatataccccatatggcgaccaccacattgaagatgtggaacacgcccctcacttcacaagctgcctgtgccactttgcagtcagtcccctcccaacttaacccctggccctaggcaaccactgacatgctttctgtcattattggttagttttgcctgttgaagaatttcagaaaaatgtaatcgtggactttgtatgcttcatttcttttgcttagcatgtttttgagatttgtccatgttcctgcatttatcactcgttaattccttttcattgccaagtagtatttcattatatacctaagctgcatttgttttttccattcactgacaggattttgggttgtttctcatttttggctattatgaagaaagctgctaggaacacttcttttacagtttttgggggacatgttcccccatgcccatatcttttttccaaaatggctataccattttatgcgtctaccagcaacgtatagagttccagtcatttcacatttttactaacgcctcatgcttgttgcttgtcagcatttgtcatcttagtcattctggtagcgggcagagtattacttcattatagttttaatcacgacattgtcctgatggccactattttggagcactttttgtacatgtgtattggccattctgttgtaagtatgggcattcatcttttgccattttgttattgttggtttcttgttaaagaattgaggtataagaattttaaaatattctggacacaggttctttgccatatgtatgttgtattcttactgctgctgtaacatattgtcacaaacttagtagataaaaacaacagaaatgtattatcttatacttctggaaatgagaagtctgaaatggtactcagtgctataatcaaggtgtcagcagggctgtgttccttctggaggcatttcttgccttttccagcttctagaggctgcctacattatttggcttgtagcctcttccttcatcatcagagccagtagcatagcatcttccaatgagtgtctctctctatgactttgaccctcttgcctgcctcttataaggaccctactgatcacattggccttacctagataactccccattttaagattcttaacttaattgttctgcaatacaaggtaaaataatcccagggattataacatggacatcttggggggccattattctgccttccatatatatatcatgaatattcatctcagtctgtgacttgccttttaattttcttaatggcctttgaatagcagaagttttgaattttaatgaagtctgtttcaccattttttttttaatgcttagtactttttgttcctaagatccacaagcataaatattttctctgatgttttcttataagaggttatagctttagcttttacatttgggtctgtaattcatctgagtttgtgtgtgtatgaaatgagagaccaggttctttttttcccccttaagggtgtcaagttgttgcagcatcattggtaaaatgttttttacaaatcatcatttgtaaaaggatttgtaaaaggattgcatcattgaattgcagttttttgtttgtttgtttgtttgtttttgagacggagtttcattctttttgcccagcctggagtggtgcaatggcgcgatctcgactcactgcaacctctgcctcccgggttcaaggaattctcctgcctcagcctcctaagtagctgggattacaggagcccgccaccatgtccggctaattttttgtatttttagtagagacggggtttcaccatgttggccaggatggtcttgatctcttgacctcgtgatccgcctgcttcggcctcccaaagtgctgggattacaggcatgagccactgcgcctggcctgaattgcagttttgttgaaaaccagctggccatatatctgttggtcttttctggattctattctgtttgtttaatatatgtatgtgtctatagcaagagcatctgcattattgtagctttatattatatcttgacttcagattcattctttttcaaaattgttttggctattctagatcctttgcatttctctacattttagaattcacttctgtataacagaaaagcctcctgggatttgactggggtggtatttaatctataggtgaatttggagagaactgatatcttaacaatataagtctcccaatcgatgaacaaggtatatatctctccatttgtttaggtctttaattttcctaaaaaatgtttatgcttcttaatgttacaggtcttgcacatattttcttaaatttatccttaaattttgtttttggatgctgttggaaatgatattgtaaaacatttcagctgggcgtggtggttcacgcctgttataccagcactttgggaggctgaggcaggcggatcacctgaggtcgggagttcgagaccagcctggctgccatggtgaaaccccatctttactaaaaatacaaaaatttgctgggcgtagtagccggtgcctgtaatctcagctacttgggaggctgaggcaggagaatctcttgaacctgggaggtggaggctgcagttagtcgagatcatgccattgcactccagcctgggtgactagagtgaaactgcgtctcaaaaaaaaaaaaattcattttctaattttaactagtttatagaaatactagtgttttttgtttgtttgttttgggtttttttttttttttttgagatggaattgcactctttgttgcccaggctggagtgcagtggcgcaatctcagctcactgcaacctctgcctcctgggttcaagcaattctcctgtctcagcctctgggatgacaggcgcccgccaccacacctggctaatttttatatttttagtagagacagggtttcaccatgttggccaggctggtctcgaactcctgacctcaggtaatccacccactttggcttcccaaagtgttgggattacaggtgtgagccactgcccccagccatactagtgactttttttttttttttttttgagatggaggcttgctctgttgcccaggctggagtgcagtggcgcaatctcggctcactgcaatctccgcctcccaggttcaagcgattctccttcctcagcctcccgagtagctgggactacaggcgcccgccaccacgcccggctaattttttttcatatttttagtagagacggggtttcaccttgttagccaggatggtctcaatctcctgacctcatgatctgcctaccttggcctcccaaagtgctgagattacaggcgtgagccactgcacccggcccatactagtgatttttgtatattgactttgtgtcttgggaccttcctaaattcatttattaaatctagtaaattttttgtagatttattaggattttcttttttttctttttcttttttgagagcctaaaagtgggcatgcctcttctgttgctcggcctttagtgttgggtttgagggttaaatcagtctactcaaaagttgagctgagtgtgagttttgttgttgctatcgttgtcttcagtgcctcagtggcatgggattcctgttttgttaccttatggttaggtgggatctgaaatgccattttttttaaaatttaaaaaaaatttttttaaaatattccacttctaccctcagtcttggccttgctagtgcacctgtacctcagaggggatctctctttacagtcttggcccccccttagcaatagattgctgtcagttactgcttggtccctgcaagcctgcagaaagggagatggcaatgggggaccgagaggtatctgtttctctgctgttgggcaggacctgtgttcttgagtctcatgaatatctggtggaagtctgtgcagaagagtatgggagcaggcatgagtcttccttgtttgtatggctcctagagggtctgtactcttatcctagcccacattttgcctttagcagtttgttaaaaacctcgctgaattctttttacccaaatggcatgtgatatcacttcctcctgcgctctgccataggtgagccagctttcactccccatctctccttggaagggcctgacttaaagatttccgaataattggttaacctgagacctgatctttgatgggttcaaaaaaagtgatgggccgggcgcagtggcttacccctgtaatcccagcagtttgggaggctgaggggggtggatcacttgaggtcaggggttcaagactagcctggtgaacatggtgaaaccccgtctctactaaaaagacaaaatattagtcgggtgtggtggcagccacctgtaatcccagcttctcgggaggctgaggcaggagaattgcttgaacctaggaggtggaggttgcagtgaacaaagattgagccattgcactccagcctggtgacagagcgagactccatctcaaaaaaaaaaaaaaaaaaaaaggatgattttataatttatctttgacactttccagctttctatatcctagcagaaacagaaatcccaacaatttgggtggaaggagggtgaggatcaaaaaactacctatgtggtattatgcttatataaaacctgggtgatgaaataatctgtataccaaacccctgtgaagacactgcagttcacctatataattaacatgcataaagcacatgtacccctgaacccaaaataaaagttaaaaaaaaaaagtcccaacaatttgattatgtatgcattcttgttcctttgtttttcctgccagggatctcttgagctcctgggatctgttggtttatggtgtttatcaaataaacaccatatcaaataaaaattaggaaatttttcagacatcatctcttcaacgatttttctactcctctacttgttttctgagacttccaatcaatgacatatatattagactgtacagggaactggagttctgatcttttgtattttcatccttttttccttttctttcatccttttttttctttctgctttcccttcccttcttcccttctgatatatactcaatagtggcactgctggatgataaggtatttctagttttaatttttttaggaagcttcccactgttttccatagtggtcatactaatacacattcttacagtgtacaaaggctcccttttttccacatcattgttaacacttgttatcttttatcttttttaatagccactgtaaaaggtgtgaggtaataatttcattgtggttttaattttaattttaatttttttttttgagatggagtcttgctcctggcacaagttggagtgcagtagcacgatctcggctcactgcaacctccacctcccgggttcaagcgattctacttcctcagcctcccgagtagctgggattaaaggcatgtgccaccacgcccggctaattttttgtatttttagtagagacagggtttcgccatgttgttcaggttggtcttgaactcctaacctcaggtgatccactcgccttgacctcccaaagtgctgggattacaggtgtgagccaccatgcccagcct

SEQ ID NO: 149 - DNA, 2286040 bp, Homo sapiens
accaataaatgttggagaataaaattattaggcatacttgaagttacaagaaaaaagtcagtgaaatttaatttttttatttttattttattattattatactttaagttttagggtacatgtgcacaatgtgcaggttacacttgtatacatgtgccatgctggtgtgctgcacccattaactcgtcatttagcattgggtatatctcctaatgctatccctcccccctccccccaccccacaacagtcccagagtgtgatgttccccttcctgtgtccatgtgttctcattgttcaattcccacctatgagtgagaacatgcagtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacgtgtgcatgtgtctttatagcagcatgatttataatcctttgggtatattcccagtaatgggatggctgggtcaaatggtatttctagttcaagatccctgaggaatcgccacactaacttccacaatggttgaactagtttacagtcccaccaacagtataaaagtgttcctgtttctccacatcctctccagcacctgttgtttcctgactttttaatgatcgccattctaactggtgtgagatggtatctcattgtggttttgagttgcatttctctgatggccagtgatggtgagcattttttcatgtgttttttggctgtataaatgtctgttcatgtccttcgcccacttgttgatggcgttgtttgtttttttcttgtaaatttatttgagttcattgtagattctggatattagccctttgtcagatgagtaggttgcgaaaattttctcccattttgtgggttgcctgttcactctgatggtagtttcttttgctgtgcagaagctctttagtttaatcagatcccatttgtcaattttggcttttgtttccattgcttttggtgttttagacatgaagtccttgcccacgcctatgtcctgaatggtaatgcctaggttttcttctagggtttttatggtttcaggtctaacgtttaagtctttaatccatcttgaattaatttttgtataaggtgtaaggaagggatccagtttcagctttctacatatggctagccagatttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtatcatgctgttttggttactgtagccttgtagtatagtttgaagtcaggtagcgtgatgcctccagctttgttcttttggcttaggattgacttggcgatggggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctctttaatttcattgagcagtggtttgtagttctccttgaagaggtccttcacgtcccttgtaaagtggattcctaggtattttattctctttgaagcaattgtgaatgggagttcactcatgatttggttctctgtttgtctgttattggtgtataagaatgcttgtgatttttgtacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccaattttcaaaggcaatgcttccagtttttgtccattcagtatgatattggctgtgggtttgtcataaatagctcttattattttgagatacgtcccatcaatacctaatttattgagagtttttagcatgaagggttgttgaattttgtccaaggccttttctgcatctattgagataatcatgtggtttttgtctttggttctgtttatatgctggattacatttattgatttgcgtatattgaaccagccttgcataccagggatgaagcccacttgatcatggtggataagctttttcatgtgctgctggatttgctttgccagtattttattgaggatttttgcatcaatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattgttgccataatttcagagcctgttattggtctgttcagagattcagcttcttccttgtttagtcttgggagggtgtatgtgtcgaggaatttatccatttcttctagattttctagtttatttgcatagaggtgtttgtagtattctctgatggtagtttgtatttctgtgggatcggtggtgatatctcctttatcattttttattgagtctatcagagtcttctctgttttcttctgtattagtcttgctagtgatctatcaattttgttgatcctttcaaaaaaccagctcctggattcattaattttttgaagggttttttgtgtctctatttccttcagttctgctctgattttagttatttcttgccttctgctagcttttgaatgcatttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcactggtttcaaagaacatctttatttctgccttcatttcgttatgcacccagtagtcattcaggagcaggttgtttagtttccatgtagttgagtggttttgagtgagtttcttaaccctgagttctagtttgattgcactgtggtctgagggacagtttgttataatttctattcttttacatttgctgaggagagctttacttccaagtatgtggtcagttttggaataggtgtggtgtggtgctgaaaaaaatgtacattctgttgatttgggctggagagttctgtagatgtctattaggtctgcttggtgcagagctgagttcaattcctgggtatccttgttaattttctgtcttgttgatctatctaatgttgacagtagggtgttgaagtctcccattattattgtgtgggagtctaagtctctttgtaggtcactcaggacttgctttatgaatctgggtgctcctgtattgggtgcatatatatttaggatagttagctcttcttgttgaattgatccttttaccattatgtaatggccttctttgtctcttttgatctttgttggtttaaagtctgttttatcagagactaggattgcaacccctacctttttttgttttccatttgctcggtagatcttcctccatccttttattttgagcctatgtgtgtctctgcacatgagatgggtttcctgaatacagcacactgatgggtcttgactctttatccaatttgccagtccgtgtcttttaattggagcatttagtccatttacatgtaaagttaatattgttatgtgtgagtttgatcctatcattatgatgttagctggttattttgctggttagttgatgcagtttcttcgtagcctcgatggtctttacaatttggcatgattttgcagtggctggtaccggttgttcctttccatgtttagtgcttccttcaggagctcttttagggcaggcctggtggtgacaaaatctctcagcatttgcttgtctgtgaagtattttatttctccttcacgtatgaagcttagtttggctggatatgaaattctggtttgaaaattcttttgtttaagaatgttgaatattggcccccactctcttctggcttgtagagtttctgccaagagatccgctgttagtctgatgggcttccctttgtgggtaacccgacctttctctctggctgcccttaacattttttccttcatttcaactttggtgaatctgacaattgtatgtcttggagttgctcttctcaaggagtatgtttgtggcattctctgtatttcctgaatctgaatgttggcctgccttgctagattgggaaagttctcctggaaaatgtcttgcagagtgttttctaacttggttccattttccccgtcactttcagatacaccaatcagacgtagatttggtctcttcacatagtcccatatttcttggaggctttgtttgtttctttttattcttttttctctaaacctcctttcttgcttcatttcattcatttcatcttccatcactgataccctttcttccagttgatcgcatcagctcctgaggcttctgcattcttcacatagttctcgagccttggttttcagctccatcagctactctaagcacttctctgtattggttattctagttatacatttgtctaaaattttttcaaagttttcaccttctttgcctttggtttgaatttcctcctgtagcttgaagtagtttgatcatctgaagccttcttctctcaactcgtcaaagtcattctccgtccggctttgttccgttgcttgtgaggaactgcgttcctttggaggaggagaggcactctgctctttagagtttccagtttttctgctctgttttttccccatcttggtggttttatctacttttagtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtaccagcaatggtggctgcagaacagcggatttttgtgaaccagaatgctgctgtctgatcgtttctctggaagttttgtctcagaggaatacccggccgtgtgagatgtcagtctgcccctactggggagtgcctgccagttaggctgctcgggggtcagggttcagggacccacttgaggaggcagtctgcccgttctcagatctccagctgcgtgctgggagaaccaccgctctcttcaaagctgtcagacagggacatttaagtctgcagaggttactgctgtctttttgtttgtctgtgccctgcccccagaggtggagcctacagaggcacgaaggcctccttgagctgtggtgggctccacccagttcaagcttcctggctgctttgttcacctaagcaagcctgggcaatggcgggagcccctcccccagcctcgctgccaccttgcagtttgatgtcagactgctgtgctagcagtcagggagactccgtgggtgtaggacccgagccaggtgcaggatataatctcctggtgcgccattttttaagcctgtcgggaaagcgcagtattagggtgggagtgacccgattttccaggtgccatctgtcacccctttctttgactaggaaagggaactccctgaccccttgcgcttcccgagtgaagcaatgcctcgccctgcttcggcttgcgcagggtgcactgcacccactgtcctgcgcccactgtctggcactccctagtgaggtgaacccagtacctcagatggaaatgcagaagtcacccgtcttctgcgtcactcacgctgggagctgtagaccggagctgttcctattcggccatcttggctccatatatgaaatttaatttttaaaaaattgctagaatatagagtatacagagtatatagaagctaaatgagaggaattttgagaaaggaagtggaacataattaaataaaacggaaatgaggacaggtgaaaggaagagacccaatcttaattagaacggtaaagttttgaattctaggaagtacagtagaaaagtaccaaagcactaatgttggaattgggagttattttgagcccagaaaaaggacttcctgctatcttatattagagttctttttgcctttgttatatgtagggagtaattgtggctgtatggaaaatgggggcactatgattgcaagtttgcttttagctggttaaggtatggtgcctgggaatacagacatgttcttaaaattattactggtgttttatagaaaggaatatttattggtaaacagcttgggataaacaagatgctagaagaaggaatattaggcagagacttcatacactagttacgaaccagtgataacttgaattatgatatgatatgccacccgcatccttgttcatgtaaagatattttactcgagccctataccgtttttttagtattccagaatagctctcctattttatttactaacctccttttaacatttttgtaccatttatttcttttataagtatttttttctaaccttgcctcacatttccattctgtatttaagacccgtggtatatgcatataccttatacagttcagcctccatttcctattgaagcagtttcccttctagttcatggcattttttatttctctttagacatgaagagtatttctggagaagaatcatcccatggagtgattatgacaaggcttaccgaaagtggacacccttcttcagatgcctggaaaggtgagaattggttatataggaaccagaaaaaatgggacataaatttgccacaagaggctttcattcctgagacaatttacactgaggaggaagattttgaatgtagtgaaaataagaaaagctttgatattaattcagttagctcaatttgtgctatacaagtgggaattccttcaagaaaggggtctccaaaatgtgataagtttaaaacttacttcaaatttaatttagactcagtaggtaagcaacattcagaatatgaatatgggaatgacttgagtttgagtacagatattcgacaccaaaaaagtcatactacaatgaattcctatgaatgttatcaatgtgggaaagccttctgccgaagttcatcccttattcgacatcagatcattcacacaggagagaaaccctataaatgcagtgaatgtgggagattcttcaaccgacgtacaaaccttactaagcatcaaaaacttcatgctgaagcaaaggcctgcacaagcaataaatgtggaaaggccttcagtaaaagtgaagacagtaataatccaacactccattttggaaacaatttctatcaatgtgttaactgtggaaaatccttcaaccggagctcctctcttattcgacaccaaatgattcacacgggagagaaaccattcaaatgtaaggaatgtagtaaagccttcaacaggagttcaaaccttgttaaacatcaaaaactgcatactcgagataagtcctgaaaaaagaaaaaatgaaagattaccttcagtcagaatgcagaactcatttaacatcatgaatttatgctggataaaatctcatgaatataatgtaagaaaacatttgtcagatttttctttaaatgatatcacagaattaatgttggatagaaatatcattggatagaaatctgtttgaaggaattttcctggttttcagatgaagccataaggctttggagttaaaccacagtatcaccatacaagtatttgtttatcattattttgatatccattaccctcacctctccctagttcataaataggtctatagcatactaatatccacctgatttattgacgaagtagacattaggcaaagccaaacaatactcttggagttgatatttaataaaactcagcccttttaagaaggtcacaagaaatcattagctcatgcgaatataagagaatacttctaaggacagaaatctctgaatcaatggctaagacaacagtaacagccatttactccactcctgacaataccctttgttgtcttgctgttgaatggagactagagttgggaaagggttatcaactgcaatgggagaagtatgtattgctgttaatctatatgtattcttaaaatctgcatttgtttatagcaggtccttgaaaaatgtttttgttttgttataatgttataattgttatgatgttgatgagaaaaatatcgattcccagccagggacactgtgtggagttcgcacactctccctatgtctccgggtgctccagtttcaaaccccaaagatgtatacattaggttaattgacatatctaaattatctcagtctgagtttgtgaggaagtgtgccctgcagtggaatggctcctaatcagggtttgttcccaccattgccctgagctgctaggatgcgctctgtccacccatggccctgtactggaataacagggtaaataattatcttatctgtttttattaatccgtcttaaatgtgtatatagctcagatttattttaatgtctgatattggaagcgtttggggtctttagaagtttgatgatgttgtgaccagacatttgccttaggaacttaactcttgtttgtatccattagtctatggtaaaattggttttgttatacatcatttcacttaaagttgcagttcctaagaacctattgatgatgttcagtgcagacttactgtacctttgggaatttaggctggagagacgtccatagccttaggtatatcatttataccagacattatgaagttattaaagtctcctatactctgtacaccagaactgtgtcttctgtaaactacctcaggatcccatctggttcttgagccaagaagtatgacttaatctgccccaaaaaattcacactggagacattcccaattaatgatgatggtagctttttgtgaaggttcataccttattcaaaggcagaaaaggtatactggagtgaactcctatgattaaataatgtcaaaatctatgtttgttcatcctttatattgcaacacaagttttattaggacaaagccctacataagtaattgatatagaaattcgtataaacaagagataacttgtagagaagcctaacaagagaaaagcactctgaatgtaaaaaattcttgaggtatgttcattcatcatagtacttacattaaatacaatggattctgactttttaaatttaggtattccaagtccaatatttcaatttttgaaaataagctgtgattttcttttggatggttgaaagatagaagtactattttcactctttatcttttctttgaacaactagctatttgagcctaagtaaaatacttatttttttctcctaaatctccaagctttcttaaaaaagtgtttactatgttcactaagtttaacataacatagtttcaaataataatttttggagtgcatttaaagctcttgcagagcatttatagccaattaacatcttctcgcagccttgtttcacaagcctgtttatttagtacattgtattagcgttctctagagggacagaaccaataggataaatgtatatataaaggggagtttattaaggagtattgatttacactgtcacaaagtgaggtcccacaataggctgcctgcaagctgaggagcaaggaagccaagtcccaattttacataagagtccaagtcccaaaacctcaaaagtagggaagctgacagcgcagccttcagtctgtggttgaaggtccaagagtcccaaagctgaactcggagtctgatgttcaagggtaggaagcatccggaactggacgaagtagtaggctggaagactaagccagtctagtcgttccaatttctcctgccttttattttggccacactggcagctgattagattgtgtccacccagattgagggtcggtctgcctttcccagtccactgactcaaatgttaatctcctttggcaacaccctcacagtcacactcgggaacaatactttgcatccttcaatccaatcaagttggcactcaatattaatcatcacatatttgagttttactatataccatcaaaggtcgatatctaagctgaaacatgaagagtgtagattaaccagattgtgtctggcaagtgtggaaatgttaggagagatgataaaggcaaaacgaggggcacaaagctataaagggatgagggcatggcaagttcaggaaacataagttcatctactagaatacagcattgggaaagaatggagctttcatttcatagaggtaaagctacagagagactcaaggggcacatcatgagaggtcttgtaagccactttagaagtttgagcttcagcctaaaggtaatagtgagataaaattgttgttaattccatgtttagtactctgaaaatgctaattgaagtaacaagataaaactccaaaggaggagaaaatcatttgctgctgatatggttgactcatgacaacctaataaaattcgttgaaaaactgttagatttaataaatgaatttagataaggtaaatatagcaactttgctcaaaaataatcttgaataagaggaaagctgtgtctggaatgagaagactactatagagattttgagtctccacacattaaactacaaatgaaaaattctaatcagatattcaatggggaggatttatttcacaaagtgattataaagtttactttgtagaagtaagaaaatagctgtgaccatttttttaaaagcaaggtaatgagaacattactagtaacatagtgtgatactagtctattcacatgtgtgagacaattgtttataactagacctaggtgtttataagaatttagcatatcgtaaattgtcacttcaaattagagtggaaactattcaatatttacatatatatcatatacagatgtatacatatatgaatatatatgatatatgttgatatattttttgaaaatttgaccatgctgtggaaaactggtctaaaaagttaaatgccaatctcaaccaataaacaagggaaatgttctattttcactaatactaaaaaacttaaagatcacatattgggctgatagacaacatataaaaggaataataacactcagttttagtgggactcttaagaaatgtaactcacatgccactatgggaatgcaaataattactaactttctggagggccaacttgacaatatatattgagagcgtttaaaaagtcaagttacaggagggaacagcgcaagttaggattcaaaaaatcacaagaccatatgagctccaaagagtgacaaagaatgcgcagtctgcataaaggaagagcaatgggagttgaagaaaagaccagcatccagcctacaaagaggaagaaaggagctccataactcagcctgagcaagcgaaaaacaagtttgagtcaagaaccaccagattcccactcagcagcatcaacaatcactgagaggtgaggccaaagatgaggataatagggtaaagcaagtgcttcacccaggctctcttccttctacttaaatatatcataagcaccttactaggctgtccagctatttcatttttagagagttgtaacccaggtgtcattgccatagattgccctggatcgataccctgattacttcactcgtcactctggcactgtggaattaaatgattaagagcaagaaacccatttccagggcaacagcttttaccatcatctccagccttcagaaaatggacactacagagctcttcagggttgcctttgcttctttttcaaaatatctttaaatctttggtgaagagagtactaaactgattccaatattctatcaccctggacctttggattcttctctctatggtatgtcagagaagttttgttattagctgtaggtcaaatttgactctaggctttaattagccaacttaccagaataggttgctctttctggtgtttccattgaatgccagaattaacagaataggttactcttctggtgatttcattaaatcccaggtttcagatgtttgcatctgagacaataaatccaacccaaatgtaacttacatttggtccatcgtagaatttgctcccacatgtattctccaggctttttgctaatagaattgccaagcctgtaactcttaaaataacaggtatttccttctgtaggaacaaagaatgcttgcatttttttctgtcagggttatattcagatctaagtctcattatgaccctggagccaatgacaagtggtaggggtgggagctgaagagaattggtatcagcttgtaaggcaaatgtaaggtgtagtcaagaatatgctttaatggagagaaggtctgataccttcaagtggataaggagtaccatttcattggcaagagagattcaaaagaatggggtgcccaaattctcagcttcatcagtgtctgcccaaataccttatgtaatattctcaccagttctcttaccttcactgtcaccaggatatgcatttaattggtgcggcaattctgcaacactttatgttgagtagggtttgattgtcagccatatctaccttacagccgctgggtttcagactgccatcgggccttttggttatcctcttttgattcttaattgtgtattcacagcttttagttgctcttcttccatatgttcattccctagggtgacagaatccaggtggctccacatatttaaaaatcatttttttccaccataactaatgccacaaccacttgcactctcgacaccttgtcctttacctgcacttttattctattctaacagtgataatctgagaaatcttgatgtcctcaaatgccaatgtttccccaacagaaaggttatccctgtgcttttctgcagcctaatgctgaatcctgcttagaggatctattttgtagagccgctttggtcccaatctttgttttcctctgggtcagcaggaaacagatgtcattctcaattttagaataagaatagtttaatattacgggactatttttaaaggtgtgggcaaagcttagggaaaccataagaaataggaaaatacccaaaagctagtaataagggtttttttttgtttgtttgctttttaatccttaggcctgaaaaggcaagacaaaggagtcatcaccagaatctaggagtcatgtaaagagggcactttggtaagagctgcaacctgagatctaggaaagcagcagtcaaaatcaaccctcttatctcctgccagggactcccattggctatagccatggagttaaagaacccattgatgtcatccatttaggccaggctcccagagaggagaaaagtggagagtggatctagaagggagaatagaggatatctggtatgggatccaaattgatctgataagggacttagagtgaaccccagcccttttatatattatctatgattcacatccttggaagtccaactccttcttggactggtttctgtactctattatgttatctacagcaagtggaagtgtattttttaagtttgactgttcatctcacttggtaatgcttggtgtcttcaccttgtaatatagtgtcactggttcttacagggtggtccccagaccagcagcatcaacatctgttgggatttgttacaaatatcagtccttgggccccagtgcagacctaatcaggcagaaattctggaaaatggacagtaatttttcttgtaacaagccctctaattctgatgcaagtttgcaaacctctgatctaagcttgacatctgggcctaatcttaccaatgacgctgattgtaagtttcagtaatgtttctaaaattggccttgcatcagctatcacctatatttttcctgtgtcatgttgtgtgtcataagtccttgtttctgaagggcccttgtattctaggtttctcttcagtatattcagtatattcagaaactatcaattctcaagcaaattaacagctctacccattttcttagtgccctttatttctagtctactcatccatctttcctgggcatgggcatttaattagtgaattcaattgaattaatcacacagtcatgtaactaccaccataatccatatataggacagttccaccactacagaaaattctctcctattcttttatagtcaagctgttcccccaaccccagccctcatgacccctgattaggcctatctatatataattttaccttttcagaatgtgatataggtggtttcatagagtatacaggtttcttagtctggcatctttcccttagcctacctaattgagattcaaacatgttattgcatgttatttattgctgagtggcaataaaataaaattgctattaaaatatggttacatatattctacactatatatgaaccatctgagttcttcacatatatgtgttattcattttaaatttgttattcatatatataggaataactcattcattcaccagttgaaagacatttggattgttgccagttggagttaaatataaaaaaagttacaaatatatatataacagtttgtgttaagatatgttttcatttatcttggtatatacctaggtgtgagattgttgtgtcctatggtaggtgtatgtttatcttgataagaaactgtcaaactattttacaaaatgactgtatcaattggcattctgaccataatggatgagagtacctgatgttccacatactaacattggatattcccagttttgctttgctttagctatggtgtactagaataagctcacattggctcacaaaaaataactgttaaattatcacaaattttgtgagctaagtgaaattatgttatagcttggaatcaaccaagatttacaccacagaaacaaatgctgttaatccgggttttttaaatgttttctggagacctagctaaacatttaccataccactatgttagcaattgtaataagtatgtaatagtacctcattatcacttcaatttgcattttctgaatgactatattttcatgggcttatttgtcatatatttttgatgaaatgccttcttaaatcttttggctatttttaaatctagttgttaagttttgacagttttttatatattctagatggaagtcattattggatatgtattttgtgtaaatattttttgcacagtccatggcttgtcctttcattttaaacagtgtctttcaaaaaagtttatagtgttgatgaagttcattttatcaattgtttctctcattgattgtgctttcactgtcatacctaaaatatttctcctgttttcttctagaagttttagagttttaagttttacattgaggtttatgatctattcttagttaacatttgtacattatgtgaggtatgggtcaagctttatttgcttatggatatccagcagtttctgtactatttgtagaagactgtagattgaattacctttgaacatgtgtcaaaagtcagagaacagttatgtcagtccatttctggagtctgttttctttcactgatctttgtgcctatcctttcagtagtacattagtctcttgattaatgaatatttagccttgaaatcagatcatgtaagtcttcttaggtctttttttttttttatttttaatgtctttggctttcttgttcctttgcagttccatataaatttttagacttagcttatttctacagaataatcaagatgagtttttattagggttgcattaaatctaaagatcttcttttgtatatgtgtcttttaacactgttttacataaattagtgtgtgtattcatgcactgaaataacattctcaaatgagtgcccaagtaacaatctaagaaactcttttatacatttgtatttaaacaaagttttacatgcattacatcatagtgaatacattcatttactgaaataatactaccaacaagctgtacaagtagaactcctacatcatcttttatacatgggtctttacatgcatcatttgtggtgaactcagatgtggcctccatattaatgtgagtaaacagtgttgaaagacaaagatgcagaagaaatatctgagtgaaacttccacaccaaattgagaacagtgttatttcagtaaaggcatattgaacacggtagtacatgttatacagagtttaaagtcacacatgtaaaagtgttgctgagagtgccgcttgtgtaccaggttgaaaatggtgttatttcagtgactggaggtattcactagtatgcaatgatgtaaaacctgtttttaaacacgtgtataaaagatgtttccaaagtgctacatggacatcaatttgagaaacatgtttttagtgtacaaatgtgttcactctattcaaacaatgtttaaagatacctaaataaaagatgtttctagaactatttatagacaaatctaaagatcaattttgggaaatttcacatcttaaaaatactgtgtcttgcaatatgtaaacatggtgtgtcttaaggttttttatttcttttatcagtcttctgtaggtttcagcatacagatcttacaaagattttgttagatatacttccatgtaattaacatttttagtacattataaatagtactgtttttataacttgaatttccatttgtttattccagtgtatacaattatttcatattgacttagcttcctatgagggtgctaaattcattctagtagttttttgtgatctcattgagatttttttatatagtcaatcatgtcatctgtgactattttttagtattttagttctgtcttcagtatactggtctttttcttgtatgccttggtctagtttggattagactaatgctggtataattaggtgagttggaaagttgttccttattttctattttctggaagaatttcagtaaaactggtattatttctccttaaatatctgatagaattatccagtgaagtctttaggctttgagcttcctttgttggaaagttttaaattatgaaatctattttttaagaggtatagagctattcaggttgtttcttcttgagtgagccttagcacttggtgtctttcaagaatataccattaaatattacacagccataaaaaagaatgaaatcatgtcctttgcagcggcatggatggagctggaggccataatcctaagcaaattaatgcaagaacagaaaaccaaataccgcatgagtacacatgtgcacaaagtagagaacagtagacatcgggcctagctgagggtggagggtggtatgaggatgaggatggaaaaactacccatcaggtactatgcttattatctgggtgatgaaataatttgtacagcaaaccctagtaacacacaatttacccatgtaacaaacctgtacatatcccccccaaactaaaataaaaaataaaagttggaaagaaaaaaaaaatgtttatatcatctaagttgtggaatctataggcataatattctatggacagaattgttcacaatattaccttgttttccttttaatatctataggatctatagtcccttctttcctgatagcataacttgtattctccatttatctcttagtctggctactggtttatcattttcattgattatttttctatttttaatttcatttttattattttgttccttctgcttgatttgggtgtacttttttgtttcttaaggtagatgcttatttttttttaagtatatgggaagttgacatttcttttattatttattacactttaagttctgggatccatgtgcagaacaggcaggtttgttacatacgtatacacgtgccatggtggtttgctgcatccatcaactcgtcatctgcattaggtatttctgctaatgctatccctccctgattcccctacccaccgacaggccctggtgtatgatgttcccctccctgtgtccatgtgttctctttgttcacctcctacttatgagtgagaacatgcagtgtttgattttctgtccttgtgttagtttgctgagaatgatggttttcagcttcatccatgtccctgcaaaggacataaactcatccttttttatggctgcatagtattccatggtgtatatatgccacattttctttatccagtctatcattgatgggcatttgggttggttccaagtctttgctattgtgaatagtgctgcaataaacatacatgtatgtgtgtatttatagtagaatgatttataatcctttgggtacccagtaatgggattgctggtcaaatggtatttctggttctagatccttgaggaatctccacactgtcttccacaatggttgaactaatttacactcccaccaacagtgcaaaagcattcctatttctccacatcttctccagcatctgttgtttcctgactttttaatgattgccattctaactggtgtgagatgatacctcattgtggttttgatttgcatttctctaatgaccagtgatggtgagctttttttcatatgctttttagccacataaatgtcgtattttgagaggcatctgttgatacccttttgtttgtttttttcttgtggatttgtttaagttctttgaagattctggatattagccctttttcaggtgaatagattacaaaaattttcttccattctgtaggttgcctgttcactctgatgatagtttcttttgctgtgcagaagctctttagtttaattagatcccaatttgtctattttggcttttgttgccattgcttttggtgttttagtcctgaagtctttggccatgcctatgtcctgaatggattgcctaggttttcttgtaggttgtgatggttttaggtcttacgtttgtctttaatccatcttgagttaatttttgtataaggtgtaaggaaggggtctagtttcagttttctgcatatgtctagccacttttcccaacaccatttattaaatagggaatcctttccccattacttgtttttatcaggtttgtcaaagatcagatggttgtagatgtgtggtgatatttctgaggtctctgttctgttccattggtctatatatctgttttggtagtagtaccatgctgttttgattactgtagccttgtagtatagtttgaagtcaggtagcctgatgcctccagctttgttctttttgcttgggattgtcctggctatatgggctcttttgtggttccatatgaaatttaaagtagttttttctaattctgtgaagaaagtcagtggtagcttcatggggatagcactgaatatataaattacgttgggcggtatggccattttcacaatattggttcttcctatccatgaacttggaatatttttccatttgtttgtgtcctatcttattatacatttcatctcctgattgctctgaattacactttaagctctctgtgtggctcacatatatggagccttttttttttttttgaacaggcactctggtatgtaacaaggtttgaaatcaaatttaagcctgggcacagtggctcacacctgtaatcccagcactttgggaagccaaggtgggtggatcacttgagcccaggagttcaaaaccagtctgggctaaagggcaaaatcacatctttacaaaaaacacaaaagttagccaggcatggtgtcacatgctcataatcccagctaccagggaggctgaggtgggaggatcacctgagcccaggaggttgaggctgcagtgagccatgagcatgccattgaactccagcctgggcaacagagcgagaccccatctcaaaaaaaaaaatttaaattacttataattcatgtccctttttcctgggtaaatgttttaataaaacaaggcttgaataaaacaagctgcttctggttttccaaatgcctctctgattgttcattacattctatgatttctttgcatgggaattagtcactggccatatctttccattattatgccatgtgctgattcttcctaataaactgggtactttggtgttgaatcactggatttgattcaggtttccatttctaaatgaaatccaaaatgtgaatttattccatgtccttatgcttttaagaaagaaagaaagccctcatattgacaattagaatctcagtaacagtgactttgcttccaaggataaacttgtaagctgtgaaagaacatgtcaagcatattgtcactttaagtccattgcaatttctgtttactttcctgtatcaaattttctccaaatatacatttgagctactccttgtggaattaagaaaactcacatttttcctgattatcttaatctctgattactgaggtatgattgccaccacagagaaaaaagctctactaaaaaaaatacttttttccaaaagcaaacaagaaaattttcaacctatgtgtacaaataacttgaatgtactccattttaaattttgactttggaatcatataaatgtttaattaaacataattgcatcagtaaagtgaaaatagctaaaaaaaaaatgtagttaaaacaaatgaacccaactatatattggtagcaaaagcacagaattatctcaagatttaaaatatagtatacttattaaacatgatggattatatcctaagaaaaaaaattgcaaagagctttaaactacatactaaggctctcatcttttcataactaatattagcattggtagtctgttattttttattttttgagacggattctcgctttgttgcccaggctggagttcagtggtgcaatcttggctcactgcagtctccacctcctgggcacaagcaattctcctgcctcagcctcctgggtagctgggattacaggcacccaccaccatgcctggctaattttttgtatttttagtagagatggggtttcaccatgttggccaggctgttctcaaactcatgaccttaagtgacccgcctgcctgggcctcccatagtgctcggattacaagcgtgagccactgtgcctggccagcattggtattttgaaatatatatcaccccctatgacatattcttgttaaaacaattaaacctcaatctattcaagcttctaggtctgcaagtgcagaaaaacatggaaatacgaataatacaagatgctgataacactacaaaatgcaatcagtgaaataaaaatgtaaaaatttgtacagaaaaaaatgatccaatttctttaacaaaatgcatgagaacaagttatagatgacaagcaacttaagaggcatattaaccaagtccaatgttttgcccttctttagatcctgatatgaacaaatctgtgaaaagacattcttgtaacaagtggggaaaattgaacatggactaagtgttagaaaatatttgggatttactgctattaactttgttaggtgataaaatgtattttggttattttttaatccttgtgtattaacagtacacactaaagtgtttacgggcgaagtaatgcctaggatttgcttgaaaatacagagaaaaacaagggataatttaaacaagaatgacaaattattgacattatttgaagcttggtgatgaataagtgggcattcattatactgttctctgtatttttgtgtatttttgaaattttccatcctgaaaagttttaaaaataacttaccctctctatctcacctgtgtcagtgtgcagatacctactacaacatatgctctgcttcttactgagcacaaaactagatattccgagacatccttccttgcaggtacatgtatacatgtgatagttctaaacaatggaatgtgcaccaaacatgataaatgaagctttcagatctgccccatacaaccctgtgggggaactttatcatgctcttcttccttgcaagtgattggtagaacaataaccagagcaatcttgaaagccaggtgttgcagatgacagagtgcagacatccagagtaacctaaagggtcatgtggaggaaataccccttcagccaactttaaatattagccctggactgttacatgaaaaaaaaaaaacaaatttgattaagtttggatcattaaatttgagtgtatttcttagagaagtctgcctccttaactaataaggatcgtctcttattcttgcctgaatcctcattgcctagcacagtgtctgaacatagcagatgttaaaaaatgtgtaagtataatctaaatcctttccatcacatctgtcaacagtgaattaatcatatctcgttctatgagagattattcttcctccatggcagagttgttgctcctttgcatttacatagttctttgggctagcttgtattacagtctttttattgcagtttgttaatgccttctcctctatctccctgaagacagcaataaatttttctgtactattttgtatcccatcaccaatcagaatgccaggaagatagtagatgctcaataaatgctgactaataaatgcctatcatagagaaaacacaaaatggatagattaaaacatgaaaatctttgagttctttgagtacatatccatagaaaggagtagagaagaaaagtgagaattattagatttttctttaagaggagaagccaagaaataggaattagagacatagaaaattgttaggaagaaatatatggaatgatactataagttcacacattctgattcagccttagttaaaatttatcatcgaaaccatagacataaagttaaaacaacatttagcaagaactcaagctgggaagagaatattgataaaggtgtttttgagtacataaagcagggttagccattgtctcttaggaataaactggaaaatgttatagagtacttacagaatagctaacaaattttaaattaaagtcatttttaaactacatattggcactgtaaggttgtttttgccaagtctatttactaaaggaaattttttttccctgtactactcagagatgtgttttaatagttgtcttcccaagactactcatctagaaccttgagactgcctactattatctgggaaactacattaaatgtttgagtgagataattatatttgtaaatttaaaattaaagaccaggcatcagtaaccttttgttttctttgtggagaatgagatagtaaatattttagactttataggttatatagtcactctttgtcaaaactactcaattttttacaaaagcagccataaacaatacataatgaatgggtatgactgttaaaataagactttatttacaaaaacaggtgacaggccaaatttggcccacataattcatcagcccccgttagactaagtttatcctaggagacttttttttttttttaaccaatattgtagcagtttacttcctataaattcacagattgttttttatatttaacttaataactattgaataactacaaatactgtaaactctcctactaaattgggaatgtatctttaagcttttctccttgcaagagatttttgcaagtaaaattcacgagtgattttaataaatggattttaaattagagtggaagatcttttactttcataaataccaaaactcttatataaatcaatggaaggtggaatttcaaggaaagcagaaatcttccctggcaaatgccaaagaaattttgacagagatgaaactgaaataattacattgtattttcctataaaatgattatcaagacagtattacaatagtgtgaactataattgtagggctcaagagactagaaagagctgatctgtcgagaaattcagactgtgcatttccaatgtcataaaatagcccttagcattgaaaggatttttttaattttttttattatactttaagttctagggtacatgtgcaaaacgtgcaggtttgttacatgtgtatacatgtgccatgttggtgtgctgtacccattaactcgtcatttacattaagtatatctcataatgctttccctcccaccccacaacaggccccggtgtgtgatgtcccccttcctgtctccaagtgttctcattgctcaattcccacctatgagtgagaacatgcagtgtttggttttctgtccttgcaatagtttgctcagaatgatggtttccagcttcatccatgtccctacaaaggacatgaactcatcattttttatggctgcatagtattccatggtgtatatgtgccacattttcttaatccagtctatcattgatgggcatttggattggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaattgccacactgtcttccacaatggttgaactagtttacagtcccaccaccagtgtaaaagtcttcctatttctccacaacctgtccagcacctgttgtttcctgactttttaatgatcgccattctaactggtgtgagatggtatctcattgtggttttgatttgcatttctctgatggccagtgatgatgagcattttttcctgtgtctgttggctgcataaatgtcttcttttgagaagtgtctgttcatatccttcacccacttgttgatggggttgttttaaccttgtaaacttgtttgagttctttgtggattctggatattagccctttgtcagatgagtagattacaaaaactttttcccattctgtaggttgcctgttgactctgatggtagtttctttagctgtgcagaagctctttagtttaaattagatcccatttgtcaattttggcttttgttgctattgcttttggtgttttagacatgaagtccttgcccatttctatgtactgaatggtactgcctaggttttcttctagggtttttatggttttaggtctaatatttaagtctttaatctatcttgaattaatttttgtataaggtgtaaggaagggatccagtttcagctttctacatatggctagccagttttcccagcaccatttcttaaatagggaatcctttccccatttcttgtttttgtcaggtttgtcaaagatcagatggttgtagatgtgtggtattatttctgagggctctgttctgttccattggtctatatccctgttttggtaccagtaccatgctgttttggttactgttgccttgtagtatagtttgaagtcaggtagcgtgatgcctccagctttgttcttttggcttaggattgacttggccatgtgggctcttttttggttccatatgaactttaaagtagttttttccaattctgggaagaaagtcattggtagcttgatagggatggcattgaatctataaattaccttgggcagtatggccattttcatgatattgattcttcctatccatgagcatggaatgtttttccatttgtttgtatcctcttttatttcattgagcagtggtttgtagttcttgaagaggtccttcacatcccttgtaagttggattcctaggtattttattctctttgaagcaattgtgaatgggagttcactcatgatttggctctctgtttgtctgttattgatgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaatgccctttatttctttctcctgcctgattgccctggccggaacttccaacactatgttgaataggagtggtgagagagggcatccctgtcttgtgccagttttcaaagggaatgctttaagtttttgtccattcagtattttattggctgtgggtttgtcataaatagctcttattattttgagatacatcccatcaatacctaatttattgagagtttttagcatgaagcgctgttgaattttgtcaaaggccttttctgcatctattgagataatcatgtggttttttgtctttggttctgttcatatgctggattacgtttattgatttgcatatgttgaaccagccttgcttcccagggatgaagcccacttgataatttttgtgggtacatagtaggtgtatatatttatggggtacatgagatattttgatagaggcatgcaatgtaaaatcacatcatggagagtagggtatccatcccctcaagcatttatcctttttgttatgatccagttacacacttagttatttttaaatgtacaattactgactacagtcccattgtgctatccaatagtaggtcatattattctattttttttttgttcccattaaccatccccaccagcctcccagcccctaactaccctttccagcctctgataaccattcttctattctctacgtccgtgagttcaattgttttaacctttaggtcccacaaataagtgggaacatgtgatgttcgtctttctgtcttagatctccggttctatccacattgttgcaaatgactggatctcattcttttttatggctgaatattacgccattgtatatatgtaccacattttctttatccgttcctctgctgatggacacttaggctgattccaaatcttagctgttgtgaacagtgctgcaacaagcacgaaagtgcagatatttctttgatatactgatttccttcttttggatacatatccaacagtaggattgctggatcagatgatagctctatttttagttttttgagaaacctccaaactgttcttcatagtggctgtactaatttacattcccatcaacagtatacaagggttcccttttctctaaatcctcaccaaatgctatgcctgtcctttgggtataagctgttttaactggggtgaaatgatatgtcattgtagttttgatttgcatttctctgatcaatgatgttgagcaccttttcatgtgcctgtttgccatttgtatgtcatcttctgataaatgtttattcaaatcatttgccgagtttttgactggattattagattttttcctatagagttgtttgagctccttaaaaggaattatttcttaaaaggaaaaacaaaacaaatctcagtaaaagtggcctgagtatcataaaattgatttattttccaaaaagtccaattaatgtcttaaaatatgaaatgttgacacagagaccaaggatgctaaaaataatatcttatgatgaaaataagggcacagtagaggttacctgagaataaatccagagaactggcagtgtttaattgatgaagaagcgcctacattgagtccagaagatcgtatcagctaatgaatatatagaaaatatgtgaaaatgatgttgcagtattgagggaacttaactgactttagtcttgtcctcagacaaaggaaacttggaggagtttttgttgttgttttatttaataattccatttaagaagaaattgcttcctctctgactagcaaatgctttttggttctcacctggagaggtaacttacagattattttattctccactagtcaccactcttccccatgctctagctgagtgattacaattgacttgaaaaatcagtatcttgtttgtggagagaaatacacatgtatatgttttctgtttcttctataagtttcctgtggctgctatagcaaattaccacaaacttaatggcttaaaacaactcatctttatgttctgatatcagacgtctgaaatcagtttcaatgagcaaaaagtcaagatgttggcagcatcgtgctgtctctagaaggtctggggagaatctgttcttcaccttctctagctggcattcctgggcttgtggctacatcacttcaatctctgtctttgtggttgtatcgccttctcttctgtgtgaagttgatagggactgaattgtgtcctccaaaattcatgtgttgaagtcctaattccaaatacctcaaatgtgactgcacagtagtccccccttttccatggtttcactttctgtgtggccaaccacagtctgaaaatattaaatggaaaattccagaaatcataagttttaaattgtgagccattctgagtagtgtgatgaaattttgctctcctgctctgtcccacccagtccagcacaggatgtgaatgatccctttgtccagcatatctgtactatatactctacctgactgttagtcacttagcagttaccttggttattagattttttaaaatatagatgtatataaggctctgtactatccgaggtttcaggtatccactgggggtgttggaatgcatcccctgtggataaggagaaactattatatttggagatagggcctttaaagagatgattaagttaaaatgagactattagagtgggccataatccaatctgtctggtatccttgtaagaagaggagatttggacccacagagagacctaggtatgcatgcaaatacagaaggaacatgtgaagacagatggaggcctcagaagaaaaccaaacctgctgacacctggatcttggaattttagcttccacaattgtgaggaaataaatttctgttgtatatgccatccagtctgtgatattttgtgataatgaatacactcttgtgacaacaaacccactcccaagataacattaactcattcatgagggcagagccctaatgacctaatcactcataaaattgaaatatatatactcaacactgttgcactgagttttaagtttccaaaacatgaactttgagggacacatctaagtcacagcaaaaggaaactataaagatcagagactcaaatccgggaaaaggcaatagctcactctgttggtgaatttcaatcccatcagtgtaatgcctcttttttctaactaacattactaagcatttactactcagaaactgattcaaaagtaatgttatctcccattgatatgaaatgtcgaatgtaggtaaaacagtgttcagttagtgaacccaagtgttcatcagtaggagaatggataaatttacaatgatatattcataaaaataacactcagcaataaaaaggaatgtgcccctatacatgcaacatggatgaataaatgtgaaaaatacactgattgaatgaagccttagaagagaaaataatctatggtttcatttatatgaagttcttgaacaggcaaaactgatctatggtgggaaacatttagaacagagattacctctggtggatggtgttggcgactgattagaaaagggcatttgacaaagctcagtgaatatacatttaggagccgagttgaaaacaaatactgaactctgattaatatgtgtgctgcgatatgtaggagacagcatactgatgtctctagtttcacttgaaatgattgaaaaatatggattgatggatgacagaaaagtagatggacaggtatgatatatccaatatggtagaaggtgaatagaaggacaggtgtagtggctcacagctgttattccagtgctttgggaagctgatgcaggaggaccacttgaagtcaggagttcaagactagcctgggcaacatagcaaggctccatctctaccaaaaaaaaaaatgtattcactgtaatattctttcaactttatgcttgaaaatgttcataataaaatgttggaaatgtggttaatataatccacctatatacttaattttaaaacattaattggaattagttgaattataagatgaacaaaaatgagaaatgtaaactcataaaattgaagtatgttttccagctctatcactgctaagatagagttgctgcctaacagcagcacttctgctcactattataataaaattaccgtgtcccccattgcctaaattttatgctgttttaaagctcttatccaccaaaaggaacaagcacaccttgccatgtaatggaatacaaattttggatcagtacaacatagggatatatgtgccaattaccaatttattgtctctcacccccagtccacctttctttgtccaactctatgatactgtactctgagtgacatagtagcaatacggtttccaagaatatcagggacaatgttgaaaggataaaggaataaatctagagggacttctgctagcaaattttacaatttgcttattgaataacacagtaataataataatgattgtggtatattagaacaagctgagtctgtgaaaaaccatagatttataataacttgatttttaagcatttaaaagaaaagtttctctatatggacactgcgttttttctgttacttatatctgtttataagtacttgctctttctgtctgtgtaagcaggaaagacaaatactgtgaataagccaaatagtccaattaaaaggaggaactattttaggaacagtaatgagtaatcagtgctgtgatttccacataacatccaagtagaagaaggaggttaagtagcatgtttaaatgtcctaaggaggagaagtaacttggccgaattgattcttcatctcctaacaggtagttctattaattataataaaatactaataaaaatttttgttgcttttaaatgttattaacagactaagtcaaaatgacgtaatgacttataaagtattgactaagaaaataattttaaaatatattgctgagaggactggggatgggggcaagaaaataaaacctacgtgacagctataaacgtgatagacttacagatgtaaaatattttttaaaagcttatttattttattttgtttttcaaccaacttcctgaaacataacctagaaaattgtcaattgttaacattaaaaagcaacaagtacacatgcacatgcgtgcaacacacaacaaaatttaaacgctaaaaatgaggttcagcccaatgatcggtggttcaggatcatattattttggaagaagcattaagttcctttgtcaacaatcaatcagttaacaaatcccagaagctatgtatgtatgccttttgtgtttgttaaaattactgcagtcattggaagaaatcaaaataatactaaaactccaataaaaattaaaaatacagcttattttgctacaaaaattatataaaaattaaaataataaatgaattaaacatatgtcattttagaacaggtttagatgtaactatagcaatgttctgtaatcataaatatcagtttgatatttaatggtttggaagtgattcaaaagtctacaatactaaattcagttgcaatcgtttaaaatacttcaaagttttaataagtcagtgctctagaaaaatccgttttcaatgtttgaattattaaacagtttaataaactaagtgtacaaatagttgcagttttcctttttgttcttgagtattaagtaataaaaatcagccagtcatttgaaaaatgaaattaaactgatcttagtttactttttattattattattattatactttaagttttagggtacatgtgcacattgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcatttcccacctatgagtgagaatatgcagtgtttggttttttgttcttgtgatagtttactgaaaatgatgatttccaatttcatccatgtccctacaaaggacatgaactcatcatttcttatggctgcatagtattccatggtgtatatgtgccacattttcttaatccagtctatcattgttggacatttgggttggttccaagtctttgctgttgtgaatagtgccacaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcatgaatgtcttcttttgagaagtgtctgttcatatccttcgcccactttttgatggggttgtttgtttcttcttgtaaatttgtttgagttcattttagattctggatatcagccttttgtcagatgagtaggttgtgaaaattttctcccattttgtaggttgcctgttcactctgatggtagtttcttttgctgtgcagaagctctttagtttaattagatcccatttgtcaactttggcttttgttgccattgcttttggtgttttagacatgaagtccttgcccatgcctatgtcttgaatggtaatgcctaggttttcttcagggtttttatggttttaggtctaacgtttaagtctttaatccatcttgaattaatttttgtataaggtgtaaggaagggatccagtttcagctttctacatatggctagccagttttcccagcaccatttattaaatggggaatcctttccctattgcttgtttttctcaggtttgtcaaagatcagatagttgtagatatgcggcattatttctgggggctctgttgtgttccattgatcgatatctctggtttggtaccagtaccatgctgttttggttattgtagccttgtagtatagtttgaagtcaggtagcatgatgcctccagctttgttcttttggcttaggattgacttggcgatgtgggctcttttttggttccatatgaactttaaagtagttttttccaattctgtgaagaaagtcattggtagcttgatggggatggcattgagtctataaattacccggggcagtatggccattttcatgatatatgcacccaatacaggagcacccagattcataaagcaagtcctgagtgacctacaaagagacttagactcccacacaataataatgggagactttaacaccccactatcaacattagacagatcaacgagacagaaagttaacaaggatacccaggaattgaactcagctctgcaccaagcagacctaatagacatctacagaactctccaccccaaatcaacagaatgtacatttttttcagcaccacaccacacctattccaaaattgaccacatacttggaagtaaagctctcctcagcaaatctaaaagatcagaaattataacaaactgtctctcagaccacaatgcaatcaaactagaactcaggattaagaaactcactcaaaaccactcaactacatggaaactgaacaacttgctcctgaatgactactgggtacataacgaaatgaaggcagaaataaagatgttctttgaaaccaacgagaacaaagacacaacataccagaatctctgggacacattcaaagcagtgtgtagagggaaacttatagcactaaatgcccacaagagaaagcaggaaagatccaaaattgacaccctaacatcacaattaaaagaactagaaaagcaagaacaaacacattcaaaagctagcagaaggcaagaaataactaaaatcagagcagaactgaaggaaatagagacacaaaaaacccttcaaaaaattagtgaatccaggagctggttttttgaaaggatcaacaaaattgatagaccactagcaagactaataaagaagaaaagagagaagaatcaaatagatgcaataaaaaatgataaaggggatatcaccaccgattccacagaaatacaaactaccatcagagaatactacaaacacctccacgcaaataaactagaaaatctagaagaaatggataaactcctcgacacatacaccctcccaagactaaatcaggaagaagttgactctctgaatagaccaataacaggctctgaaattgtggcaataatcaatagcttaccaaccaaaaagagtccaggaccagatggattcacagctgaattctaccagaggtacaaggaggaactggtaccattccttctgaaactattccaatcaacagaaaaagagggaatcctccctaactcattttatgaggccagcatcatcttgataccaaagcctggcagagacacaagcaaaaaagagaattttgaaccaatatccttgatgaacattgatgcaaaaatcctcaataaaatactggcaaaccgaatccagcagcacatcaaaaagtttactttttataagaatataaattccaaatgtatcaaagttttaaatatgagaactaaaataatttttaaaaactagaacatagatatatcttgttaaaaatattatgaagtggaaatagcaaactcagagacattgttttaaacttgttaaagtttgtatatattagaaaatacgaataaaaccaaaaataaactgggagaaatagtttcattacatatggcaaaggaagtgctaatatctctaacataaaaagctgataaaaacaaggaaaagacaaagcatcaagtagaaatctggcaaagaatataatccaaaattctacaggaaaagtccaaatgaatgataaatccatataaaggtgataggcttatctaatatttaaagaattataaagtttaacaccaatacagtattttttctcttatgagactaaacgcctaaaacatgatagtactcagtattggtaaaggatataaaaattaacatactctcaaacgctatctttgggggtatgaagtggtaaaatatttcaggaagataatttgacaatgtcccttaaatttttttttttttcagatggagtttccctcttgttgcccaggctggagtataatgatgcagtctcggctcactgcaacctccacctctgggttcaagtgattctcctgcctcagcctcctgagtagctgggattagaggcacccaccaccatgcctagctaattttttgtgtttctagtagaaatggggtttcaccatgttggccaggctggtcttgaactcctgacctcaagtgatccgcccacctcagcctcctaaagtgctgggatgacaggcgtgagccaccacgcccagctgtcccttaacatttgaaatgtgtatatcacctcatttagctattctgtttctagaaacttatttttacaaagaaaattcacaaatgcacacgaaaatgtatgcatgaagatacttgtcacagcgttggttgtaataatatggaattaggtcaaatatttatcagtaaaagactaagtcatattgtgcatatactgaaatatgtgataaacctaaatttactgacaatctgcccatgatttacttttatgagaaaaaagggaggtgaaatttattgtatatggtatgattccatagtttgaaaactaagatataaattggtatgttgctacctgcacaaagaggggaaaattacataaactaactttttagaagccattttatccagatagtaagattaaattgggttttcacaatcttttacatttctcttatagaaataaaaaatagttaaaaagagaacagaccagtaataggttccaaaattgaatcagtaataaaaaccctaccaaccaaaaaactgcactggtcacgatggattcacagccgaattccaccagatatacaaagaagacatagtatcaatcctactgaaaccattccaaaaaattgaggaggggggctcctctataactcattctctaaaggcagcatcaccctgagaccaaaactggcaaagacacaatgagaaaagaaaacttcagaccaatgtccctgatgaacatagacacaccaattctcaacaaaatactaacaaaccaaatccagcagcacaccaaaaagataattcacgatgatgaagtaggctttattcctggaatgcaagattgattcaacaaatgcaagtcaataaatgtgattcatcacaaaaacataattaaaaggaaaaaaactaatctcaatatttacataaaaagcttttgataacgtccaatgtcccttcatgataaaaagccccaacacaatagacacctaaggagcatacctcaaaataattagagccatctatgacaaacccacagccaacattgtactaaacaggcaaaatctagaaccattccccatgaaaactagaacaagacaaagatggccacgctcaccactcctattcaccttagtagtggaagtcctagctgaaacaatcaggtaagagaaagaaatgcatccaaataggaaaagaagtcaagctatttatcttcactgatgatatgattctatacttagaaaacactaaagactctgcaaaaatgctcctagagcttataaacaatttcaggaaagtttcaggatacaaaatcaatgtacagaaatcagtagcatttctatataccaataacatttaagctgagagccaaatcaagaatgcaatcctatttacagtagcctcaaaaagaataaaatacctaagaatacagagagccaaggaggtgaagaatctctacaaggagaattacaaaacactgttaaatcaaagatgacacaaaaagaaaaaaggtcccatgctcatgtattggaagaatcaatattatttaaatggccatactgcccaaagcaattcacaattcaacactattcctattaaactatcaacataatttttcacagaattagaaaaaactattctgaaattaatggaaccaaaaaagatctcgaatatccaaagcaatcctaagtaaaaaagaacaaagccagaggcatcacattacccaacttcaaactatatactacaatgctacagtaaccaaaatagcatgattctggtataaaaacagacacatagaccaatacaacagaatagagaatccagaaataaagccacatgcccacaaccatcttatctttgacaaaatcaacaacaataagcaatggtgaaaaaactccctattcaataaatgatgctgggataactggctagtcatatgcaaaaaaatgaaactagatccctacctaacaccataaaccaaaactaactcaagatgtattaaagactgaaatataaagcctcaaactacaaaaatcctagatgaaaacctaggaaacacccttcttgatattggccttgggaaataatttatggctaagtcctcttgcaacaaaccaaaaactgacaagtggaacctaattaaagagcttctgcacagcaaaagagatcatcaaaggagtaaacagacaacctagagaatggtagaaagtatttgtaaactatgcatccaacaaacgtctaatatccagaatctacaaggaacttaaatcaacaaacaaaaaccccattaaaaatgagcaaaggacatgaacagacacttttcaaaagaagatatacaagcagtcaacaaatatatgaaaaaatgctcatcatcactaacagaaaaatgcaaatcaaaaccccaatgggataccatctcacaccaggcaaaatgacttttgttaaaaagtcaaaaacaaaaacaaaaacaaaaacagatgttggtgaggcagcatctgtttctctgtttccctgcagagaaaagggaatacttatacattgtttttggggatgtaaactagttcagccaaccgtggagagcagtttggagatttctcaaataactgagggttgaactaccatttgacccagcaatgacttctgggtacatacacaaaagaaaataaatcattttatcaaaacgacacatgcacccatatgttcattgcagaactattcacaatagcaaagacatggtgaccatcaatggtggattgcgtaaagaaaatgtggtacatatattccaaggaatactatgaagccataaaaacgaatgatattatgtctttcgcagcaacatgatacagccggaaaccattacctaagcaaaataacacagaaacagaaaaccaaataccactggttctcatttataccacggagctaaacattgggtacacatgatcataaaaatgggaaaaatagacactggggaatacaagaggtgggaggaaagcagtggggaagagctgaaataaactacctttgggtactatactcactaactggatgacacattaatttgtgctccaaacttcagtatcatgtaacatacatttgtaacaaacttgcacatgtatccccgactgtaagataaaagttgaaaaaagaaaaaagcaaaagaaagaaaaagaaatccacacataggcatctggtatgtatatctatcttttgttatcttttcaagaatttgtttagaatgagccagttgccctgcagcttattaactcagagaaactagtcacagtcaagtttctgaaaatgcaaagatgcaggtagatgataaagcactcaccaaagtaataacatccattgtagtctctagtaaccagtcagttgttcttctgctataaatcttgacatatcacagtatgtcttctttcaaattgcaccccactaaccccacctctgacaaattacatggcatttcagcatggagggaggaaggacttacctgggatttggccatttcttcttcttaggaaagtggaaaactggaacaaaaaaagaaagaaaagtaattataatcagagcttgccttacagctccagattaatcacttttaaaacctcacttatcaactatatctaagaacattctgtaggagactgaatccctgtgtcctatgtaaggaagaaccatgttgaagtagtgtgacctgtcagattaaatgttaagtaaaaatttggagcaacagcaattcataatcataaccaatgcataatctgttcaattaccttgtagagaattatacccatgacttataccttcttcctcacatcgatagggagaacacactgaaggaagcagaatgaggggcactaagcactgcaggagaagatggggatggcagactcagcctgaccaaagaaatcaatcacatcttggtaaagtaagccactctcatttgtgtctggattagagtaggatgaacatcagaaaagggctctgtgatcagcctcctttactaggctttaatgtaactgattttccctttattatctcctaaactcctaatttagaacagcatataataaagcctttttgtgcagctttctatccaggcaccaagaggggaaaccagctcttatatgcagaagtgacatacaatgccttcctccaaaatgctagcaacaaccatctctgtaccctcaaaagtgaacttgttgagggcaagacttaggtgtcctatcacactgaatcccagagaaagcaaacaagatagaattaaattggcctgtgtttgttcttcagcctccccatcagagctgaactagagatgactcaaacacaaaatcattaggcttcctggggtttgtggtaaaatggaatatgagatatgctaaagatgttttcactacaaaacactcaaaataaccaaataaatataataccttgataattttgaactttacctgagctatgtgatcctataatcctcttaagaatctagggtgtggtggctcatgcctgtaatcccagcactttgggaggccgaggcaggcagaacacaaggtcaggaatttgagaccagcctggccaacatggtgaaaccccatctctattaaaaatacaaaaattagccaggcatggtggtgggtgcctgtaatcccaactactcggaggctaaggcaggagaattgcttgaagctgggaggcagaggttgcagtgagcccagatcgtgccaatgcactccagcctgggtgacagagatccgtctcaaaaaaaaaaaaaaaaaaaaaaaaggtattatgttggtgcaaaagtaattgcactttttacaataaaagtaatggtaaaaacttttgcaccaagcgaataaaattgctgggaaaaaacatcagcagtctgatcaaacatcccactttcccaaacctacttctttctagccacgtttatgccttcctataaaagaagtagacatgggttctggagcaaggacattatttctggagaagataactagtcaccctttgaaaagaagcttctgatatactactaggccctagtggacactgaacacctacctggaacatcaaatgactagatagccacacccacccatgaactgagtattgtcagatcaaccaagttataaaattggataggtactatagcagtccatcataggagggaaatggtatgtttgagattgattcagagggctaaaatttcatgaataggtggcccagactcccatgttccctagctctgctgcactcttggctcttcctaaacttgtatccatggccctacaagtagcttcctgtgaccagctgacagaggaagtgaaaacacaggcctgggtcacagaagagttggctcaatattgcaaccaccagacaaatctggttcaatttttatgtaacaaggttgtgagttatttttcaattcccatggaccctcaggtcatgtaacctgagtatgcccagataaaccaagcctgcaaccatagggagaacctaatgctcagacctagcagcagaaactgaattaagaagcagacactgcatgtcataacccaggatcaaatcaaattgagctctggcatcacctacatggcaggatgcaatcagataatgcctcccagcactaccttattgcaagatccaatcagatcatgcttcattgccctatgcttataaaacccaaccctgcccctagctcagggagacagatttgaacctttcctcctgtctccttgcaagtcaacttgtaattaagctttttctatttttgaaagcttgtgccaaagtattggtctccatgtgtatcaggcagcaagcccatggatttcttcgtagcagtatgttggagccaaaatcatactgctgctgtacctcagccccactcaaggatagccttaacaatggtgaagggaaatctttccagtggcaaagtcacaaaaaaatgttgaaaaacctcatctgttaaagtattatacacagagctgtgtatggaatatgctactatttttatttttaaaaaccaaaaaggatatgcatatctatttgcttgtgcatgtattaaaaatgctttgaaagaattcattagacaccagaaaaaaatggctgcctccagagataggtactggataggtgagagaagtgagagggagacttacaccttacaacctctgtatcttttgtatttacagccacattaatgtattatctatgttttaaaggaaaattaatgttcattatacaatggaatactatctttcaaaaattcttaagaatgtctttctgttgtctttatatatattaggtggatattacctaattctaatttgtcaattccagatccccaaaacacacacacacacgcgcacatgtgcgcacacacacaaaggggactttgaaaaagaagggtgatgagaatatatttgtccctaccaggtatatattcacattataaaaccaaagtcatttaaattagtgtggcactcctgcaaaaattcaacagaccaggaaaaatgagaatcaagcaacaattataagagcttgtttatgaaaaagaatcacaaaccagtgactggagaaggcattatggaaattggcaaaatatgtaggcataggcaggaaatcaagttagcatcacacttgatatcacataccaaaattatatcctccttttcaaagctttccagcctcatcatgtgagaaaagtgttttcatcaacaccctgactttaatcctggacaagctgcctggactgtgggaaagggcaaagagtctcaggtcacaaaccttgtaataatcatggtagagttctggacaaccgcttactatttctttgcctgcgtttcttcatggtcagaatggatggctccttgttatctgtgattccactttcccctagcctccctgcttccctccaggatgtccagcaccagccagtgtacaggcccaaggtctggacaccctccctgcctctggtttccctaagacactgcctgcggcagggctggggctgtggcagcacacaccgtcggggctggtactccagtgctcccccgcccaccacagtggatgagggccctaccctagagccccctcaggcctcctgcacttactgccaccaaactccaagtcacccctacacacccgcaactgcttttttacttcctccttaagagctcaggctaagccttccttttctctttgtgctgtcagtatctcatctcagttcaacatttgtaagtaaactaaacaatgctttagaatctttatgacttctacacttctagagttctcatattttcattgcatggctcatattttcatgattttgtgtccaaattctactttgcccgactttctgtatgattaatcataactcctcatttggtaatattttaataccacttttaatttccaatataatctcttacattgactggttagccagagcaagcttattattactacaactagttacctgtcaatttgtcagaacaccactggctctactggcatctccccgtgaaccgcctcttggtgttcataacgttgtgtagtccccttcctgtgaatctagggtggtcctgtcactcttcttccttaatagaatatggcagaagtgatagtttgcactgaaatttcatgaagggctggaagtttctactcttgagctcttaggatccctgagcaactcaggaagaatccaggaattctgctggaaatgccatgtagaaactatgtgaagagggagaagtcctgaaactacatggagagagaaaaagcacagcccagcttgttccttaatgcaatcacaggaatgcacactggcaagacgagcagaaccaagcagctcagctcagcctagcccagatttcacaattgtgagcaaataaaatggttgttgttaggtaaaatggcaataggtaaccaaaacatcagtgttagcaaagtggcataattaatatattgtcaaagttgtatttcaagagtgaagactgctaataatggccaaagaatctgtgctgcttccgcaaccatcaataggataaacatgctatgaataatatgacaggatatcaactttgtcttaaatcaacctttttacactaacagtaaagtataaataaaatgtgtaaattgtcctcagagggaaaaatactcagctgtattagatttcgaggacaggactgacagatcgtgctgtgccacagaattatgtcacatgctgtgagaaagctgttcctcaccaaggggcccatagaatcaaccattgggacttttctttcagcttctacaatgaacacatttctaacatgtaccagctctgaggtctgaacgagtcatccagctatgtatgctttcattctgggacatctgacccaggttaagattctggctagtcacattattgttaagtaaacaggagcataggagagctacggtaatactatttttaaatcaactccatcgtaaaaccagcaaggcacattcctggccagtcacaatgcacagtcataacatgtttttggctaaggaagcagtttagtaatgcttgcaaggataaactcctatgatggcagaatgtccagatgtcccggtatcacataacaatgtatacttttacgatatagtcatgctttgatgtacttatgcactaaaatgccacagaaaactttttaaaaacaaagtactaaattttgtcacgctgtcagcctacccccacatagacgtaatagtttttacatagataagactcctatacaagaacagtttaaaacaaagaaggcacattcctccatttcgtttctgaggacaccctactctgtatctgggtagctttcaataaactctcttctcactgtactctgcaactcgccttgaattccttcctgcttagacccaagagttctctcttaaggtctggattgggacctctttttctggcaacactatttcctacttcattttagcctctgatcctcagagaaatcactttgagctgattctttttgtatctacctacctatttctaaatactgcactatgcttatgcagtaagattgacaattttaggtacttccttctgctttttttctattatgggagatggaaatttggtgtttttataccccctctcacttacccttccatgatcctactaacatagtttctatcaattttttgttaatttattttcagtgatcacatttttatgactatgccatattgtccaaacagagataagcagtgttctatgattacattttcttccttatcctattttttgttctttcttatgcctttatgtttgattggcttgcctagattttatatacagtttaacctcattactaatggatttcatatttgtaaattcacctactcactacaatttatttgtaacccaaatcaatacttgtagcactttccccagtcatttgtacacatgtgcagagcagagcaaatttcaagttgcccaaggtgcatgtgaccagctgaggttgaacaaagcaatgccataccttcttgttttagctcttctaccataaaaagcatcctttcacaatatatttagtgctgttttagcatttttgtgctttttgttgatttttgctgtttaaaatggtcccaagtatagtgctaaggtgctgtctagtgttcctaagtacaagagggctgtgatgtaccttaggaaaaaatacatgtgaaagagaagcttccttcaggcattatagtgctgttgtcttgtgagttcagtattaacaaatcaatatagtaaatgttattttatatatattttatatattatatattaataccatttaatactaatatcgcatattaaaggcaaattatgtattgatccgttgacaaaaatgttgtgataagaagctcataggaatcttaccctctggtgaatcatgaacttttctatgccacaatttctcttgactatagaatgtgccttgtgggacctttctcaaagcagttgtgaaattttaatgacattaaacttctaagactgagaatcagtgtgctgtgaaaattaatactttattatgtgaataggcactattctagagaaaagatcaatttgtttgggcagtagccttaggactcatcttatttcgacattttattttatagctgaagctgcttaagctcagagaggtcaaaagattatcccaatcccataacatcagtaaaggacagattctgggtaaaaccccagtgagccttttggatccttcagccactgtgctgtcactgttcaccaggaaactattttgaagaatgttagagttctaattcatctgacaattaattttaatgttcagtgaaggatatcttatgggtgcagtgattgtggtctgtattccaaattttagggcctgattagacagaaacagaaacacaccatagcattgcctttttgactgggtcatagtttttcagcctctgcataccccatattaatattcaatagatattaggatttaatcattcaatttgataggaatttctgacaggatctgcctgactctgatacttttctcaccagaattgctgatgagagtctgtattactcccagttcacactgagccaatgattatgtttgttgacattaggtagaaatataccttgtcttcccaaaaactgatctcagctcaggaagccttgctcttaaccaataggctatatttattcctaaaactgcatttttctcactttgcttgaaacacttttaactcctccttgtccaccccctcaggttattgcaatttattctggactaagatgagaacctctctctttggaaagcctaccctgactccccaaagttgggcatgactattcccatggcacgacttgaactttatattatccaaatgaaaaaacaaaaccctctagtcccttaagagtagcttaaatctcaacattgatatttgaggttaatgttttaattaatcttgaaacattaatctagacagactgatttcacagtccctaaaacactgtgttcaactgtaagattttacaagcaattcttcctgtctgtaaagtagtaaaggattttggcctcctttttacctattaaaatactaaataaagtccagttttaaaattaatttctgatatattcatcatggtcaaaatatatccaatatttgattatttctgtcacctccactgttaacactatgttaacaccttatctcttttaggggtaactgcaatacctcctaattggaatccctgctttggctctagcctctactttgtcagttcttaacacagcattcagaataagcctgtttaaatttgttagatcacttaaaaccctccagtggctttttacttcacttagaataaaagacaaagcctttacaattacttacaaggccctattacctttaatttccctctgttttcctcctcccttacagtgctgcagtacattccaggtccattcctagcctcagaccctttgcacttgctctaccctctacacagaattctttttccatggagagctccatggctcacttgctccctcacttgttttagtgagataacatcctgggatctgagtatgtgcatatgagcttctaccatatgatgttacataaccctgttctttacaagccccctaatagtatgaaactctatttccatagaacatattcctgtagaattactgtagcaaagagtaacagcaattttaaggctcaggattggccaaattgtttttccaaaaagtcgttatcaatttaccctcaacataagcataagtatacatcactccatactcttgctgaaaatggctattgtcatttttgttaataaaagtgatactgctttgctttaatctgtttatgttcttcgtcaaaattttaaattaggtgtccatttaattaaaaagagtttgtactgtcacaatcatggcaaatatttctcctatttttgtctgacttatatgtttttcacccagtttaaaaatttttatgtggtcaaattgtgtattttttctgagtgtttaaaaatccctctagagaattttaaatattttatagtggaacctcctttaaaaaaacaaaatcaagtcatttttgcatatgaagagataaaatgtggctacacttgcagttcttttgcttctgaagatactagtcttcatgaaaccacatggaggtccatggaacacagcttgaaaacctgtattcaatcaatgttttattctgatataggtcatgaaatgaaagtcttttttattaaagagttaaataatgatctcagcacaatttactgaataatcctcctattcgcagatctttatcatgtgtgaactctataagcatatgcactgtatgttcaaatacacatatataatccatacactggtatatttctaagctatttagtgacttagaatcctaactttttttttcaaatatacaattaaattctccattattacaacttcatataccaatatacaatttattatatgttagggcaatatcattaatctttcttacaattatctttgctcttctccaatgtctattttccttaaaagactagaacatctttatctcaaattcattgggattttcatgagatctgaaacaaatatataaattaggaacattcccttaaggaaaattaagactcctctagtcaagtcctcttttatatttccccgttttttattattttcattctgcatttttgtaaattaaaaaccagattttttgacaattacatttcctgaatattccaagaatttagaaaactaatgattttgtatttttgcccaacttaatgagtttaaattagtgcacttttcacctttaaaaacatattgtaggtactcctttatgtttgtctaataaaccttcacctggtctcacatttaagcaatatcacattttcatctgttatagcacataattagaaatttttaacccagtgttttcaacattttaaaatgaagcattgaacgtgttttgatacatttggctttaatcatcttgatccgtttattttaatattttaggccaacttcttggggatttttttggtagtcattgctacagagactgaataatttttgcttttatcttctcccattttgaaaggtatatgcactttttttagttttattaagttgtaattttaggtttgtaaaaaaaaaaaaaaaaggcctttcttaaattgtcattcaaaaagaaaatgttattatgagtccctgctatttaagatcagaaatgtggcacttatggtctctctccagttgccggatgtagcaactaaaaacagaaatgaccagttaaatttgaatttcaaatgtatgaaattttagtgtaagtcccatgcaatatttgggacacccttatactaaaacaattattctttgcttatatgaaattcaaacttaactgggtgtcctgacaaccttactctcctacccagactcagcatttgtacactttacactcagcatttgtatatttttattgcacatttaattttttgaagttttggaaactatccagacaactgcatatctaattgatttcagtgcttatcactagtccttttataccatgatttccacattcacaaactctctttaaggcacatatacgctacactgttttcttgcttatcaaaaatatttgtttcctgcacatatgaaagacacttttgttataaaactggtgataataaacttttcaaatctcaaaattctgaacgtgctgctccattgccttctgagttactgttgcagagctctgtatccaccctccctttctggttttgcagataaccagaatttttctttctgcatgcttttaattgcttctttctaacctgtttctaaggttgctttaatactggttttgcctaaaacttagtgaccatatacttttaactcagagaaagtttcttaatgtctttgatcattgattctatgccaaatgttctttcaccttccttagagacacctttaattctcacactggacctccatcctctgatattcatatctgttctttcttagtttccatctcattatccttttcagatacatttaagatcagatcaagtttatctattaactatcaattattttatattcttcagtgttactttttattgcatttattttgatacagtatttcagagctccctgaagtccttctttgttgtatctatttctcttttcactttagatactcttctctacttgtatatttctactctatctttactgagttcagattctctgttatgccactaaggacaccaacatttctggaaatttcctctgaagcctgcagcagctaattttcagggcaataagtttccaggtctttaggatgatattcttttcttcagtattgcaattccctctaattttcctaaacatgtccacttttttttctcttggtattacttcagcatatttgtgtatcaataattaagactgtgtattccgactaactctattctgagataatggccaaactctctttttacataattagcttcagggttcatcgttgcacagagttctgagttcaatgctgtccttgcagatatttctctattaccactctgttctactgagattaaataaaattctactgcttggatctctaattccgaaccaatggagtatcttccatttctagcacttttgtccatacccttcacaccttagagaaaattctgtacttcttgttgtttggtatctgaacctattattaagcgtggaaaaccggaaagggaagggatgagtgcactgtagtcacctcaaagtgaagcacccctgcaacagaaggatggtccctgggttttctggttgacagagataacaactcagatacactgtctcagacacaatgtcatacaatgctttcctatcttttattaggtggcttttgtccataaacaattgaattctaccggccaaaactgagttttaagttctatgtgtttccatcttttctgttacttcctagggagtttttaggggagttaagagatgtcgtttaacagttggccaaccagtttcaattcaaaccaaaatttaagtaaatattttgaagacagtgaaaatacaaaattgaacacacaatttcatgcacattaaaatgcacagaaaaaaagactagaatgaaatagaatgaagagttttctccttaaatgtttaatatatttatgactgtattatatttatagtaggtaaagaaaaatacactataattttaaatatatagggttttttctaaagatctccttttgaagcaaataattcttagtgggagataggggaaactataaatgttgcttgggattacttgtgttatttataagatttccttaacagcaggatttatagggtttaaaggttaggtaaactttgattaaagctgttaactaaatgaacaatatttataagtttcctcttctatgattattgtgaagatgtgaattatgatcaaatcccttataatattcacggcatttgtaaggtttctctcctgcatggactctttgatgaattcgaagagctgagctatgactgaaacctttaccacacttagcacattgataaggcttctctcctgtatggaccctctgatgaatgtgaagattagaactgtgactaaaaccctttccacaatcatgacatttatagggcttttctcctgtatggactctctgatgaatgagaagatgtgaacgctgactgaatcccttgccacactcttcacatttgtagggtttctctccagtatgtactctttgatgagtgtgaagctttgaactcttactgaagcccttcccacattcaggacaagtatagggtttctcccctgtatggactctctgatgaatgcgaagatctgagctgtgactaaagtcctttccacagtcatcacatttataaggtttctctcctgtatgcactctctgatgaatttgaagatttgagcgctgggtaaagcctttaccacagtcttcacatttataagacttctctcctgtgtgtactaactgatgaattcgaagatttgagctctggctgaaacccttaccacactcatcacacttatatggtttttctcctgtgtggactctctgatgaacatgaagtactgaactccgattaaaactcttaccacactgattacatttaaaaggcttctctcctatgtgaagtctctggtgaatgtgaagtaatgaatttctactgaggtctttatcacactcaattttatagaatttctcttctgtgtggactctttgatgattgtgaagactagagatctggctgaagctcttaccacatgcattacagctataaggtacctcccctatgtgaactctctgatgaaagtgaactccggagctctgatgaaagttaccgtcaacttcatcacatccgtacagcttcttacctatgtggtttcttggatgtctatacaagtctgatctctgagagaagcatgctttacagatggagcattgacagaggttttctccaggttgatttctcttgtggaaaacacaccgtgagttccaataataaattcctttacatttattacatccacagtacttttcttccattgaatctctcagtaggtcttcttgacatatcaccccaacatactgtggaagggcttcctccactgggatataagaatgctgaactatgagcttctgttctttttccatggagaggtttttcctggatatgccaagacggtatctgcccccttgaaaaccatgtgaaccactcatgtagatttctctaccatagtcttgagtggtttttgtttctaaggactgccaaggcataaaatttttatattttaagttcctgagacttttgctttcaaaagtcagttcatagttcccataccctggtacttgtgtggagagtattaaccattcctgacactgggaacgatcttgctgtgtgaggtctttggaatctgtcccttgaacagtttccccatagttctgattctcatacatctgggcgccagcattccaccagccttgccagtaggaaaaattttcatattctaagtatctgaatttttcttcttgggatttgtagctctcattccagttttctagaaaaataaaaagataatcccatggtgagataaaagctgtgttgaaaaatttccaactatctaaatcaatgacctttaaatgataggaatatatgtgtggctgggggtaggaaagaagggttatgactctgcctgctccatttgggtctgaaattcatttattttgttcattcatgtatgtattcattcattcacttatttattcattccacaaacatatcttgagcaggcactgttagaaagatttaacttctatttaccacgcactgttagaaatgagaataatgccaactgcttcatggaaatagtcgtaaagactgagatttaattagattacttcattttgtatgctcttataagaaacaaaatatattgttcctatttttctgttctagaatagcatggtagattgagaaaaaatgactacattaactcactactttacctacacctttggtgttctccttccacactctctctatgcttggctacacaatttgcgttggtaactgggaaaataacaaaagtaacacaagcagagacttgaaaagtccttgccctctctcgatgcttttgaaaatcccgtgaccaccaccatgtaagtgtgcttgggttggcttgtttgaagagagatatatggccaacacattcccactacctccactgatactgagccgactgccccacatttgagtcaggccaggcagcttaatcttagaccattcaaccacaaccaaatcctccatgataaaagatcatccagtcaatgagaatcataaaaaataataaagtttgtttttaagccactaagtctggcatagtatgttatacaacaaaagctaacttatacaaatagcatgaagagagaaaaaatttaggaccacacaaaattgactacatatggagatatgtgttttaagggtaatgcagagaataactaaaactaataatcacaagtatctattaatgatataacctaggtgtcctggaatctgtcttgctttatcttctatttgtaacatgatttaagaaacatttttgagaatatctcttccaacacctcaatataacacccagataaaaaaacaaaatactcaacaaaactgctcctagaagaaactctattccctatgagacgggataactttacctactgacatgacatttgtgtagttctcccacatgacctccctgtagagtcttttttgagaagaatccaggaatttccactcctcccatgtaaaaataatagtcacatcttcaaatgttactgccatctggtcaaagatcaggctttctaggaaaaagaaatctaagtgagaagatggacaaagataaagacatttagcagataagatatgtggcaagccgaatagaaaaaacaagaacttcagtaaaggagaaaaccaagaaaggtaaggagaggtaataacaatagtagttaaatagctaaataatatatccaatcatgaaacatcatcactatcaaaagaaacacctatacagcacttgtctactaagttttttacctatatttcagttactcctcacagaaatcccatgttgtaggtagctttctactactattatgcattttagaatggaaaacagataaatatatgtattaaaactgcctaaagtaattattttagtggaaagaacagatcataaattggttatgtgacaaagccattttattttttaaaattttcattgtatctatttgatcacacattctcaattctaaatttcaatttaaaatattgagtacctactaagaataaaggaaacagatacttttaaggagtttacaacaaaatggaaggaaagccaaatactatcatcatcagcagcagcagcagcaccatcatagctgcagctaaatcttattgaatgtttattgtatgaatagggctatgttatctcatttactctcagaacaatccaataaggtattattattcacaataaatgaatacgcaatctaacgtttagcaagactaagttacttgtataagattatgtagttacatcatagaggtttttaaacccagcactacctattaaataaaagtgagataaattaaaaatgtttgatgaagggttgtcagttgagatttccatatactgtcataatgtgttaatgaagaagggcaaaggaaagatgtactgaaatattcaagggtaaaaaatatgccaccaaactactattttccaaataaactacatgaaaatacatgtctaaacaataaaacattaaccacaaataagaactcaagaatgagaacattcagagccatgtatttaaatacctagtggtatatttttaatgtttataaaataagtttaataaattttaaatataatgaatccactttaaatatataaattaaaaaaagaaaaatttgggatgctcagaaactcaaactacaggactgaaaactgtgaaagttggtatctggaaaataaatggactcactgatctctaattttataaaaagtacaataaaaataaaactcaatctgtagttactggatttgttattttttaaaaaatttaaggatttattttaaaaacatactagcaattaggagtctaatttcttttactggaaataagttcataaatatttaaaatactgaaataacataagtaaaaattaaaagcctaccttcccccaaataatttaagaaataaccactataaccagttttcactgtgttctaaccttcttccatgtatacacaacacacattcatacttcactgatttttttccttaataaagacatgataattctgcaattttctttttttcatttaatacatagtgtacaacttcccacttcagtacaggtagacctgtcttatttgtgataatttttaaacatgcccacaaattatttgatcctttccattcaagaagtgaagcctaattccccaccccttgaatataggctgaacttggtgagtaacttctgatgaataggaaataaagtggataaggaagtagtggcatgcaactttggaggcggggtcataaaagtcactgcagcttctttcttgctctctctctgggatcactagctctgggaaaagctatatgtcatgtcatgagaaaacctaggcagccctgtggtgaggaactgggaccttctgctttcgttgagaaatgagacatcttgccaacagccatgtgagtaaactatcttagaagtggatcctccaaccacggtgcagctttcagatgactacagtccctgctgacagcttcactgcaacttcatgagacaccttgagacagcttagcttcttccagattcctcaccctcagaaactgggtgagataatgtttgctgttttaagtattaaataatttgttatgcaataatagataactaatattatttgtaaaagttacgtagcatttcattttattgatgtccaagacttaaatgttcccatattaatggacgttaagatcatttccagtttcttggctacaacatatagcaaaagaattctcttaaatatatcatatttctattgtaatatttatatatgataatgtctatatgataaatataaataattctatatgacaaatagatatatttctgtatgataaacttctagaagtgaaattgtcaggcatctgtatttcagtttactaaaaaatactacaaaatgtcccttgaaaatatttttaaaaatatgttacaaatattttcccccagtggagcaataaaagcaagacatctatattcaaaattagtaagtacaataaatctaaacagaaaagaagaaaagaattatataaacaataaactaagatgacaagcctattgatagagaaaaggatactaaaattgagttttaaaataaagtggcatactgcttataagagatatactccaaactaatgaattctgaaggattaaaaatgatctggctaatgttttcttgtggtgtttaagttctttattcacttcctgttagctggttcttttgttccagggacttgattagactacagttcattctttccgacaagaatacctgcctatatacttcctatagtacattttagttagctaaactgaacaatggcttcaggtgctgtcagcccagtccttccattctaagattctcttaaacctttcactaaaagttttagcaatagatgatcatttcctggatttgtgatttcattaggttttacaaattggttgtctaattctgtaattctacataccttgtgcatacatatgctataattcttctataatgaaaaacttgccattacaaattttctggttatcctgaaatgtaatcctaatgaaaaagataagataaaatgcttgattatctcccaaacttactctctttcaaaaatcaattttcagagtaatgagatggggcaaagcaatcaccaactatgaccagtgagatttgtattattttgcttttcagtgttttcatactcactgattcttacatactggatggattgcaattaaattgcagtcatttttcttttcgatgtgcaagattctctcatctcagactagtaggaatcccttcaggttggctcctgggtttgtaatatgaccttttttggtgtttgagagcttccttactttctggcacaacaaatgtccaggttcattcttgttccatttccttgaccaactaggatgtattatttctcccaggagtctgataattttccactccttttttggtatataagtaaccccccaacaatattatataaacttgatatctcttttgtcctctcatctatgaacacagctctctccgattattagttttctttaaggtccttttcaagaaaggtcagttaaaatcattctctatacatctggagttttgattccttcttctaatattgtcagattttgcttatacaatttgaaatggattcttagctacatattagttcatgactaatacatctccttgatggatcttaactattgaacattattgaccttttattgtgacattaaataagtctcttgtaaagagcacagagaaagatttctgtttttcattcaatcagtatgactcagttattttattatccatgttcatttattgtgattactaatacaggcttatttctaacatattattttttattcttcctttcctgtctcttagattgacagttttatgctttaatttcttcacatcgccaccttttcatctatatagatttcaatttcacacatagtttctattattttaataagtaacctaaatatattttaaacatatacacttacctatttttctaataagtcaattaagaagagaaactaatccaggaaaggctgcatgaaatatgacaagaaaggtgatcaagtaccttggtgaagtttattgttatcataaaacaaaactaacaacaaaagaaataggagtgaacaaagaaaaaaggagacatagaaagtatatcagtgcctacatatctgaactacaattcttgacaatacaaacatgaggggagaaagagacagatataagagtgtgctaaagtccatgtcttattaaaaatatgacctagatattaatacatttaaaaagtcagtaggggtaaataaaagtcaatgtgggttttaagttaagcacaaccatcataagaaacaaaatgaaatctatgaaaaacaaaataaaaacagaagacaacttgctccacgggaaaacagaaaataagaaaagatggcaaaaataataaaataattataataaatttaaataatttaatattacagattaaaagactcagattaaaaaataagatttagcatgtggtttagaacagatacactaaaaagaaaaatatttaaaaatacaaggataaaaaaagattgcaaaaatacgaatcaaaagaaagctgaaatagcaaacttaatttcagatgagtaaaatttatggcaaaaataccataagggacaaaaatgttttttatatgaacagtaggaaaaaatatccaaaataaattgaatccacagataaaatttcaaaatgtatcaaatgacaagtgtcacaaatgtgaggggaaatatacataccattagttgtaatgatagatattaatatgtccctctcaaaaaattatagcaagcaaacaaaaaaccctaataatatgaagactaaacactacaaataataagcttcagttattttatctgtgttgaactctacaccatcaaaatacaaaatacagattattttcatgaatacatagtactataagatagaccatgtattagtccataaaagaaatcatgataaattccaaagcatcaacataatatagaatacattatctagctacaatgtaataaaatttgaaattattaacaatagaattttaaaagtccacacttctgaaacccaagtaacatactatattattaaataatcttcaaatttaaaagaaaaatataacaattcttaattgttttttcttcaaaatctaaatgtaataatgacaataattacgtaaaaaatgtgcaagatccaaatgaaatacttgaaggaaacaaaaatggctagagcagctgggcaaagtggcacacacctgtaattccaagcactttgggagccccaagtgggcggattgcttgagcccaggagtttgagaccagcctaggcaatatggagaaatcccatctctacagaaaatacaaaaattagccaggcatggtggcccacacctgtggtcctagctactcaagaagttgaggtaggaggagcaattgagcctgggaggttgaggctgcaataagctgtgattgtaccactgcactccagcctgcaagacagagcgagatgctgtcttaaataaataaataaataaaattaaaaaaccccagctagactaacatcatactgaataggtgaaggctcaaagtatttaccttgagaaccagaaaaagacaagaatgcccactctcaccactcctattcaacacagtactggaagtcctagccagagcaatcaggcaatagaaagaaagaaaaggcatccaaataaagacaggaagtcaaactatctctgtttgcagatgacatgattccatacctagaaaatcccagagtctctgccccaaagctcctttagctaataaacaacttcaggaaagtttcaggatacgaaaccaatatacaaaattcagtagcatttctatataccaacaacatccaagctgagagccaaatcaagaatgcaatcccatttacaatagccacaaaaagaataaaatatctatgcatactgctaaccagggaggtaaaagatctctacaacaagaattacaaagcactgctcaaagaaatcagagatgacataaacaaatggaaaaacattctatgcttatggatagactcaacataatcaaaatggccatactgaagcagtatacagattcaatgatacttccatcaaactaccaatgacattcatcactgaattagaaaaaaaaaactattttaaaattcatatggaaccaaaaaggagcccaaatagccaaggcaatcctaagcaaaatgaacaaagctggaggcatcacattacctgacttcaaactacaaagctacagtaaccaaaacagcagggtactgatatgaaaacagacacatacaccaatggaacagaatatagagcccagaaaaaaatgcctcacacctaccaccatctgatcttcaacaaagttgacaaaaacaagcaatggggaaaggactcctattcaatgaatggtgctaggataactggctagccatatgcagaagattgaaactagaccccttccttatacaatatacaaaaatcaattcgacatggtttaaagacttacatgaaaacctaaaactgtaaaaaccctggaagataacctaggggataccattctggacataggacttggcaaagatttcatgatgaagacaccaaaagcaattgcaacaaaaacaaaaattgacaaatgggacctaattaaactaaagagcttctgcacagcaaaagaaactatcaacagagtaaacagacaacatacagaatgggagaaaatatttgcaaactatgcatctgacgaaggtccaaagtctagaatcgatgaagaatttaaacaaattaacaggcaaaaaacaaccccattaaaaagtaggcaaaggacataaacacttttcaaaagaagacatacatgcagtcaacaagcatataaaaaatgctcaacatcactaatcatcagataaaggcaaatcaaaaccacagtgagataccatatcataccagtcagatggctattattaaaaattcaaaaaataataagatgctgacaaagtagcagagaaaaaggaatacttaaatacgctgatggtgggaatgtaaattagttcagtcattgtggaaagcggtgtggtgatttctcaaagaacttaaaacagaattaccatacccagaaatcccattactgggtatatgcccaaaggaatataaactgttctaccataaagacaataagcatgtgtatgttcatttcagcactattcacaatagcaaagacatggaatcaacctaaatgcccattaacaatagacgggataaagaaaatgtggtacacatataccatggaatactacacaggcattaaaaaagaacaaaattatgtcctttgcagcaacatggatggagctgcaggccattatcctaagtgaactaatgcagaaacagaaaaccaaatactgcacgttctcaattatattttcgagctaaatattgagaacacatggacacaaagaagggagcaacagatattagggcctacttgaaggtagagggtgagaggaggaagaggataaaaaaactacctatctggtactatgctttacctggttgacaaaataatttgaatgtcaaacactcatgactcacaatttatataacaaagctgtatatataaccctaatcctaaaataaaagttaagaaaatggctagaaataaatcattcagctcaggagtataaaaaagagaaaccatcccccattaaaaaaaaaaaaaaagagcaaacttcaaaaaagaagaataaagtggaagtcaaagatataagaaacaaataaatgattgagaaaatgcataaagccaaaagatgttcttaaaaatttaatgtcagaccaatgaaaatcagatttttaataacacggttatgaaaaaatacagagcaaaataaggaaataacttttgacataagatttttcaatgatgcaagggtgttgtgaactatatatataaggatatttatgagctataggcaaatacacctaaatatgtacctaaataaatggatcaattcccagtgaagtataaaaaaaataaaatggcaaaatagatgaaagactaataaaaaatcatatagactagtaagtactaaattaaaatggtagccatgctcttcctccctctccctaatcccaaggctctaagagttttatagctgagttctagcaaacatgtaattaacttaattactattacaatacatagttttcaaaagtagagagtgaaaattgccaacttattttatgtagctagtataatcttggattccaagaccagataagaatgatacaaataaaattaaattacaggcacatttgtaaattttgtaaatatacaaaaatcctaaataaaatattagctaattaaattcagtaatatatcaaatatatgcatcatgatcagacagtttattataggaatgcaaggatcgttcaacatgagaaaaatctattaacacaattcactatattaatagactatagaataaatccatgataatctcaactgatgcagaaaaatcaagtgctataaagttcaggaagttcaacaccgatgtattctcttaaaaacacttgtagcaaactagaggaaaaaaataaactccctaaagtggcaaaggttaaatatcaagaactttaagcttaatggagaaacttcacatatattccctttacaatggtaacaagaatgaccaccgtcactgctgctttcaacacagcactagagattctggcaaatactataagaaaaagaactaagagctacaagaattagaagcaaaaatataaaatgtcattatttgcatagttatggccatctacctagaaaaagagtatacaataaactataaattaagagagttcagcaaaactatcagatacaataaatagtttaatgactcagcaatcaactactagaaagtaagataccattcacaccagaaaaaaaaccctatcttaaccaagaatacaaataattatttgaagaaaactttcacattccaataaagaagaaagattatctaaataaaaggagaagcatgcttccacgctcttggatgcagtaacttaaattcaatacattccagtcaaatattcagatggctattctgaggaacgcaatagacttctgttccttaaaattgacaaggaaggaaataagttggtaaagacaagtaaaccaaacaggaagactaccagatactgacatatcaccaaaactacagtagtaaaatcagaagagacaaatagaccagtagaacagagcagagggctcagagactaaccaatgtgcttctttatctacaaaaacatattaacaatagaggtggcattaaaaatcaaagacagaggtaaggattatttaccagatagcattatgaaaactgattaactatatgagataaaataaaactggattccaacttaataccatatacaatggttaagtatatagatcaagtaagtacttaaatgttaaggggaaaactataaaattaatgaaaaaagatggaattaatgaaaaaaaagatggaatttgaaaacatttaccactgttaaatgaatccaagagccagtcctttgagaggaaaaatattaataacaaagtagataaatcacaagctagttaatcaaaggggggaaaaggagcacaaatagaaaaaaataaaaataagattagggaaatagcaactacaacctttaaaaataactggaacaaaagttttctcaaattctttcaaattttcaaagaacagattatttgatgctatgaaattatcccaaggcatcaaaaactgttcaaggcatcagaaacgaaaaactcttcaagacgtcagaaataaagtgaaacataaggccagtaaaatccagcagcacttgaattcataatctactaccatatcactaattacttcaacatttagtagcttaaaacaacaataattatttactatttcttatttttttttctgggtcacaaattcaggagtggcttagctaggcagctctggtttggatctcacaagataagttgttggttacatctgcagtcatcaaaaggcttgactgagaagaaggattcaattccagggtggctaactcccatggctggcaggctggtctaaatgttgatgagagatctgttttttctccacgtggtcctttcaagtggcgggggctatctgtcagcatggtgcaagttgcccaaaagaaagtcaagcaaaagctgcattgtttttatgacttagccttggaggtcacatcctatcacttctactgtactccactgatgaggcaatcacaagccatggctgtatttgagaggggtgggacacagaccccacctttcagtggaaacaatgtcagtcacatcataagaagagcatgaaaacagcataaattgtaagtgttgggaaaaagctgagtgttgtgaaggaaactgaggcagggtttgcataatgtcctttggaatgtgtctagacttgctggctccttgcttctagccctcctaggctcctattcccactatctaaagtagcagaacatgttccatataaatgctaaactatcgcagctgtaaatcatgtgcttaatgcaacgtgtccttttgacctccacattctcaccacctgtttctctgttggattaccaataaatagcgtgggctcccagagcttggggccttcgcagcctccgtacaatagcgatggccccctggtgttcccacctccttttctctctcactgtctttttctcaatcctttgactccgccggactttgtcacccccacgacctggtgttgggtctgatcaccccaacaataagtaaggccatctttggaaaattcaatctgttataataccaaagcatattatatcatggtaaagtggtagtttattccagaaagaaaaggaaggttcaaattaggaaagctattaactttaagcttttataataacatcaaataagaaaagccatatgattattgtaatggatgccaaaaagtatacttattaaaattcaacatgcatccttcatttaaaactacagacaaagcatgcaaaacaaaacaaagcagaagacatacaaacatatcttaaacccaaagataaagcattaaagtcattctcattaaaactggaaacttgacaaggatactgcaagtccacaacttttaaactactgtgaaactacagcataatgcaattagacaaaattatctgtagaggatatgactgcatatctgagagatccaagaaaatcagctgaaaactactggcaatgataagggaattcatgatcccagaaattctgttactagaattataaactagacattacacatgtataccaaaagatctgtacaagaacagttagagcataataaatgctgtaacagcaaaaaactaaagcaatccaaaaagtccaacaacaaaacagataagttgttcatactatgaaatagtacacagctgtgaaaatgaacagctacatgaatcaacatcgatgcactgtaaaatttagcattatgcaaaagaagccattcatggaagaatatatagtgattcaattttacaatgttcaaaaatatgcaaaactaaacaattgtgtttagaaatgtacctgtagttaaaagcgcaggaaaaaacaattaaggaataacaacatttaagatagtggctgcccctttaggagaggggtgggaaagaaattctggagtcatcagagggcttttacaagtatatgctgatttaggctgggcatggtggctcacacctataatcccagcactttgggaggctgaggcaggcaggtcacttgaggccaggagttcgagaccagcctggccaacatggcgaaaccctgtctctaacaaaaaaaaaaaaaaacaaaaaaaaaacactacccaggaggtggaggttgcagtgtgctgagatcacgctactggactccaggctgggagagaaagcagtctgtcttaaaaagaaaaaacagtgtatgccgagttcaatggtgagtgtccgtgttattatattttaaattgtacgtatgttttcatatattcttttgcttataggaaatacatcataataaagttcaaattacataaaatctaagagtatacaaaaagagttcagacatataaataataattagaattttttttttttttttttttgagacagagtctcgctctgttgcccacgctggagtgcggtggcatgatctcggctcactgcaagctctgcctaaatgaaatttataatagcaataagaatataaattcctaaaaataaatttaccaaaaataccagaacctatataaagatagttttagaattttgagtgctaaaaatagggttggggtcgggtgcggtggctcatgcctgtaatcccatcactttgggaggccaaggtgggcggatcacttcaggtcaggagttcgagactagcctggccaacatggtgaaaccttgtctctattaaagatacaaaaattagccagatgtggggctcacccgtgtaatcccagctacttgggaggctgaggcatgagaatcactttaacctgggagacagaggttgcagtgagccaagagtgtgccactgaactccagcctgggcaacagagcaagatgactctgtctcaaaacaacaacaaaaacaacaacaacaacaaataggcttgaaaaaacaagatgactctgctcagtcttaggagaaataaatataattttgttctaactaaacttatctctattttcaagcagatttaatcaagatattaatcttgattttgatgtggggttggaggagctgtaacaaactgattttcaaatgcttttgaaagaaaaccattttgaaagtggaataatgaggagaggctaattcaatggcatattaaaactttaataaggactctgcaattcataacatggcttgacatacaagtagagaagatcaatggaaacgggtacaaatccagaaatggacacaagtacaacagtgcattttacacatgacaaaggttacatcaaatttgtgggggaaagacggcttattcaatcaatgatgttgggacaaatgatgacatctggcaaaaaaaaaaaattaagcttgatactctgtctcaattcttacgtcttagtgactaaaaagaattatatcagatatgcattatagttcaaataatagctaacaatgcaatcaattgttagttcttcatgtccagcactgttctaagttatttttacatgtatgatcttgtttaacattcttaacagccctacacagcagctgttatttctccactataaagatgaaagcctagctaagtgattcaatctagttcacagtattaagaagtgacagacatgcaataagcttaggtagtggatgtagagcctgtactatgaccaatgtgctatattgattaaacataatgaaaggttagtatatacttattatctaaaacttattatatatatgttccttttacatctttttgaccaaaatggaaatcatcagaatattattctgtggaaaaagccatcctctctcatttttatcttcactgagtgaaaaagaaatgctacattcttcttcattgcgtattaaatgcactacatataaagggacaacaataaaaacattctgataccagtgtaagaattgagaagaggctccacaaaacaagacagcctcaaaagtaatctttgtatacatatgtgtatgtgtaatttgtatatgaaaaggtagcaccacagtcagtagagaagataaatgttagtagaaaaattaaataacctaagtaggaagtaaaaagaatgtttaaattctgtcatttctcacatcaaaataaattcttgatagatttaaaaattaaatgtttaaaataacacaattaagaaacaggaaaatgaaagcaattacatattaaatttggaagtgaagaagagatttcaaagcacagaactatataagtaaaagaaatgagatttcattttatgcaaatttaaaacttatataaacaagtccttaaagtaaaaggcaaatgataaactaggagaaatatttacagcatatgacaaatgatttatatgttttccacacaagaatatctaatatcaagtggaaacaaaaaattcagtaggaaaacagtgatgtatatcaaaaggcaattcatcaaagaaggaatataaagagtcaacgaatatatgtgaaaaagtcaaccctactaaggattaaaaaggatgcaaatcaaggcaaaatttaaaacttaatactcagtgctggcaaaggctcagtaagatagaatcattcatcaaatggttgtaggagttcaagttcacataacatttctaaaagagaacttcagtttttcaaaagcctaaaacatgcttatatcctttgattctgttttcctatttctcagagtatatcttgagaaaataaaaagacatatacttaacaaattatgtataagaatatttattataagatatttataacaacaacatattgggaaatacttaaattttccccagtaaaaagcaaacttaatgggagtccaaggtgggcagattgcctgagctcaggagttcaagaccagcctgggcaacacggtgaaaccccatctctactaaaaatacaaaaaaattagctgggcatggtggcgtgcacctgtagtcccagctattcgggaggctgaggcacgagaattgcttgaaccagggaggctgaggttgcagtgagccgagattatgccactgcactccagtctgggcgacagagcgagactccgtctcaaaaaaaaaaaaagcaaacttaaataaagcatactatatacctagaatggaacactatacagtcattaaaactcatgctaccaaaacatgcttggaaaaatgctcattatatgttaagtgaaaaacgtatacaaataacagctattcatacattgaataaatatttactgagtgcttagtatacgcacagtacacttctatatactgggaacatttccttccctcatggagactatttgtcatgagtcaaattttttaatttaatgttttatatatactaatctttttatatacgtgtgtgcatatacctaagtttatatttgtacatgtgtatgaacatgtatacatacatatcagtatttgtacagactagtgagtacatatatacaataagtattaaataaaagactacaagtaaatacacccaaaggtcaacaatggctgtcaatatggttcatgtgaagagatgcacaagaataaataacaaatttaaacattaattgccttccacaatgtggctttatacattcatgtttcacttccctgtcactagcctggtttccttatttgttccctcaaattgtacctgagagtaaatgatggctttcctatttagaatatcttcctactcataattgttcaaatctgagtttctgttgctgtgttttaagtgccactcattctggcactgtttaatgtcgataacttcagaaattattattaatctcatatagtttattacccccaatgttaagacttttttttttttttttttttttttgagagggagtcttcctctgttgcccaggttggagtgcagtggtgccatcctggctcactgcaacttcagcctcccgggttcaagcaattctcctgcttcagcctcctgagtagctgggattacaggtgcctgccacaatgcctggctaatttttgtatttatagtaaagacgaggtttcaccatgtgggccaggctggtctcaaactcctgacctcaagtgatccgcccaccttggcctctcaaagtgctgggattacaggcgtgagccaccgcgcctggcgatgacattcttataattctttatctcagaacaccaagaacagcatgaattatacactagacttgagtgactgaatgaatgaatgagtaaatgttgggaaaagacactgggttggggcagggtcaagtctgcacgctcgaaaatttcacaggcaagcgaggaacgttttctgtccagtcatccatccatcctcattgccacctccaccacccatggagaatgcagggacattttgtaaatgagaaaagacaatcatcctcacttgggatcagactatgagggaaacagtgtacattccttcctcctttgtgttcctcttctggggaagggtagagtgctgagacggctgagctgaggaggaaggcagactgaaaacctgggtatggctttaaattcccaaattcattaaatttcccatatactaactgggtatgacgcacacatctcctagcaagaggtccaaaagaagcctatgaatgctcttgtttcctttcaacgaccagaaaggagagctatgaacactggcaccttgaaatttatttccaaccctctagaaacttcaaaagatacaactcacttatttattgagattattattactactaacaataataggaaagcaccagcacacttaaatagtatctattctcaaggtatttttcttattttgttcagtttaagtagaaaatcattccattgtcctcccctacttgctaaacaggaatactggatttactatcagaaaagtacctggagtcttagagaagtatcccagaactggagctcccaggtcctgatcaaagtctcaactgtgccatcaagcacttgtagaactttaaagaggaccaaacttatagatctccaagatctcagtttccttacctgtaaaatgggggcatgagcctttgccaccccagtccttccttgctgatcaaaggtaggttcctgggcaaagtaataagcaattagttaaccctctttctctagggaaaaaacgtttcatgcgtgccccaagagcaggacaggtttgggctcccccaacgcgtcacgggctgcccaagtgtaagcaccagagaaccagacacacgaacggttctctaggagcgggatctcccggtctccgccacagacccgggggtcccctgctcctgcactgaagacgcgcgcggcctccgttgcttatccagatccccggccagaactctgccccggcaccgaacaccgggcacccataccccggggcccaagctgcttctgccctcctctacttgcctttattaagtcttaacgtgggagagaagccgtgatgtacccatctacacgggtgtctctggggtttctaaaccggagtagcttctcagtccctgaccctcgattttctgcccctcttccttcaagcacagctcgtcttgccctgtccgcttctggctcagtcctcctgagagttcatgtcacttaacggagcctgtgagagtggaccgggatggccaaaacactcagtccacacaaacaatggccgcagcccggctggaccgaaacggaagtcccaggtcttggagtagacactcgcagtgtttccatggatacgggaggggcggggcgggaagagagagcgcgggaaaacgtgactcctgattggccagaagtatcccgcgcctcccgacctttggccgctggcattcctgcgcgggcgggagctgcgggcgctcgggggataaggcgaggacgcaccagcattaatggaataggagaactcccgaagcttttagggccctgggaaagggggcgtggctggaaacggagctactggcttcggagaattctgtgaccctcaccaccgcgacgaccccgaggaaacgctgtcaggtcgcctttggttggcaaggcgtggttgtcctcgctgtcccgcgccttggcggaatgggcacctcactagccctggcactagctagcatcgctctaaactcaaggttagaggttttcaaattccgtcctattgttgccagacaccctcttcgttcctggtccagtgaggctttcctccctcccgccttcttgccaaatcccaggctcctctggagactccaggcagagaagggaaacgcacagtggagctgaaatgaagccatgagaaggagcccctcctcagtgtcctgggaccacagagagttgcaagagcctgttctattatttagctgagtgtgttatattaggaaaatactttcgcatctttgggccctgtccttcaaacttgggctggatcagtaatattcaaacattttattaggcaaggaacttttggtaggatagtcattacaagcaagggactccttggattcaaatctgacaacaccacttacgagatcttggctggattacctaacctttaagcatcagcttaataggcgtaatattgatagccaataataatagtaactatgtaacagacttgttagattgaaatgagttagtgtagttaaaatgcttaaaccagccccttgcacataggaagtagtcttgtgaactatatatttacagtttggtgtttagcaggggtgggtggcccagcgcctatctgcttgagttcaccacacaataagctcttgcattttttatgactctggagaccacattttgaaaattactgggcgtgggccttccctggtttgaacattcagagagcatagcatagcattttaaaaatgtgggctttgttgtctgacggaactgacattaagagctgtcaatcattgttatccactaggtggtggtaagcaagttgtttaaccgctcacccttaagtattttcacctgtaaattgcaatgtatttatttatttattttttattatactgtaagttttagggtacatgtgcacaacgtccaggtcaggtttgttacctatgtatacatgtgccatgttggtgtgctgcacccattaaatctgtctctgcattcagtaattcaactatcaattgcggctatttaaatacattaaaaagcaatgtatttaaatagccgcaattgatagttgaattactgaatgcagagacattgaccggtaagaacgaacactggaagtgggctgttctgccacactgcttccaacctgagaatattacctgaacctcattgaactaaccaaaattaaaagaaaaaaaaaaagctaagaggatccagttttcagagaaacaaaatgtgtatctgaaggaatatacctgctaaagggcagaggccaatatgaataacaaagagcaccaagtatagcatacgcaagacttttaggaatgaattctacccagttacagtttggggtttagcaggggtgcccggcctagagcctatctgcctccgtccaccacacagtgagcatctgcattttttatgactctggaagctacattttgaaaattattggtcatggaccctccctggcttgaatgtgcagagacccaaagcaccagctttgatgggggtcctgggagcagtcaccagatgcctagagatgtacccagggtaggagtgaagaaactgccttgcatgggaagagagggatagcccaagttcctagtccaagatgttgcagattcttcatagcaaataattgaagaatctaagaatatgactgtggcttgaaggcatagaattttccataattttggttaatgtcacataactaagaacaaaaattggagtcaagtctgacaagacagcaagggatttaggggccaagatcctgatgaaaagggaatctttaagcagccaacctaaaacttggtggttttctcttcaaacattagcagaattcttaagatgaacagggaaagaagataagaagaaagctgttgaagtgcacagaaaattttcagaagtctcatcacagatcggaggagataaagattatagttcaaaacccatcaaggaatagatacccaactagaattcctggagagcaaaagaataagaacagaagcaaactggcaataaatagagatatagctgcaattcaactttgagtcagctccatacctgactggattgttattatctgccccctctctatctgcctatgagaggaactctctcaggaggaatattatcattcagaacttctacagtgtttcgtatacaatgtctgataattcacccaaaaattataaggacagaaagaaagacaatagaaacaaattcatggatgactaaattattgagccaacaaatatatattttaaacataatggtgattaatatgttcagtaatggtgaagagttgacaagatcaggaattttaattgaaaatcaaattaaaattttatgaataaaaataaaattgagaatgtaataggtgtgtatgacagcagatcagatccaccagagaagaggaaagaatacgaatacctgaatgagaagataaccattttatatacacatataaaattttaaatatgtttaaattttaattttatatatataaaatcttaaaataggtattttaagattgataaagtatatattttataaaataaaattttaaatatataattttaattatattacatatataaatatatatatcatgtttagcttggaaattttttatataaaaacatttttatataaaaacatttgtactataaaatttttattttatatatgtataaatctatttttacacaaaaatatataagtataaatatataaaaatttatgtattaatatataaaatatatttatatttatattaatatattttatttatatttatatataaaaatctccaagctaaagtgcagagaagaaagcacagaaaagaacataagaaattatattaggccatcttgcattgtataaataaataacttgagactggataatttataaagaaaacaggtttaatctcacagttctgcaagctttacaggaagtacggtgcttgcatctgcttggcttttggggaggcttcaagaagcttacaatcatgatggaaggtgaaggggctatgggcatgtctcacatggtgggagaagcagcgagagagggagagtagggagggaggttcctcacacttaaccagatatcatgagaacttactatcacaaggacattaccaagccatgagggacacacccccattacccaaataccacccaccaggccccacctccactgttagagattacatttcaacaggagatttcagtggggacaaatatccaaactatatcagaaacatatgaaacacaatgaaacaatgatctaacatacaaaattagagtctcagaaaagataaaatgagcaaagatcaatatgtgaagaaataataatttagaattttccaagcctgatgaaaaatactaatccacagtgtataatttcattgtaactctcaaatggtatattgaaatcctacaaatatttccagggatgcttggagccatggttttgatccttggccaaaccagaatagaatatgctacataggaattaatgcagttttgtgctaacgtagttttccaaaaaataccaagagggaaatctgtaacagcttgccaatattgcttatagaaaatttattgattcatggtttgcatctggtttctgttatgctatcttggtttctgctattgaacctggtcccatatcctggtttcagctacatgacaggagtagtataaaagacccctacttgaatgagctgtgccttccctgaaatcaaaatatcttagtagttcacttgctggccataaagcacaaccttgtgactgagagaggtctctggaatctgtgtgggtattgtggacctcctttcttacccctgctgctttgtgtccatatctgtcacaaatctttcatgagtgtgtgtgtgtgcatgcatacaagtctatgttatgctgtatttttataaatatctctaataagcttagaacatttgtacattttaatggaaaaaatatgtgagtaaaatgtgaaaaaagtatgtatttctaattaagcatgttagcaattgaattggaggagaaaaaatggtcactttttgtatcaaaaggtatcctatatgatttggttaaagaaatacctgaaagcatagaagaggaaaaagatagagatggaaatcatgaaaaaaagatgataggcttaaatagtagatctataagacttaatatgtagacacaaaagttctagaaaaaaagaaagaggagtttataaaagtgaagaaacaaatgactaacagaataatagaaaatgtctttgtgttgaaaatttttgagaaggcatgaatgtagaccaaataactcatgacatttcagtctggattagtgaataaagacacactagacataaaaaggtataatttctatactgtgagggtaaagagaaaagcttttaggtaaaaagggtaagttatctaaaaataaaaatgacattggacttctcttttgtaatgttggaagctaaaaaattgttcaatagcagtatagactagtaggataaaggggcttcaatacatcagccaaaatatcatctctccctaatgtagtgaaataaatgtttaaggattttcaagaattcagagcctgtatcactcagatgtcccctgagttcacaattcaagaaagtactccaaacaaataacaaaccaaaaacagaaataccccacaaaaaattatggacaaggaaacagagaaagccaagatataaaataaataataaaccaaaagttacatgtataaaggatgcaataaattattagtcattatgctaaatgtgaatggactgaatttttcaatagaaagaaactctcagagtcactcaagtaacaaaatccaaccctatgctgttttctagaaacatctgtgaggtgagtaaaaaaagatacgaggcaaatgagcaaaaatgtcaaataattgaaggttaatttaagaactaaagaaagagattggccttatattttgataacaggtacaatttatgaagaagtataatgccatcaaacctgctaaatacatggagctaaatacatgcataaatttgagtacttgattaaaaaaatacagttctatgggaaaattcaatatttgtgtttcagaattagaactacaatacaataaaataaagccacgcacagattgaatagtataataatctgaatttcaaaggtatatatagaaaccttataaccctagaattgatagtatattttgtgtacatagaacatttacaaaactgattatgagttttgccatcttcatcctcaactgatgaatgtgtttttaattgctctgcataggcatgggcaaggacttcatgtctaaaacaccaaaagcaatggcaacaaaagccaaaattgacaaatgggatctaattaaactgaagagcttctgcacagcaaaagaaactaccatcagagtgaacaggcaacctacagaatgggagaaaattttcgcaacctactcatctgacaaagggctaatatccggaatctacaatgaactcaaacaaatttacaagaaaaaaacaagtaaccccatcaaaaagtgggcaaaggatatgaacagacactcctcaaaagaagacatttatgcagccaaaagacacatgagaaaatgctcatcatcactggccatcagagaaatgcaaatcaaaaccacagtgagataccatctcacaccagttagaatggcaatcattaaaaagtcaggaaaaaacaggtgctggagaggatgtggagaaataggaacacttttacactgttggtgggactgaaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatgtccaacaatgatagactggattaagaaaatgtggcacatatacaccatggggggtagggggaggggggagggatagctttaggagatatacctaatgctaaatggtgagttaatgggtgcagcacaccagcatggcacatgtatacgtatgtaactaacctgcacattatgcacatataccctaaaacttaaagtataataataataataaaaaagaaaagaagcaaagagaacttccatacccttgcccatccacacaatgcattcacacacctacctgcatcagtgcccctttttagctagaagcctgttcatgtagtcactagtttccatccattcttgctcacatgccacatgcacctaactccagtaattcccctccctttcaatgtcaatttttccctctatactatatccttcccatcatcaagtatgctgtcatttctctaaaacaaaacaataaaattttctggggccctgttttagttagtgtaggctcttataacaaaataccataaactagatggttgacaatgacagaaactcacagttctgggggttggaagtccaagatcaaggcaccagcagattcagtttagtgagggccacttcctggttgatttatggctgtcttcttgtagagtcctcacatggcagaaggaaccagggagatttctggaacctcttttataaggacaccaattccattcatgaaggctctgccctcacaacctaatcatgtcccaaagtctccacctcctaatatcatcagattgaggattaggtttcagcatatgaatttgggaggacacatgtagtctatagcaggcctacttccctctcagctactgtatcgtttctgtccttccttttgagccaaacttcttagaaagtagtccattgtcttcaattttttctccttccagtcttttttggcctagttcaattaggtttcaccctaccgtctcactgaaactactgttttcaaagtaactattgatctcaatgttgctaaattcaatggtcagttttcagtctcatctcgttctatcagcagaatttggcacaattgatttcaagcatttggtacaattaatctctctttctaccttgaaacattttcttcacttggagttttagacagcacgctcttcaggtttttcctctctggatgttctttttcatgcttttttgaaaacaattttattaccgcctcccaggtctgctccctctctgtgacttctaaacagtagagtgattcctcagggatcagtctttgaatgttctattctcactcccggaatgatcttccatggctttaaattccacctataagctagtgacttctagtttgtatctactgctcagactttgaattctaactccaaactccttccttgtcaatttgacttcaatgtttaataggcatcccaaatttaccaaaaatgtactcctgaaatgcctcataaacttggttttttaaacaatcttctcaatctctttcttccagattcccaagtcagtatcttagatttgcctttgactcctttcttttgtcttacctcccaatctgttctgtcagcaaattcttgcagttctatcttaaaaacccagaatatgactactttcagcaccacgactgctaccggcctcgccctagacatcattttctctcatctggattattataatagcctcttaactggtctgcttgcttctgccattgctgtactccaggatacttcatatagaaccaggatgattctcttaaaacataatagctattattcactttgcccaaaaccctcagctggcttcctagtttactcagagtgaaagccaaggaattacagtgacatatagagctctacatgatatctctcttcctacctttctcatttccccccatttctctgattcgtattccattatttcgctgccttatcccatattagccattctggactaattgttatttcttcaacttgccattcttgttttcactttactcccttctttcattaatgaggtgctgttgattgattcattcactgctttaggtactgagaattaaaaaaatgaatgaaataaaaatctttatcttttatggatccattctctaggtgggaaggtgtggagtaaggaaagatcaatacccactaaataaataagtaaaattatttattgggtgagagtaaaaatacaaacaaaagagtaactcaaattttgttacttgtatttgtgtgtgtgactgttaatttaattatgcagcatgaagaaaaaatgtaaaaggatacataccagagaattgatatgttcaatgtgtattgtttattgggagggattgatgtaagtacagacaggaagaaattaggggcctataaggaagtctctcaaactcttagtaaaaatggaatactaccacttttattttacctttatgcttgtggtagacaagcgaagtgacaagttctttcaatttggcaaagaaatcctacaagcatttttacctttttgcaacacagagatgtcatttaaagtatattaacagcaacaaatgaacaagtactacaatcactcatatttgcagaccttttagatattaaagatcactttcacgaggcattgcaataacttcaaaagtccaggtttcttataagatctctctgaagaaataacacttccaaatataagtttatatataaacgcctctatcctcttccacacatttaccacagaagatacagtgttcaatataggatctttgcgctcagcaaacctgtgggcacacgtccttccaaaacaaaaatagaacaagataataacagtatgaatatttatacggatatctttcatgggacagcaaaaatgttctatttcatggttttatgtgcatgttagaaacaatttcaaaaccaaacctagaatttatagtttctcttaagatgcacatactcgtgaatgtaatattcagcacattatagcaatttaatatagtatgttgtaaccaaactaaaaagagtttaccttttctctcaccctacacttggttatccttttgaggtagtttttgtatgaatctttataatctaagcttctgatttctggttgttattgaggttgttgggcccatcttgctaactagcatgcctgagtccttagtatcagttgcctagagtgtacattttcttaatgccaacgaatactggctcctcctttgccaataacgcttaaagttctccatgaagagtccagctgaagaaatgctgtcttaaataaggataaatcacccaaatctggctgctatatgaatatgaaaacttgttccaaatgggtaatccttagaaaaaggaagccatcagaacagagcatccatttacccatgtgatccagaggtttctcatctgagaggcaattctcaatcctgaagctactggatctattagcttctaagactgtcttcaggggccaaggccatgaattcatcttagagcagttctagtcatgtaggatttgaatgaaattgcactatccataaatcaacacacagccttggtgactactgtggtcgatttgactcagctgttccttaaatatatcgagtaggctcttaactgagggtctctgcacttgctatttcttcctcctggaatgctccatctcccagatatctgcattgttcacactttcacattctgcaaatatcgccttagcagtggcttctcttgctattcaaagagaaataggacccacccccacttttcacccccagcgctgtattccttgccccactctgattttctccatagcaatgattaccacctggtatactacaattcattatttgtgccccttcaacagaatgtaagctccatggaggtaagggctagatgagcaagactttggatattttattcactgctagacagggtccagaaaactgacaggcacaaataagatgctcaataatcgtacggattttagatggacgaataaagggacactgcttattgggagtcagccagtctgggaaaggtccttcaaagctggggttcaattccccgacttcctctttcccacatcgggaaagcaaggaggaaggacgtgcgcccacaggtttgctgagcgcaggggatcctatattgaacactgaatcttctgcggtaaatgagtggaagagcaagcatagaggcggagagtgggagcagagctcccttggcccctccagccaatgggaagagagattcgctaggtcaggcggtggggtccaaccacccacgctggcccgcagccctcttagcgggtttgctcttctctcaggggaggaggaaggtgaggcattaagggccagagtgcgttcccctttctggtggaacagcaaatgcctgttgatcctttcctgtccttctgaggcctggcttttggcgcttataccctttgccaccgacgcctggtgagaccgaggtatggaatgactctcctcttctctggatgcgtactttgtccactctaaaatgggaagttgggttctgtgcgagtccatccagcgtccacattctgtgtggaaaatgaaagggatgtggactcagggcccaagaggatgagctgccaggacaccccagggtgggacacttctgggcatggcgccggccatgaccagggtggaaaagcgaccttgagggtgcgagtccacggtcacctgcaagtagtcttcggctggagacctagtgtggcctgtatccatttgtcaaattccaaagagataaatgaatgcctgccaactgtgcttgaatttggcaggcactgcgtgcagtgcccgcttcttgaatctcctggattaaagcggtatgaatagccccactttcaccagccttgacgaatggaggcaagcccctcgcctctctaaccaggagcaggtgttcgtccttcagtctgaagctattcccgccacctgtgttctgccgtctttcattcactctgagtcttcccctagcccctctccctactgaaaacgaaacaaaccgcctgaaaactgctttgcaggtgcaacagctgctctcactggtgctccaggttatcagtatctgtctctccacttctccctagcaaagttcaagaaatattagtaaggtagcacatgcttgctcccggcgttggtcatcctctctagcctatagtgctttagtgctttagcacccccactccctctactccagcagtgacccaaaattgctctctctatgcaagttagcaattattgccaacacgccaaattcaagtacagatggcaggcattcatttctttaactttttggaatttggcaaatggatattgcctttttacctttttatttctccacttatttaaggaatgtattctaatgagagataattgtcaaaaattgtcctaaactcagttgtgttttgagttaggacaatttgtggtaattattttaagtacattttggttttttttatgtagaggttttgttttctttgcttagttgtaatcttcatatacctgccaactgttttgctgtatgacgaggtcattttcatgactaaaaatcaagtgtgtgctatatttttatacattcattataattgaatccttattgacaattatttactattctaaacaaacacccttatgcacaaaactttcttttctgtatttaggatttttttttcagtggatgatttcccaaagaagatactgtttgaaaactcatgcatgtttgtaaaattctcagtagacatgcagacatgcagtttttcaagagtgtagcaattaacatttatattaactccttttatatggtactgctttttaaagcttatttttgtcattttgttctttgagaagggctgtttcctggtttgcattagttgtgctatctgcctaagtttgaaaattttctgaaatacttgttagccatttgctttttgctttttttccccttctatgaataggctattcacaataaatttgctttattgctattctgatctatttgtatcatgtcattttagggatatgaacattttcaagacaatattttagtgtgaactgtaactcataaaagactgcactgagcataaacatgcagcttggtaaatgattaccaagtgttcactcatgtaaaacatcagcaggtcaaggaataggacattcgttaccaggacataaggcccccttcatccccctccacctcatctccacagaggtattaggaaatggacttttataatagctacttcataatcttgtttgatttggcttcttccactagttatgagatttattctagtggcatatagcttcaatcatatgttttctttgctgtttaggatttcattgtacgaatttaccacaatgtattgattggttctactatagatgaactcttggatcttttcaagtgcttaggaattacaagcagtgctgctgtagttattgtatatctcctggtatacctacacacatatttctattggatattttctaagaactttaattgctctgtcatagtgtatgtatatttccagttttaaggaataaccattttagaatagtattttttagaattacagaaatttcttgtcacccaatttccccaatttttaatatcttgcattactatggtatatttgtcacaatgaagacaataaggcaattaagttgcacttaatttgaagttcactagtttttccatagtgttctttttctattcctgaatattacatttttctattcctgaatattacatttacatttattattacagtacagtattgtcctgggtggacatcttcaattttagtagttaatacaaacagttttaaagtggttttattaatttacacttcagttgtctatttgccatattccctgtaaacatttttctgtttttggttggccatttgtgtttgaattctaaggacaagaggttttaatttcagcatagttaacgaacattttgtctctgtagattcctctggtctgtgaaagtttctcagtctttccttgttttctgatgaccttgacagttctgagaagtactagtcaggtaatttgtatcatgtccctcactttgttttttcttatggctagactaggatgatgggtttggggaaggaatatcatggtggcaacatgccattcacagtatcaatagcacatacgatcacaatgacttatggctggtaatagtagccttgatcttgggagagtgtttgtcaggtttctcactaaaaagtttctccactgtccccacctgctcccatactgctctctttggaaagaaatcaataagcacagtcagcgctctgggaggtggggtgcagttgggttaaccgccacttcctggagggaagaatatcctacacacagtatttggaaatcttctctaagagagatttgtctcttttctctcatatattcggacatttgtcaatatcagtacggactcatggacatttgctttgtactttgggctataatccaatactgttatttattttggccatcaggagctctttctggttttatcttaggtctttttgcataccccattattttcctttccttatttctggcactatgagatgctatcggctcatcgtatctattccctgtcccagccctagaatcagcagtttctcagaggagccctgattccttttattggcaaatggtacagttagaaaccaaaatttgggcctgggtggacatctccaattgtagtagttaattcaaacagttttaaagtggttttattaatttacacttcagttgtttatttgccatattccctgtaaacatttttctgtttttggttgaccatttgtgtttgaattctaaggacaagaggttttaatttcagcatagttaacaatatatcttcaaatattcattgtggttcttggtcaattcccttactgtgtccaaactggtaagtcccttctttcctaagttgtgatgaatattctttgctgttttctcctccctggtttgaagtattaatgatgtactacttactatatctgggatttattatgaggatactaattaattcttgtcaaaatggtttacaagttgtgctaatgaacgaccctgaattatttcctcccaattatggtgtctcttctataatatattgaaatctaatgagaatgtattttcttggctatctactctttttctttgatttaattatcatgacagaagttgtacatttaggccaggcaccatggctcatgcctgtcacctgtaatcccagcactttgggaggcctaggtgggcagatcacttgaggtcaggagttggagactaacatggccaacatggtgaaaccctgtctctactaaaaatccaaaaataaataaataaataaataaataaataaaattagccaggcatagtggcaggcacctgaagtccaagttacttgggtggctaagccatgagaatcgcttgaacccaggagggaaggcagaggttgcagtgagtggagatccaccactacactccagcctgggcgacagagcgagactccatctccaaaaaaacgaagttgttcacttagcagtagaggttagactcttgaagttttttcaactggggggaaatttgctgccctggggtcatttggcaatatctagagacattttttgtttgtcacaactgtagaagatccagggttctaattggcatcaaataggtagaagccatgaatgctgctcaacatcatataacgcacgtatagtatcccccaaggaaatatccagcctaaaatgtcagtactactgaggctgggaaactgctataggagatttaattagagcgaccaagaaaggaaatcaatccggactatatgaaaagggtggaaacacctggcttcctaggtcaaatcttacctccctgagacctccatatctctcccctctctaggtgagattcccttctccctttgtgtcctcctagaactactctggcccagatgatagtcatgctatatttagaggtcttcctcttctagtctggtgttcagcatagggtctgctatcacagagcatggccacacagattttgtataactctgaatttccaatgcctaggaaaatgaagtgaaattaaaaggcaatgctatgtagtagaaagagaatgagctttgtagtatgataggccatttgtcaactctatgacctgggcaagtttcttaatttctgagactccgtatctataaatgtggataaaatcaaactttcaggtctgttttaaagtctagagaaaatttttgtaaagaatctatatacactaggtcctcacaaatatagtcattattaatatgagctaattattttgaacaaatatgctttgttataggcaaaaatttacatcaataaatttgcaaattaaaatcctcatagaccatgggttcccattttagttcagggcatttttgaatgaatgaatgccttcctataagagaaacagtgccaaacatgtgttcctctttctaaaaaggtaaaaagccaaaacaaaacaacaaattccttcgaggacagcgtaaaacctttgggaaggagactatagtatattctactctactataattgtagatatcatatagtagaaagctaatagggttcagactcatatagatctcggctcaaagggacacccagaaaggaggaggaaaatgaaaaaagtgtgggattatgacagcaaagagacaagtgtaaatatcaagatgtaaggcattgttaaaatagtattattaacatatggcaccttgttaaagttaggtgcatgcgttagcttttttaatccttgcagaggtaggtactcttgctattcctgcttacagatgggaaaattgaatcccaaaatgccccttgagttttgtaacaaggaggttattggtatgagttatttcagtggaattgtggtggcaaaagttctattgcagtggattgaggaggtataatataataggtgatagagtatagaagattgaagaagtttgactatgaagatgaaggggatttggagtaaagggaatatttgtaaaagactaagtgagatttgggcacatttaagtgctaatgagtaggacttaggggacagggagaagttgaagatcaagaagatagatttctaatggattaaatcccttcaggaacaattgcttatgagatttagatcacaggtagagaaataagctatagaaaagggaagagagcgcccctcatttgttacaggaaagacaaagataaagatggacccacatgtagggatacctgcagatttctagaaaggaagcggaagatgtattctgtgccttgctttccctcacctaccatattctctatgtcctggagaaatttcagagttcttttttgaagtttcctcaaatcttttcctttatgctttttaaaaaattactataggacttgtttttgtcagatttatctgtaatctagaatatttttaccatgtagttaaacaaacaaccttaaaacagctgatagctcaccaattactgtaggataaaatccagatttactatatgtttcgagacaattcaccttctgtttaaaagaaaaactctcccttctatatacttttatttcccccatccgtcttttttttccaatcatattagcaagaattgggggagacattatgaaagactggaaagggcaggaattttagtgaaagatctaagttgagttccagctgcatcacttactagctctatctcttcaggcaattcaccaaaacagattaagaaaacttgatggtgcttgggagagtatggattaagtgattaattggagcacccatgctgaataagaaattgaataaggcccttaagatggctgatgaggggtaaacgcagggctcaaaaggatttgatgatgtttgaagaactgtcaccgagtaagggcatgaaaccactcagttaactggaagatattagtaaaaaatgggttatgggagtttgcagcttaaaagtttgagtagtcattgacaaagcctggggtgagagcattagagtaaactgccagagagcagtaaggtcatgggagttgatgtcaaagacgtgagatgaggatgtttttgatgcactttaacactgaactcacccagactaactgtggtgttggggaaagtgcatgaaaggagcttgtgtactacaaaagaccctcagtaattatatatgtatttatgaccagaaatgacatgacaagaagaggtagatggtggcatattctaattgcatgtgtttgttgagtaataatgtgttggcaggggtgcaataacaatgttttataggttgagatgtatattagatgttgttgggggatagaagggatgaggatggacagttagcaatacttaggaggagccagttctgtgccaggtgatatatgaaccctatcttatttgatccatactaaaattagaggttggctctgctatccccacttagcagaagagtaagttgaggttcaaagagaggaattacctttatttatatagctcataagtggtaggactgggaacagatcataagaagatggaataaatatacagtacagtggtctatatcagaggaatgctttgtgaaagaagatatattacagaggacactaggtcagtaccgagcctaatacagtgggcttctgcaaatgtttgttaaattaatctatataagtatttcattttcaaatctgtctttttcatgtgtcccatttattccatgtgcttttggttattttttttccccccacagaggcctgaatatttggacaagatggcagattcatcatcatcttctttctttcctgattttgggctgctattgtatttggaggagctaaacaaagaggaattaaatacattcaagttattcctaaaggagaccatggaacctgagcatggcctgacaccctggaatgaagtgaagaaggccaggcgggaggacctggccaatttgatgaagaaatattatccaggagagaaagcctggagtgtgtctctcaaaatctttggcaagatgaacctgaaggatctgtgtgagagagcgaaagaagagatcaactgtgagtgatgctaggggcaaatcgggggctaggcaggaaggaagtgtttcctggagcccagtggaatgtttctgtaagagggatttagggattaaaccatgttgggggacataagctccatggtggtcttgtgcatggggagcttgttgaattatttgaggaaggaaaggcagaagcgttttgagtactgttactcagcctagctccttaactggcggcaattcatccatcttgtaccagttgaaatgatcaaaggaattgagtgataggaattgtcccataaagtgccttcaccaaaactacaagttataagttaggcaacattttgaggaatcaaatatgatttaacatatttgctgaaatatgaggaatgggctgaaaattattattggacgtaatccaaggcagtatttttagtcattctcaggtatgaaatattatagacctctagaattccttacgcgtatacaaggctttagagttatatatatatatgtatatatataatattcatatctattatctcctttgcacctcaccgtatcgtagtgaagtcagtatagacaaggaaactgaggcttatacactacactatttgccctggagctacaaggtgggggccatggcaagaggtctcctacttcagtgttatctgtatcacattgtttcttctctcagctaagcttatggagtctgaggctctggcagctctagttttcttaaacccagatagtcatagaattggaccacttatgtgaatgctggcctctgttctagccatcatgaaagctcactttgttttcattaaatatcatgatcctatcggaacctgttgcagggtcggcccagactataggaccagatgatgccaaggctggagagacacaagaagatcaggaggcagtgctgggtgagtagttaggcctttcatcagatttgggaggcattcaaagttttgatacaggacggtgatttatctcccgaggacttttgttcaaatcttgttaacttcttctaataccccacctgttccctgaatgtcacccaaaaaggatcagcaaaacactccctggccaaagtcagaatcagggccttgttaattcagatcctcaagagaacagtgtttagaatgcctgctaaaagaagggctgacgcacaaaggtatattaatgtttatattttatggactaaaagtcactgaattgggaggaaactttcagtttatcacatctactttctttaaagatggtgctgtaattaaattctaggagtggtgaccaactggttcatataaaaactgatttctagaaccaggtcttctcagtcatagttaacacaggggtccccaactcctgggccacagacccctactggtcggcggcccctcgggaatcaggtcgcatagcaggaggtgagtggtaggccacgggagctttaccacctgagcttcgcctcctgtcagatcagcagctgctttagtctcataggagcacgaaccctattgtgaactgtgcattcaagggatctaggttgtatgctccttatgagaatctgatgataaatgtaatgcaattgaatcatcctgaaatcatctcccctccctgccctgccacccctgcctcctacatccatggaaaaattgtcttccatgaaactggcccctggtgcccaaaagattggggatttcagaccactggtttattaacaccatttccccactttgttttgaattctacataatttaattccaatttatataaatggaattacagtagaaagaaaattagatcaagtgagaaacctttattcttaacccagccacattctaacaagccacattatttcattcaagaaataattgaaaacttagttcatcccaagcactaaaatagaaaaattacttgttatcttaaatgaccttgaatataacatcccactgtgaccttaatttctgattcaatataaagaagtatatctttatggtatgagaaaaatcacatggctaataatttttgttttattattatttcaaacctaatggctatttccctcttatgtgcagataattgcacacagatagctaataaatgtcttcaaattattatttgaaaattgtgataaaagtaaactatttattatgggaactttggaaaatactgtaagtacaaaatagaaaataagaagtacagcaatgatttactgattattttctctgtgagtataccaatatcacactgtttgaattactatagtttcgtggtaggttttaattttgggtaaatagtgtttttcttctccctgcctggccaatcattattttcgctttttgggattttttagttatcatttgtttatgttttatctttgtttttaaacttcacataagcaaaatgagctatttttttaaaaaagattcaaatgttttaaaattacataaagtgagtttctcactcttcccactccccatccccaatcctactattcagaaataaccagtattaatatattggtgtatatggtacatgttttcagatacataaagtttgttcatcttttttccaggagaggatcatattctacataattgccagaaacttcatatcttttttggttattatttggggggatattagtacctatagttataccttattcaaaagttgtaaagtactcaattatatcattgtattctcatttttttattgcacaaatatatttgacacttatgtgcacggaaatgtgttagacactgaccatgcaatgatgaagcccctagccaagtgcatcatttattttaaaaataaagtaattgtagctagtgacatgtactgtgaatgaaaaatatactgttttgagaatatataaaaaggggaagtagtctagcgatgaggttcagagaggtcttccctgagatcctatccttttaatagagatctaaaggagggatcagacttaaacaagtaaagatgaattatattttcattctatttcactcaggatgtttttcttttttcaaaatattatttaagctacgattcaatgtttatttctattaactttttacttgtacaaagaaaattattttgatctgtagattcaggtctgtcttgggggtcttccctattattgttaatggttgcctctgttctttttttttttaatctggatgacatctctgttctccacatctattatcttttttctatgtagaaggaaaagtacaaagaagaaaaaatatttctaaagtgaatccagtttttatttcccatcacaaattcatttttctgcatcatctattctggtttttattacagtatctaatacaggttttaaatctataggaatatttttatttatattatttttaaaaaatcaaaaccagctctgatttcagcctatgttctttcttgttcctaattccaagttcggtattcttgacattacatttcatagaatttgttttgatcatgtgtctttgtttttgtttttttacctttgccattctgacttaggtgatggaacagaatacagaaatagaataaaggaaaaattttgcatcacttgggacaagaagtctttggctggaaagcctgaagatttccatcatggaattgcagagaaagatagaaaactgttggaacacttgttcgatgtggatgtcaaaaccggtgcacagccacagatcgtggtgcttcagggagctgctggagttgggaaaacaaccttggtgagaaaggcaatgttagattgggcagagggcagtctctaccagcagaggtttaagtatgttttttatctcaatgggagagaaattaaccagctgaaagagagaagctttgctcaattgatatcaaaggactggcccagcacagaaggccccattgaagaaatcatgtaccagccaagtagcctcttgtttattattgacagtttcgatgaactgaactttgcctttgaagaacctgagtttgcactgtgcgaagactggacccaagaacacccagtgtccttcctcatgagtagtttgctgaggaaagtgatgctccctgaggcatccttattggtgacaacaagactcacaacttctaagagactaaagcagttgttgaagaatcaccattatgtagagctactaggaatgtctgaggatgcaagagaggagtatatttaccagttttttgaagataagaggtgggccatgaaagtattcagttcactaaaaagcaatgagatgctgtttagcatgtgccaagtccccctagtgtgctgggccgcttgtacttgtctgaagcagcaaatggagaagggtggtgatgtcacattgacctgccaaacaaccacagctctgtttacctgctatatttctagcttgttcacaccagtagatggaggctctcctagtctacccaaccaagcccagctgagaagactgtgccaagtcgctgccaaaggaatatggactatgacttacgtgttttacagagaaaatctcagaaggcttgggttaactcaatctgatgtctctagttttatggacagcaatattattcagaaggacgcagagtatgaaaactgctatgtgttcacccaccttcatgttcaggagttttttgcagctatgttctatatgttgaaaggcagttgggaagctgggaacccttcctgccagccttttgaagatttgaagtcattacttcaaagcacaagttataaagacccccatttgacacagatgaagtgctttttgtttggccttttgaatgaagatcgagtaaaacaactggagaggacttttaactgtaaaatgtcactgaagataaaatcaaagttacttcagtgtatggaagtattaggaaacagtgactattctccatcacagctgggatttctggagttgtttcactgtctgtatgagactcaagataaagcgtttataagccaggcaatgagatgtttcccaaaggttgccattaatatttgtgagaaaatacatttgcttgtatcttctttctgccttaagcactgccggtgtttgcggaccatcaggctgtctgtaactgtggtatttgagaagaagatattaaaaacaagcctcccaactaacacttggtaagtgtgttagggccattccctggaagtgccctgtaagggagagacgtagatatttgtcagagggaggaggcgtttagctgaggtcccagagctgagataaccctctggagttgtcccatcttgaggcagggaggctaagcatttaaaccccttattgaccaatcatggctactggtgaggagtgggcaaaaactttcctgagatggctttttttggcctgaaggcaataccaggagagggactgggctgaggactctcaattgttgacaatctcaacaactcagggggaatgagcacttcagtcttcaaggaggaatgtggcatggcacaaacttgcatccatgataataagtatatttgatttctaaagataatgtcatccagaataagggaccagaaattttctgctgaacctggtaaacacaggttatctctctgtattatattcctccgtactccactgacctagctcgctttctctattgcccagacattggttggcctttgttttgtagtttgtgaagggtctcagccctttaatgcctatctggagacactggaggttaataagaaatagtaggtgctaaataaatatttttgaaaaaagaaatgaaccttaagtgttttacgtacattattctactctacctcctttctcaagttgccttttctgactacccatctaaatctgaggaaagatttgaactatggaattcattcccagatgtatataaaattaattgaggacttcctatgtgctatatagttgtatagtgaactggatatttaacataatgtgcaatttaatgttgttggcaaccatctctatttttaagattacaaaactcagagacatatacctagaaaatttattgattcaagcacacatcaaataatagttaagtggctaagtgcttatcacataacctgacagtcttctaagtccttgatctcatttagtcttctgatagtcttattaggtaggtgctattatttccattttacttaggacaaaattgtgataccaagaaggcatataacttgactgaggtcacacatctgattgtaatttcttggtttgctaactttatccaagctgtttcagtaccattatatacaattgcagaatcactcctttcttataagagcatacatttcatttatttgcaaactgtgggagtagaaattgtgggccctgatgctatgacctttacccaccttggaaaattgtgagtaatcgtcagtcaattttcttaattctgacttcagagttctatttaaagaagatgtgatttaacagggcattaaaacgtcttttatgcctaatagtaaatgctagaacagtattctggccactagattgccagttctcctgctagctttccttacctatgttgtagagttatctagtactagagttgattgttgctaaaataaggagccagagaacccaatgttttaaaagaaaaactgtaggtgacctcagtctcttctataatataactacattgtaagctttgtgagagcaggagctctgtatggttcaccattttatctcgtgttcgcacagaggaaacacttgaatgcttgaaagaataatttattatcctgtttttataaatttaagacctcaagtgatatagaccatcactatgaactgtcattcattccaatttaagatatgggaatgaatatttattgactagctgttatatataaggcaacacactagacttttacatgttttgtatatattatatttaatatatacatatatatgtatataacagttactgattactaggaacacttatagcatgagacatttgctaagcattttctacatactgccttattgaattttcacagttgtcctaaaaaatagatactattatcttcatttatcaagatcatgaagctgaggctcacataggttagtaaattttccagaataactaagttcagtgagtggcagtgttgaattgggactcagagccgctccattgtcgagcttataaacaccaggttgtcccctgttttattaccctttatttgttcatgagtttattgataatattcctaataattaaattataaagtatttaaagtttacagtgtgcttttgtgtaccctttaaaatgcactattaaatttccacatctttgtgaaaggagacatttccattttatagatgatgaaaatttgcaagttatagaacttatgcaactctcttaaaataatatggctagtaagtggtagacctggggctcaggcctgtggtttttaatctataccactttacacctaatgtctacccactaatcctaatcatattctttgtgaccaaattttatttttctttttgatattggctcttcaagtatttgaatacttctctcttatccctcctgagttgcttcctctaaagtaaagcttctctggtttttattttgtgtgtgttgaagggagtggatgggaaacgggagagctattggacaaataagacctctggagtgcccagaggaagacttcctggtggactgtgcccacggtggagctgcactggatgctcttgcctttccaaagtacacttacttttactccaatactatcctctgagagttggctaggctgaaataaaatcagcattgtttttcttttctcaattatttatgcaaagggatggtgatcgcattactcactgttggcaagatctctgttctgtgcttcatacaaatgaacacttgagagaattggacctgtaccatagcaaccttgataaatcagcaatgaatatcctgcatcatgaactaaggcacccaaactgtaaactacaaaagctactgtaagtctggtatgagaaaatttaatggagttattctaatttctttctgtgtcccatcttccactcatactcgttaggggaagccaatgctaaacaaatacttacaatccattttgtaaaataaacaggaacaatggaatcctctggggacatgggatcattactaactggttctcagagtgattccacagggcatagtagctgttcacatgggtttttcaggcttgattaggaactttctaaatgaagagcacagagctaaaacattctaggcaggtcaccaatgcactttcaaggacatgttctggaacttactatcctcttaaatttttttctattgaggaaaaatttgcatttaacaaagtccacaaataatgttcagtttgttgtgttctgacaagtgtaaacatctttataaccaacacacccaaaacaagatagaaaatattttcatttatctcagaaaggtcccttgtacccctttcgtttttttttttcctgagacagggtcttactctgttgtccaggctggaatgcagtgatgctatcgcagctagaactcctgggctcaagcaatcctgccacctcagcctcccaagtagctgggattacaggcatgtaccaccatgccaggctatttttttttaattttttgtagagatgtggtctcactgtgttgcccaggctggtctgaaacttctgggctgaggagatcctcctgcctcagcctcgtaaagtgctgggattacaggcatgagccacaatgtccagcctatccctttctgttcaatcttctcaccccatccattcccagagacaatcattttctaatctctgtcaccagagttcagctttgtatctttttggaatcattttgattgatttatacagtatgtattttttttaatttatcttctttctctttcttttcttttcttttttttttttgagacagtcttgctctgtcaccaggctggagtgtagtggcacaatctcggctcactgcaacctccgcctcccaggttcaagccattctcctgcctcagcctcccgagtaggtgggactacaggcacgcagcaccacacctggctaatttttgtatttttagtagagacagggtttcaccatgttggccaagctggtctcaaactcctgacctcaagtgatctacccatcttggcctcccaaagtgctgggattacaggcatgagccaccacacctggctatatccatcttcttgtgctcaacaaaatgtcttctaaaatttatccattttgttgcaacttttagtagtttcttttttattgctgattagtattccattgtataactatacttatactataatttgtttattcattctcttgttaatagacccctggaggtttccctaacctgttaggaataagggtaatctttgccaacattagatgctgtcagtcttttttaaattttaatttatcttaattggattctagataatcactttaaaatgttgattgttcacatgtctcttacctttttgtgtaaggactccactaggagctgaaactgatcctaatctctgtattttgtgcctgtcaatatgtacaaggtacatttgttgcttagtatgaactgaatgctgaacaaatgatagatctttgtttccattagcactgaaaatagatgttcttttgggtgggggctggggacaggcttctcaccaaatattttcctcctgatctcagtgtttttagtgagttctgaccttagatttcaagcatctagagtaggcttggtcttacatatagatgtagtaagacaactagatgtatgttatgattacggggttcctggaagtcctttccactcatccctaaacatttcccccatattgtcccttcattggatgtcatcaatccggatcttcacaatagccaatgccttcttggttaactgacttcctttcttagaatgggagggttgcatcagtgggatgacaccatgatgactgttctcagtctgtgccaccttaatgtggtctgtcttactgtggtccctttttcctaataagtgagatggtgccatttatgtttactgagtgccttaggcacttttactagatgaggatggttagtgctataaatgggtaaaggctttattttcctgtgtgtacttgcctggggtgaggggagtgagggtggagggtgggtggtgggccgaaaggaggaaaggtggtgttacaaagcgaggttttggacagtgaacagaagggcattggggactagcagagacactatagaagaatcagaaatatctgacattgactgagttaggaggtagaaagtaggaaaaaaattggcagatttaacttcataatattttgcttgggctgcctccgtacacctgcctccgtatgcctaacgaagtccccaagatggcacagcatgttttgcaacagcgttttgttattactgcacatcagacagttgatgctaattttgaattaaccttggattatttaaagatttggctattgtgaattaatgttattgtagtacttggaatggccctgataatttttgatagtcattcctgggattacaagttaaagaggctcctcttctgcttttcatgatgttatcaccttcttttccgttaaggtaaaaaaaactggggagtgtcaattatcaggtcataaatagaaattgaagttataacccaattgttttagatgaaaataagataaaagaatattcatgtaatatccaagaattagattgaaaagaaagggatcctgtaaccaaggagagaaatggttttgtaatacctcctgcatatttttcttctgaaggttgaaatttatcactttccctgatggttgtcaggatatctctacttctttgattcataacaagaatctgatgcatcttgacctaaaagggagtgatataggggataatggagtaaagtcattgtgtgaggccttgaaacacccagagtgtaaactacagactctcaggtaagctttgaattgttttgtcttgttttgtttttataattgaggcttttgtctatccaagtagactcttacagcctggatttgctattcataggaccggcttaaatctactttcatgatatggggtagcaagcatctgtagaatcaagctgatttcatcctggtaggacttctcattcctcccatctccccaggaagatttctcattgtgtagttctctgtgtctccatctcctaaatctgctggtggtgggaataagagcagattcagaattataaatatttaacacttctaatatttaagtgctgcaatagattcgttgtatctttgaactctcgtagaaaataatacagtgggggatgttctttaatgtaactgggggcagtgctggggcagactcactattatttgatttttgttggtgactccccctcaatttagaacttcaactcagtgaccagcccagaaggctgagaaagaagagcatggaaatggtcctctttcaaggtgcttgctggctaccacacactattgatctgagtggtgactcttctttggccgatgaaagtgaaaggattagcagtcatactgttctccacattgtgtgacaggttttaagaaagatcttatttttcaatgaaagtcaatgaaataggtttctgacaaaaccagacaaaacaaatagttacagtaagttttgcattagaagtttttataagccctggactcagttcagggtggccaagactgaagcttgatgcatgaagggccaaagtagatctgtatttgtaggaagcaaattataatccaggtgtaggaaaaataaatgaagtctggaataagactttctttgacgttttaaaaactcttatcggtttttataagatggaattcacttacagcatatctggaaagttgttggataattctcaaacataggttgagttcagttgttaggaggccaggtcagagtaaaggttttacctactaagcagttttaagatattatgaggcattttctgtaacctacatatctagtctgaaactcaggtaagaagtatgtcactgtttcctatatctaaaaataaaatgtattagtagcaaaaagctgttaaattgaggaaaagaggaaagatgttttcttacagtgggagctgtggatccaagacaagaaaagcttggtgcttgacagatcagtaggacttgataagatcccttccatttgaggtttgagtaatgtcgtccgctggtaagccttgatacagaccaagttgccaggatttcaaataggaaaccatctttctgggtcaactagtagggctccttgcaacagtaaatacaatgctttggcaaaagtcatcagagctttgtaataatctcatactccattatgtgggactgcatgttcccccagtgtggatggccactgaggagcaatcaatggtcctattaacatttcgtgtgggagaaggtccagttttctgtttgcttcatatctcatgttataagagccatgggtagtatgaatgtcctcattagtttggtttgtgtatagaccatgcacaagtttttagaattgcattttgatgttatactctctctgtagatgtgggcagtgtcgatacatcagtaggactttgccagtctgtcttgcaacatatgatccccagtgattgttagaacttggctaatttaaaaataaaataccttctaaaactttaaattgctcatatgagcccctgtacatgaacatactgaaaggatacataatcactaattttcttctttctttttttgagacagagtctcgttctgtcacccaggctggagtgcagtggtgcgatctcggctcactgcagcctccacctctgcctcctgggttcaagcgattctcctgcctcagcctcctgagtagctgggactacaggcccatgccaccatgcccggcttatttttgtgtttttagtagagatggggtttcaccatgttggccaggatggtctcgatctcctgaccttgtgatccgcctgccttggcctcccaaagtgctgggattacaggcatgagccatcgcacctggcccataatcactaattttcatgagaatgctttactataatatttacccaaggcctccctcaagaagaggagaaagatctattctctttgtcttgataatttttttccacattataggccttataataggtcttaaaatatgctttaaggtaagctcttaaaatttgctgagcaaggagagaccaaaaacaaaaacagaaaccttggcatagtccaataatttctgattgtgcccaggatctcttcttagtttgcatatgctctgctattggggctttataagcaaggtaagggaatgattgttgcttccacaaaacagccacctgaagggtaccaaaatggcatataaatgcagagcactctctatatcttcatagactttgaattagaagactaatatttcagaaggggggcaactagaatagttagataaggccgggtgtggtggctcacgcctgtaatcccagcactttgtgaggctgacaaccttggatcacttgaggccagtaatttgagaccagcctggccaacatggcaaaaccccatctctactaaaaatacaaaaactaactgggcatggtgatgcgcacctgtaatcccagctactcaggaggctgagacaggagaattgcttgaaacctgggaggcggaggttgcagtgagccaagatggcgccactgcactccagtctgggcaacagagcaagactgtgtttaaaaaaaaacaaaaacaaagctggctaagaggaacttgcctgagaatggcaaatatccacagctgtgtctcattatcaactagagtaaaatattacttaacaggtagatagcatatggaccaatagaaatttttgcttcttcaggagtgaggaaactctgtggctcaatacaattgtttataatcatgaaatgcctaatgaatcatcataaatgtaaacagaatttggggaaatgagaatacaccgtttaaaaccagaggttctgccacctgggaagactaccagcaagcagagactaaactaccagtcctcttctccattcaaaatttcttttattcattaataaaccatgatatatatgtatacacagcttcataatcataccaaaaaagtttaagtgaactatcctttaaaggctgagaccataactttttgaacagaaataatattgattatgagacagtatattgatttttgctgtctttattttaatatgaagaacaaattgtgtggtaagactgtaatttattttcccactttgaaattaaacctctctagaaacatttagataaattataaactaatctttaaaataccgtattacttcaacatttcaaaatcagtaagtttggaaactgtatttaagttaatattaggaataacataaccactgttgataactaacaatatagccaaacaatgtgatacctcaaaacttgacccagatagtacaaaatatttataatcttggctgattcccagatttacaagcttccggtttataaagatgctcatcatttagttaactcatttaaatcatatatatatgatttaaattatatatatatatatactttaaaatattagtgtaagtaatatgtctacaggagaattgtaggatacttaggaaattatttaatttagacttctcattaaagaaatacagaagttttgtggtctaaaaagccatcatttgtatttttttctgagaggattttgtatttttttttactttcacttctgtattttcaattttttaggtacatagtaggtgtgtatacttacgggttacatgcaatattttgatacaagcatgcaatgcataataatcacatcaaggtaaatggggtatctatcacctcacgcatttatttatcctttgtattaaacaatccaagtatactcttttagttattttaaaatgtacaattattttttacgttagtcaccctgttgtcctagcaaatactcagtcttattcattatttctaactatttttttgtacccattaaccattcccctcttcccctcattcccccactgtgcttcctagcctctgataaccatcattctactctctatgtccatgagatatctccatattttcatttttcactcccacaaataagtgagaacatggaaagtttgtctttctgtgcctggcttatttcacttaatataatgatctccagttctatccatgttgttgcaaatgacaggatctcattcttttttatggctggatagtactccagtgtgtgtatgtaccacattttctttatccattcaccttttgatggacatttaggttgcttccaaatcttggctattgtgaatagtgctgcagtaaacatgggagtgcaggtatctcttcaatacactgattttctttcttttgggtatatactccacagtggaattgctggatcatacggtagctctagttttggtttttttgaggaacctccaaactgttctccataatagttgtgttaatttacactgctactaacagtgtatgagggttcctttttctccacatcctcaccagtatttgttattgactgaattttggataggtcatttttactggagtgaggtaatttctcattgtagttttgatttacatttctctgattattaatgatgttgagcatctttgcatatgccatttgtgtgtcttcttttgagaaatatctattcagatctcttgcccattttaattggataattagatttttttcctgtagtgttgtttgaactccttatgtaatatattctcgttattagccccttgtcaaatgggtagttagcacatattttcttcaattttatgggttgtctgttcaccttattggttgtttcttttgctgtgcagaagctttttaacttgctatgatcccatttgtccatttttgctttggttgcctatgcttgtggggtattactcaagaaatctttgcccagtccaatgtcctggagcatttcccctatgttttactttaatagtttaacagtttgaagtcttagattgaagtctttaatctactttggtttgatttttgtatatgttgagagataggagtctagtttccttcttttacatatgaatatccagttttcccagcaccatttactaaagagactgtcctttccaccatatgtgttcttggcacctttgtcgaaaatgagtccactgtagatgtgtaggtttatccctgcatgttgtatttttatttatcattgtggtaaaaccaaaatctcaaattacagagccaattaatttatctgatgattcaccttggtttagaataggcccatgaagcctatcctcttagtggaaatgctccttctcttggcaatatcattcctctgtcacctgcagtacatttatattgatccttagaaacaaaaagctcctgcaaccatatagcttcggcaacaactctcctgttatctctcaatttctaattcatatcagaaaaataatctcatactcaaaaaacaaaaataaattacgaagttcttgagcaacctggaaattacacagcagacattttcagaagggaaaaatacattcacgcagcatctttgagttcctgggagttcatcttcaggagttagcagttcctctttattgaggaatagcccctttttcaggtaatggcagttttctgattcttgtttgctagcaggacaggagaacttactccaacagggctcaactcataaagaaagctccagcgtcttgcatccgttaaaatcctaccctgaccaactctcaaagcagagcttattctaggtagatggaacatgggttctctaagtcaacagcatctgtaccatcttatggacctataccaaataacagctggtcagtgctacagatagcaagcagtaaggacaacaaaaacatttataacttgctgacttttaaggagctttgggctttggaaatttttgccaaggatgttgttttggtagcactattaagaggaagtcgtgcaggctcttaagaaggaactaaatataagtgataagctaatctgtctcctgttttgctggcttacatttaggggtcagtttggagccataatcctcagcttttggcttcccttttgattgaatcactggtgattgatgttatatattaatacaggtgagaaaaaacctccaaactctagaaaactaggaaagagttttattttttattactttatacatgtgagaggagagtgttaatgattttttttctgatttgaaaaaatctttccaatatttataaaatttaggaattcagaaatatcaatgtgaatattacaagagtgacacaaagcaagacaattgataaaaagtacagacttaatagtaggtaagggttgttttcacaaggcatagcaataatttctaaagtccaggtatcttataagatttcattattataataagacaaaatcattcttataaaagattttctgatttgtaatgatctcttctttgcagctgcaagggaaagagggaacattttattttaatgaggctaagatttcatacataaagagttaggcagtcccatagctgaaattctattagcactaatacaaaaaaaaaaaaaaaaagaaatctcaagaaactcataatatgggaaggataagagaaaatgaactatcaagcatttaatatttatatctacagttagaaacatttaaaaatgttttcagtaccatttttccttcataagtgggatatattttctttcatttttgttctgttttgcttccaagatttggaagcaacctaaatgtccatcaaaaggtgaatggataaagaaaatgtggtacatatacatttgtgtccagaaacttccaagtaatttttaacttaaggtgattattagttatgggttagtgcaaaagtaattgtggttttgggcaagctgagctttttcagccttaggccatgttctaggtcatctattaagatttaattctgggcttaggaggaagcttctctgttccttcctctatagaccctgattttgatgacgagaaacaattcttgagtgactcaagttggtaagtctttgattataaaggaatacccagagaaattccaaataccagaaatgctgctgctgctgctgcctgactcattacaaagggttagtattactccccaacatgtacaaggcacaggttgtctctaaatatgagtctctctacatgtactttttctgtttctcttccttttaatctttagaaacaattttgttttatttatgatttacttattgtttttcactcttaaggactggattcgtcagaaaacacgggctcatgaataaatgagctcacgggagacacagcttttgctcccaacttcctgtccatttctgttctgtttcagaagtcagagtgtagaatacagtcatccttcacgccatatcttccaagttgtagttagcggaaattcctcccagactaaaaaatattatcatttaaagatatttttgaatgctctcaaatgtattttcatagggaattaaggggatgggaatgtgataaacaatctccttcccttccctccttaactctgtcagagccttatgctttagttaaataactttttttctgtgtagagaagttggatttttcaggcaagattccaaagattaggaaacttcctacctttgggatcggtaggtgttggttgtaattattctctaaggagtggtcattcctgcttttctgtgttgttttccaggctggaatcttgcaacctaactgtattttgttgtctaaatatatctaatgctctcatcagaagccagagcctgatatttctgaatctgtcaaccaataatctgttggatgatggagtgcagcttttgtgtgaggccttaagacatccaaagtgttatctagagagactgtcgtgagtgtttctgttttgttttctgtagagtcattttgcttggttctgtgtagcttaattgtgatctgatagggaaacttcttgggtcttggcactaactggctcgtttgtcaattctgaataagctctacatgcatcccccttctcttcctctacttccctctcttttacttcacttttagacctatcatttttttctgattgacctctttattttcattcttttccaagcttcccctctccccttccgtgttttgtttcatcatatcctgcatacagctgcaatggaattcgtaatttaaataggtttgttgaggttaattttatagttgaggtatgggggttataagtgccactgatttccctgtgaaggagaagagaagcatgggctttgggaattgacagatctcttctcatctctttctctttcagcttagaaagctgtggtctcacagaggctggctgtgagtatctttctttggctctcatcagcaataaaagactgacacatttgtgcttggcagacaatgtcttgggtgatggtggagtaaagcttatgagtgatgccctgcaacatgcacaatgtactctgaagagccttgtgtaagtgtcttcaagtttttatccttaatatatattgtacattttgaaatatgtttaaaatagtaaaatattatgaacacattctgtcccttgctttttccctgttacccttaatgaagaaggtgaaagtgatattaataattgccatttattgtgtcctaactctactctggatcttgttttaaacatgcttaatctgcaaaatagtacccgatggtgtcaaattgaccacccaattttgaggggcctcactctacaggtgaggaatgtgagccttagggagataatgcaccttgcttaatatctcacaagaaaatgatgaatttagaactaaagcctaccacctatcctagtctatgatctgagctcagaacagaaatatagcactctgttgtatgtctgaatcacattgtgattattctgctcatttttgttagataattttctaaacattgaattaataagccaaggttttaatttggccaaatatggttaaattgccttccagatagattatttatattcccagcagcagtctagggacctgcactttaacaccctcattggacatctacaatctttttgatctgtattaattaaatagttgaaaagtaacttttaaagtaatttaaatcttgagcatcttttcaaatgtttttggccttttatatttaggaatttcctcttcatgggctgtttttttctgatgttttctattatatatatcttatagttattaatatcacatatattattattttttatatattacaaataattttcttagcatgttgctttatttctaactttctttatggtcatttttagaacagataagtttaaaattttttgtgatgtcaaattctgcctcatgacctcaaggagtttggaagtacctttcttttaaaaaaaatacacatatgtcatctcatactcttcatggtttaattttaacgtttacatgttaaattattccaaatttattttgttataaggcttaaacttattttcccccatatatcagatctattgtacaaaagcaataatggcataatatggattttccttactgtttgaaaatgccgcttctattacatacaaagagtacttactttattaagattactcttattctactccatctgcctgttcttctagtccatggagctacttctacaacagagtactatgtatatgtgtaatgtaatgaggttagcatttaatttattgtaagaaaaatgctgaagaatatgagtctagtttgtagcccaatttgatgtatatctgtttcccaagtgagacaggctggcagtgagggtgtttcatctgagatggaatgttggcaaatagataagggatcaaatcatgaaatctcttcagagaaagaaatctctggacagtagagcaatgattccatctttcttcacattgtccttcctgtaggctgaggcgttgccatttcacttcacttagcagtgaatatctgtcaacttctcttctacacaacaagagcctgacgcatctggatctaggatcaaactggctacaagacaatggagtgaagcttctgtgtgatgtctttcggcatccaagctgtaatcttcaggacttggagtaggttttctgttgctttacttttgtgtagtttcaacaacagagtgtctggggagatactgaaagaaaggctgagaaccgagcatctatcagagaaaagaatataaagctgattttccctctctcttctgcctgagacaagctggggaagtctgctcatcagatttctaaaaataattaccatagtaattctaataaactttcctcaggtaatgaggaccagaggcatcaggctgaacagtggccattttattctttccttggttgtgccccagtgaatctactgtgtgtcctctacttttaatccagaagctaaaattgttctctactagtttttctcttagatttatatttaaactcaggtttataattaggtcaactttcaaagaaattgggaaggagatttttacagtatcctacaatctattgctgaacagtagccattttattctttccttggttgtgtcctagtgaatctactgtgtgtcctctacttttatccatgaagctgaaattgtgctctactagtttttcttttagatttatatttaaactcaggttataattaagtcaactttcaaataaatggaaaggggatttttaacaatatcctacacatttttaaactccaaccattttcattaatattatgttttctcactctatgagcagatttgcatacatatccattgcatgtgcatacataattgtgattgctttatggacatgatttggggtttccttttcacttgatagtatttcagaaatacatttatcgaggtgtgcatgctgagaataaaaaaagaaatacattgaaatacttatttcaaattatcttcttgattattttaatgactgtatggtatttagtatttcattgcataaatactttggccagcatgaatcaaaacagaggcgtcacttagcaacctcagctcactttcctaccagggcctcccaagtgaccagcaacttttgtgagtcattaatggtctaaccccaacatagttttttagagctataaagtcaagctctttggttgacccagaagtatttgtcttgaccagactgactcatgataactaaacttccaaatgagtttaataatttaatgtgacacctataaacacaaggcaattacactgtagggttcaataaatacatttacttactttaggaaaatgtagatgacatgggttactatgtgattctctggaatttcattgatcattattcaactggaagacaaagttttacttaatggatgttgttaaatccaatgtcttcatttaactacagacgtataatttctaagtgacctatatacccaaggtctttgctagcccactttctgtccttagcattgctgtaaacaaagctgtactttcttaattaccttccaaagcctctatgcagaccatgtcaattctcttaaccaatattttcaaccaatatgaactagatgctgagggaactaaaagtcattaaggtgatgcttttgtccccaaataacataaaatgctgataacagggaaataaatataaagcaaattacaatatattccatacgttgttataaggatatgacaacagtctcagggattgaggctgggacttctcagtggagacagagttactttaggctagagaaatgatgaagattctgttatgtggggatatgctaaacagaaggaaaggagagagaatagaagagacgcaacaacaaatatggtttagttggagaaaaatgcatgtgtatggttagagaataatgtggggacaaaatatggaaagagaaagcttgaggccagattgtgagtgctcttgaatgccatgcaaaggacctggaataaatatctttttatatgtagctttcttctttgaagataatactttgagatagattccaggaaacttttttcacttaaagatatattaaaaactgaaagcacagagatctattagttccttgggaaagtttatattcatttttttaagtattggtaaaaataaatgtttatacccttgatttttaaagctctgtagataacctgtttgtggaagaaaacagttttacctgctggtttattctgctcattaagaaatcccatcatttttactgataaattagaccctcccatgtatgtcctggattgtagatagaaaagagtgagaaaagaggttcaaatacctgggtatatctcctaggaagaaacttatttaacctcacaatggaaggattcacttttcctattgtaattcttacagattgatgggctgtgttctcactaatgcatgttgtctggatctggcttctgttattttgaataacccaaacctgaggagcctggaccttgggaacaacgatttgcaggatgatggagtgaaaattctgtgtgatgctttgagatatccaaactgtaacattcagaggctcgggtgagttcatagttttccattaggaaaatgatgcctatttggtagctagtatagctagaagatatttagtgtatggagagaggataaaaactaaatggggctagaaggtaagttactctcagaaataagaatctaaatttcaaataaatggatcaatgtactgcatgttctttagtatagaagccatatttcacatttctttgtgtcccctttagtaccttggacagatacttagtacgcaaatggtacctggtttgggtcttcatgttctgtcatccttcagatagtctacttgtctttgaattaatttttttattaaattgaagacttttactaattatcttctatctgtaaaatactatgttcttaaggagcttgtaataaaatcacattctgtgttgtggacatttcttacgttcaattctgtgtttagatttttatttaattttgaactgatattggctagtacattttcacttatacaacatgaattattgacctcagggtcaagaattgtgctctatgtgtgggaagctcagacataatgacatgtgtcatcctttagaaatttaacagtcttccagagaaatctcccctgactcttccaagaaaatgaagctgttatatttccattgactatatatttttataatagcaatgatgatgatgtaactgttaggtctgagatttaattttatcctacttacaacctaataaattcaccggttactgtttcatggatgctggacaaaaaacaaaaccaaacccacaagactcttaggagagacaaaggactttattgcttgtagcagagcaagagcatgagtattagcatgtttgcgtcagttccttttgtcccccgagtctcacagggctgatgaagagggtccagatggatgcctgcacatgcaacattgagactgagagacctaggattttacaggaggcagtaataagcctgctgtttgtccctcaaggttgctcattacaaacacaatcctggaaaatggcccaggtaaagcgctgtcagggccttgcatttttgttagcaaacatgtagcagagagaaagacctatggaagaatatctccccaaaatatctaccccttgtttctacacagtaaaatcttggcttctggtgaattttcacataaatatgctactccattggccactctgattaacagagactgggaccaaatctgttcagttaatctcatctaccatttaattaaggccactaataacaaaactccaagcatgtgatgagcccaacttgtagtattgatttcaaacattcccacaggggtctgactcagtcaactgagtaagtcccaggaaggactactaggtcttttatgctttagaacccatacaagggagtctaaaatgagctgccattctttggtgtcactggcaataaataaacaaagatgggccaaaagcagccctcctccccagtaaagagacagttagcagtccactcttccccacatgcaaacatgtaactgaaaggggtagaggtcactctaattttggatttgctgttatattttatttggttagccattgcactagtttggttaagccaggtaagcagtctcactggtagttgtagcttcctcattctcatacgtggtatagtccaaggctgttctagcatcaagagaagcttgcagatttgtatcgaattgaaacaaggttgtgctagtgattgtgtttgtatacatatgataagattccacattaggaggttgctattgatggcatcaggcacagcaaagtagttcaggacctgctatgtctacatgagattttctattttcatagtatatagacaggcatgacaaaccaggccgagggtcagtctgtcagctgcagttgctgcttagactccacagaccacataattattttgccaggccaaggtgttggatctaggagaaaaaagagagagtgaattgttctcctcactctccacacctccaggttctaaagtgttccattccaaatattgttgctgctcttcccctacaccaatgaaatcagtttgtgccatcccagtggctagaacttcacctattctccaattatcctttacttgcatggagacctttggtctggaggaatcatacaaatgggagagagagaaaagcatctttacaatatttacagaaacccattatatcttatacattatataccaattctatattatctgaatatcaaaggcaaattaggaagctttggagcctctaatctaccttttaaaaatatatgtagctgtaaagttcaattttataattttcctatatactctttttttttccagcaaaaagtattgaaatttttatcccctctgcttggtagggacatctttgttataaaccacattttcattggtgcgtggatctgttcctgggttctgttttcctttccactgacctgtttgtaattcccagttctaacaatgctgtcttaattaatatagctctatgataagccctgatacgcactacagcaattcttcccatcttcttaaagagaattttggctctccttcccctttacatttgcaaataaattggaaatatcaacttatcaagttacatacatatgtactgccccccaacctacctatatgttggcgtattgaatcgaattgcattaaatctatcagtgagtctcctgatacaccaaaaagacatatctcatttatttaggtctatcaataaagcttagtaattttttcttgagtggtcttgtattttgttactggttaactttattccaaagtgcttactatatttcatgctgttgtaaatgattgttttagttattttttcattgtgtttatacatagaaacataggagtttttaaagttggtttcttatccaatagcctgccacattctcttgcttattctagttgctaatttgtagatacttttgtattttttaggtatacaatcacatcatttgggaataatacaatgtagttgttttttccttttctgttcttatattcttttttcattttttatatgccttagtaactgttaatatatgtgatataatgttaatatgtctggggataatgaactttcatatgttgttcacaatgtttgaagcacaacttcagtggttcaccaatttatcaatttaaggaaattgccttctacacctagttttctaggagtattctttttcttttttttaattatactttaagttctgggatacatgtgcagaatgtgcaggtttgttacataggtatacacgtgccacggtggtttgctgcacccatcaacccatcatctatattaagtttttctcctaatgctatccctctgctagcccccatcccccaacaggccctggtatgtgatgttcccctctgtgtgtccatgtgttctcattgttcaactcccacttacaagtgagaatatgggatgttggattttctgttcttgtgttagtttgctgagaatgatggtttccagcttcatccatgtccctgcaaaggacatgaactcatccttttttatggctgcatagtattccatggtgtatatgtgccacattttctttatccagtctatcattgattggcatttgggttggttctaagcttttgatattgcaaatggtgctgcaataaacatacatgtgcatgtgtctttatagtagaatgatttcttatcctttgggtgtatacccagtaatgtgattgctggatcaaatgttatttctgattctagatccttgaggtatcgccacactgtcttccacaatggttgaacaaatttacactctcaccaacagtgtaaaagtgttcctgtttctccacatcctctccagcatctgttgtttcttgactttttaatgatcaccattctaactggcatgagatggtatctcactgtggttttgatttgcatttctctaatggccagtgatgatgagctttttttcatatgtttgttggccacataaatgtcttcttttgagaagtgtctgttcatatcctttgcccactttttgatggggttgtttttttcttgtcaatttgtttaaattcagattctgaatatttgtcagatggatagattgcaaactttctcccattatgcaggttgcctgttcactctgatgacagtttcttttgctgtacagaagctctttagtttaattagatcccatttgtcaattttgggttttgttgccattgcttttggtgttttagtcatgaagtctttgtccatgcgtatgtcctgaatggtattgcctaggttttcttgcagggttttgatggttttaggtcttatgtttaagtctttaatccatcttgaattaattttgtgtaaggaaggtataatgcgtaaggaaggggtccagtttcagttttctgcatatggctagccagttttcccaacaccatttattaaatagggaatcctttccctattgcttgttactgtcaggtttgtcaaaggtcaagtggttgtaggtgtgtggtgatatttctgaggcttttgctctgttccattggtctatatatctgttttggtaccagtaccatgctgttttggttactgtagtcttgtagtacagtttgaagtcaggtagcatgatggctccagctttgttctttttgcttaagattgtcttgactatacgggctcttttttggttccacatgaaatttaaagtagttttttctaattctgtaaagaaagtcaatagtagcttgatggggatagcattgaacctataaattactttgagcagtatggccattttcatgatactgattcttcctatccatgagcatggaatatttttccatttgtttgtgtcctctgttatttccttgagcagtggtttgtagttctccttgaagaggtccttcacattccttgtaagttgtattcctaggtattttattctctttgtagcaattgtgaatgggagttcactcatgatttggctctttgtctgttattggtgtatatgaatgcttgtgatttttgcacattgattttgtatcctgagactttgctgaagttgcttatccttgaagaattttgccaaatgtgatgaatcacatcgatataatatgcattatatcaaccttgcattttttggagtaaaaccaacttggacatatctcctgtgtacattgtgtaatttactttgttaatgttaatattagtgacagcatttaaccattttgttcataatggagataggttataatttcttttgcagtcttcatcaagtttttgtgtcagaattacagtattttgatgagttcaggagtgtttcttatcttttagtttcctgagaagatttttgtaagattggaattatttcttctttgaactttgtaacaatttctggtgaagctgtctaacctggagtttctttgtatgtaggatttttgacttctgattcaattttttaaataattatttaggttttctctttctcatagggtactttttagtaagtatatattgttgattttatctatttcatctaaattttaaaacttattggcaagcatctagtattttattatttgcttaacttcttaatcatctatagtgatgtgttttttctcatttctgatattgaatttgaccatttctttattttttattcaaagaacacaacattgatccactctgttgtacatctacattctatttcattaatttctgtttttatcttatttttcttcttgtacttttgttgggtttattttaccatttactaaattcttgagttgtatgcttagacatacatattccctttcttcttctccaacaaagatatttaaggttacaacttcccttcaaatgactgcgttaacttaatcataaaattttgatgttgtatgcagtgtttttgttatttttgagtccacaatatttgtaaacttccctagaacttttttcttcaactaataggttatttgtaaacatactccttaattttcaagcatgaggcttttctttttatattcagtctgtagaattgttgtctgagaacatactgtgcatgagtacagttctttgaagtttgttgtcatttgctacatgactttttaaacatacttaagaacacaaaaaattgttatttctaatttaatttatattttttctaagtacggggtctttttctttcacccaggctggagtgcagtgatgtgatcatagctcactgtagacttcaatcacctaggcaaccaagcctcccagcctcacgagtagctaggactacaggtgtgcactaccatgtctggctatttttttcttcttttctggtagagatgaggtcttgttctgttacccaagctggtcttgaattcctggcctcaagctactctgttctcttagcctcccaaagtgctggtattacaggtgccagctactgtgcctgggcagtggcagtattctgtatcagttaattaagattattagttctgtttatctaaattttagtgatttttttccagataactcagttactgtgaaaaatgttaaaattttcattaaaattctagatttgagtctttgcagttctgttcgtttctgtcttctatattttgagactataatttgtgactgaaaatataaaatgattatatttcctgatgaattcatgataacactttgttttacgatgctttttcccctaaggaagattttgtgtgatatttacataccctgtctcataattagtgggactatctcttcatcacataaatgtgatcacttaacaaaaaaaaagttttgtatgctcagcatctatataggtactcagttgttcaatggccaggtaaacataaggtgaaaattagattcaaattgtttaggagaatgttagatgcagaaggctgagtttgacatacttcctcagttcacgtatatactattatcggcttgtgcagaggcccttggctgacagatgggtgggttggctaatttatctccattagccattctctttcccacctataggcagctgacctaatgtattcgaaataggccatgtaattgcatttttatttgcatcaatggcatgatgctagagaccttattatatttcttgcttattttattttattttttttgagacggagtcttgctctatagctcaggctggaatgcagtggtgcgatctcagctcactgcaacctctgcctcctgggttcaagcaattctcctccctcagcctcccaagcagctgggattacaggcgcttaccactacccccagctaatttttgtatctttagtagagacaaggtttcaccatgttggcctggttggtctcgaactcctaacctcagatgatctgcccacctcagcctcccaaagttctgggattacaggcatgagccaccatgcctggcctattccttgctttttaaacactcactaccaagcttccaatatctagttatagtgatgtatttttagtgatgttcaaggattcaactgcttcatagtattttgtaacgtgcttgcatattttatttattccttaataattacgaatttgtaattcatgattttggaagggataagttcagcctagaaatatctggtaataatgaatattataggtacttatagtccttgaatttatactaactgtgctcattttttaaagtttctggaattatcctccattctgagttcacagatctcttgtgggctttgttgtgtcatcgaataaattcatttttatcttttgtctctcttctctacaggttggaatactgtggtttgacatctctctgctgtcaagatctctcctctgctcttatctgcaacaaaagactgataaaaatgaatctgacacagaataccttaggatatgaaggaattgtgaagttatataaagtcttgaagtctcctaagtgtaaactacaagttctagggtaagtctccattggcttctcagggggagcatttcctataatgagggatttggggagccactcattaatacaggcctcagaatccacctaattgtgtatcattgggtattttctagacacttatttgtttttctgtcatagaacactgaatattgagagatacaatatagcatagtggttaaatattgagcaccctggaaccagcctagatgagcttgaattctgaccctaccacttactaaatgtttaattaaggctagtcccccatcactctttgttttgatttgcttatgagtaaaatgggtgaaatgataaaatctacccataaggttatcatgaggatctgagtcaatataggctaagtacttagaatggtgccttgcatgataataaacaataaatatgttctctgtttttattattatcagtagtaatattaattttgcttggatagcaaaaggctcttggaggatcctttttaattttaattggtttctctttctcttctgttaatttattctgtcttccttccactactttatctccctcactgtatctctctcagttcgcttccccactcctcacccatgttataatattatctctctattttaacagaacagttttttttctcctgaaataaatcctttacagagaaagtggagggctgtagggaaattgaatgcaggaaaagagatgttcccttgttttctcaggttgtgcaaagaggcatttgatgaggaagcccagaagctgctggaagctgtgggagttagcaatccacacttaatcattaagccagattgtaactatcataatgaagaagatgtgtcttggtggtggtgtttctgatttgaagaaactgacattcctttaaaaatataaatataaatacatacatacatagatatatacccagacttgggtgcttagcttcagatactctatgcccagagatagtgcacttggcagctgtcagataccattcatctacttctctgtaaaatgtctgttctacttcacacagtggtcgagaggctaaaataaaatgaaaagcataaaactctctgaaaagtatgtttttaattggatacagagcttaagaatgcaggtaagggaagcctggatatgaggctggaggatgcagacagggaagatcagttaaaatgccttgttttttccttacttccactgacatggcttagttcacagccctgctatctctggcacgttttattaaaatgtgtctccatatgtgttcttgggatcaccagtgtcaagatcacttgggtatccgtcttaaaatggagattcctgaaccccacactagacttaccaaatcagaatgtctgctaccagctagcaaccagcatttttgagaatttcccaggcaaattcttaagtatactaatagttgagagtcactagtttcaatagaaatgggagtctacttctacaatgaatactttctatagcttattgtaaagataaggaggattaatttcctttaagggaatataaggttatttgggctagagctagaaacagattctttcatttggcaagagcgtgacacaataaattttgtgtgtgtgtgtgaaagactgttctggttatttattgatcgtgtaacaaactatcccaaaacttggtggcttaaaacaataatgattttattaaatctcataacttggattggaattcagaaagggcccagctgagcatttcttatactccacatggtattacttggggtcccttggtggtattcacctggcagccagattgctctggaggccccagataacttggacacgtctgctgccttggcagggatggctgaaaggctgggatgagccagaccccttttcctgttatcagccggaagtctagtgattctcagcaattttgatccttgccccctcagaggaaagaattcaactgagaggcagaagtaggtttaaagcagaggcaaagtttattaaagaaagcaaagtacacttggaagaaatcaagcaggccacctgagagattcaagtgtctctcttgatccttggtttgagactttatacattgactcatcttccaggctcttctcccctgttgatccctcccttgggcgggttgttgcttgattacctgtgtgcagtggcctgtcaccacttgtgagaggccccgtgcacggtgtgtttactgaagttgtatgcatgctcccttgggatgattttttcttactggttgagctcccccagaggaaggtcatatacaggtcaaagtccaccatcttgctcccctttgcacacagttgaaactttatcagggattgtggtttgctgactccaggtgttttctatctgttggaggagtcctttccttcctggtggcagttgtggccacttattgtctcagagagatagttttatgctcacctgtccttcacctgatgagagccagacttctctgggggccctcccttgtcctgttcattatctcagaggaaaaggtttacgagtgcttgactatggctcaagaattgcttggcattcctgggggccctctctcctgccctgctctcatatctgtctaactacctactctaacattgcttgtagtcttagggcctctccatgtggtttctgcagtgtggggattcaggatttgaaagggccaagaggaagctgccatttatcttaaaagctaggcccagaactggcataaagtcacttccataatcctccattagtgaaaatagtacaggccagctcagattctgggagaatcaattgttgatgggagtagtgtcaaagaatttgtggccttccttagttcaccacaaacttaatgtttttctccttgtctgtgggagaaaataaagccttttaacttattgtaaggcaaaaaccaacactttttctttgataagactgtcaattcccatgcagttctggtcaccaaaatgtgtgggtttttaccacaccaagcaattttccaacaccagctgggtgtcctataattcaattctattctgatattatcatcctggaggtagcattgtatcccacaggtgaggatctcagtcccacaagactctcccctatttgaagtaccaattgcaagttccaggttgtgacctgttcttctgacaaactggccataagtcagggttcccacaactctcttttccctgggttccataatttgctaggatggctcacagaactcagggaagtactttgcttatgtttacccatttattataagagaatatttcaaatgatacaaatgaacagccatatgaaagagacacatagggtgaggttcggaaggttctatccctgtgcatttggcttgtgctaccttctaagcacatggatgtgtttagcaaccagggagctctctgaatcccatctttttgtggaagcttcattaggtaggcatgattgattaagtcactggccattgtcataaactcaaccttcagcatccccttgcttctttggaggtcgggatggggagtgctgaaaattccaaccctttaatcacatggttggttctcctagcaaccagcccccatcctgaaactatccaggagcctccaactaccagccatctcattagcatacaaaaacacttactgcttcaaatattcacaaagttttaggacctgtgtgccttgaaaggggccaggaaatcacactcgtataatatcccctgagtcaatgtggaggactggagaatagaccttggcagtcagagggggcaaatggttttcgtgaaaatttgcaagtaatgttactggtgctgatatccacacaaaacagtaatactgctgctcacatttggcataggtgatacatagagaggtggctttactgaggttgattcccagtgaggacagtcttgctagttagaggaatctaactggggctattataacaaacacagaaaagaaagtatacaccaaagtggtgacacctctttcacatgatagccttgggctgcagtcatcgtctcatccttcacagacaacaggatttccaagctgcccaaggaaaactccaacaaaggtaaatgtttcttaagataatttctaccagactgtcagaaaaaggaaaattcttatatttctgaaaccatttcagagcattatagaggaagacagcttttctaattcattttttaaagatgaaaactattgataatagaacctgacaaccaaaatgagtgattgaggcataagtctcaaatcatcaggatttattgagccagcttgagaatgcatctaggaaaaataggggtcacaggtgcatctgtggctgttttttctgtagcggatctgaagaggtttagtatttatacattttcctttaaaaaggggacgtgtcagtgaaattaatgattatatagttttcagactttagtgcccagtaaatctacattttatataaggtgaacatttgaagaaaaaaggaataaagtaagcagatgtctcaggagtgaaggaataattaatctttgtctttttggtgcacctggggaagataagctagttgttgacattattggtgtggagccttttgaaagggctggtttctgtttagcctgtagggaagaaagcctaagggtagttaactaaggggagggagtaatgtggtgtgtctgacctcccgtctctcctgacatgaatgggaactcagcttccaaggtttttccagggttccgttggccaactggggatccattcagtcagttggggactttggattttattatttctcaagcctaatagcactatcacgaaatttaaagatgaatgtcacttatgactatgcaaagacctagtattaaaatttttgaaaatttcaacatttaattaaaatatactatgattattgtgacttagaagtgcaagagtgggctgataggaggaatattataatttatcacattaattggatgatgcagaaaaaccaattatctcaatttacattgaaaaggcgtttaataaaattcagtctctttgtgaggtagttttataacatgatgaggaatgtttatcttaaactgatagcaatacgcttagaagcattagcatttaaatattaaaaacatgcctggtggtataactgagcctatattacaaaaatcattatgtgttcattttacttattatttgtctttgttcttttcttcctccatgcaagtaagcatggagtatacagtcattttgagggaatatagtcactagtaattgtttaacttcatatcctaaattctggggcaacctgcagaattaatgaactcatttttcttttaaagaacaatgatccttaggtcatgcagacctccttgatggcacccagaagtttgatcaccctagagatgcagatagctttgatcatcggggatctcccctcctgcatgtctaccttattcataaaagcccacagttatgttcgaaggcaggtcaaatttgagagctcatctctcctgccctctcactttagccaaattgaataaacttttatctgctcctaagggatgatgtgtcagtgtttcacttactgcacatcagatatatgaacctaaattttggggttctacaacagtgtcactgctgtggaacagtggtgatggttagaataagtcaaatgaaaattttgatattttgatcattatggatatttttgcactaacttttgtctctaaaaatagtatttatcttggttactaagtttttttgtatctccttaaattttgtgcatcaggcaagtcactcccctcatgctaaactcagctctggggaagaaagggtttgcaattttaaatagagtcaagtcagattgtcaaaaaagcaaatagagtcttcaaaactaactttagttttttttattctttatgttttatcgttttctttttaatttttttgtgaatttttattgcattatttctgctatctttaaatttattctgttagtatgctaacttcttaagttggattcttctgattcccagccttctctcttttattataagcattaaggctatgcatttccctttgcatacctgatcctctctggccactcagctcctcttcctcctccttacagagctggctctggatgatcccttaacctgcagttgaaatatcgcctcctcagagaggttgagcactctatcttatatatcatcatctccccctcccctttcctaccaaagcaccgtgtttcttttttttttctaccactatcacagatatgtatttattttatttcccatcgcttgtctccctcatcacaatgtaagttctatgagaacagaaaccatgagccttttcttcactattttatttccagcctacagcacagtgtcttcttgcacatgtgggctatgattcaagagtgaatgaatgaatgaataaaaattgatgaatgaatgaagaatgaatagaagcaaaagcatcctactcttccagggaacacttgtattattttccaacttcccagcaactcggtgaagataggtgatcttgttatcatgggaagccccgcagactccagcagaagtcactgcccgaaacacctagctctctggagactccctagaatcgcatccggtgggagtcccgggattctatcccagggtgccccacgtttctggttgtctttttacatttctttaattgggtgtgacgaatcagctctcaggccctgaccttccgctcctcctcctgtgtccctgagccagacgccctcggaactcggcgtggggcgcctggtaggggcgtgggtgcggctggaaaggaggtgaccccaattctggtctccatcaccagagaaagcaggaccctggacagcgccgagagcccacaacggctagcattccttcctttagttctgagttctttgcccgcagggggcaatttcgccaatctgggccgaggtcccaatctctgaagccactctcctaaagacagaaatggattccagaaaagtggatgcttaccattcattgaagtaacataaatatatgtgaattaaaagtcagccactcttttggttcatgctgtttgaataaatgagggtgtattagtccgttttcaggctgcagatgaagacatacctgagactgagcaatttacaaaagaaagaggtttaatggacttacagttccatgtggctggggaagcctcacaatcatggcagaaggtgaaaggcacgtctcacgtggctatagaaaagaaaagagagtttgtgcagggaaactcctctttttaaaaccatcggatctcatgagacttattcactatcatgagaacagcatgggagagacctgactacatgattcagttacctcccactgggtgcctcccacaacatgtgagaattcaagatgagatttgggtggggacacagccaaaccatatcagagggggttcccagtagtcaaatttatagagacagaagaatggtagttgccagggtctggaggtggggtgggggggaccctggggttgtttaatgggtatagagtttcagttttgcaagacaaagagttctagagtgtttgcacaacaatgtgaatgtacttaacactactggaatatacacctaaaaatgactaagatggaaaattttatgtgcatttttaccataatttaaaaaataaattggatgaaattaagtttaaaaattgaattaggctgggtgcggtggctcatgcctgtaatcctagcactttgggaggccaagacgggtggatcacgaggtcaggagatcaagaccatcctggctaacatggcaaaaccccgtctgtactaaaaatacaaaaaattagccgggcatgatggcgggcacctgtagtcccagctactcaggaggctgaggcaggagaatggcttgaacctgggaggtggagcttgcagtgagcccagatagcaccactgcactccagcctggacgaaagagcgagactctgtctcaaaaaaaaaaaaaaaaaaaaaaaaacaaaaaaattgaattagattaaattacattttaaagaaattagagggctgggcatggtggctcacacctgtaatcccagcactttgggaggccgaggcgagtggatcacctgaggtcaggtgtttgagaccaccctggctaacatggtgaaaccccgtctctactaaaaatacaaaagagccgggcatggtggtgggtgcttgcaatcccagctacttgggaggctgaagcaggagaattgcttgaacccgggaggcagaggctgcagtgagccaagatcgcaccattgcactccagcctgggtgacaagagtgacactccgtctcaaaaaaaaaattgattaaatcttttaaaaacaaggaggtatccaaattgggagtctccctccctactactgaagaattgtgggatagtatagagccatggggttgctccacatgtctggaccattgaaccagaactcaatccctgaagatagcaggaacaaagtaagggtcccaggccacaggcacttcgttctgctgcagggaagtttccctgacctttctagttggaaagagtctcatataattgtcttagggaattataccctgaggagatagggatttgcaagacaattctttgcattctccaactcttccttgtcaggacatagccctgtgcagattttctggggggccagaggaagaagatgattcctttttctctttctctatggtggatacgtttatcttcttcatcttggagcttctccgccccctaaattcccatctagagttacctgttccagttactctcttggaggatatggaggccaatgtagccagtaagatactctgtagagaatgccccctctttgcctgtttctcattcctttggtgtactcttctttgttcaccaatattcacaccttcactcgtcattcagatctaccacaattctctgccattagttgtaaaaggaataaaaagtaatcgttctttatctggtcacgtagagaacagtgtataaacacatattcatcaattgtatttttgcaatttcgggtattataagtatacattaaaatattacttaataatttttcaaaataagtagtctagaccatgggtgttagaatttttgaagaccatatatgttagaacctcttcattgcagttggcttgtgttggaaacaaatgcttggtgccacaaagaagaactagcactgagacaaaagacaaagggtctctcagcaaggcaaatttacttctgcagaagggtgcatctcacgtatggagcaagggcaagagcacatagaacaaaggaaagcaggggtttttattatctctaatgcagcttctgcttctgtgtctttcccccattggctagggttggaccccacaatctaagctgaacccgattggctaacttgaaaagtgcaggaatgcggttacactggcgggaaggcaggaagatcagtgtcagtgggagaagccattgcgataggaggggtaattgacagcatgggtagcagatgtggaatgtgggctgtatagataaggactggcgggaaggttgtttaccagggcagggggaacacagagagtaaggaagtctggctttgaaagcagagaacaaaggacaaggaaacttcagcaagctaaacctttgaagaagaatttcttacgtatttaacaacttggcaactgtttaggtatcctggggaccccatttgcagctggcatctgaagtgagggcagccttattgggactaagcccttaaagtgtgggtctgcactaattcctggtacttagtgtcagaatagaattgtaggacacatggttggtgtcagaaaattaagaattgttgttggaaaatgatatactatctatccttgattactacagtagtctcctagccaacttgggggttcctacgatgccctcagattcaataattcattacaaccattcacagaactcaagaaagtactatacattttgtcgtgaccaatgcaagattagaaataaccaggtccatgcatgtttgtgtctttccacaatgtcaggcttttattgatgctatttcaatcacaaatgccacctggagttcccacagaaacaattctccatagtacttcctgtttactccctagccagagctatggtcacacaggttcaagccactccacaagtcagtcaatatgacatatcatacatagcagtgtgcttaaccaatattcaaatgttatatgttaaacattccacaaaagcaaaataatatttatcaccaaggggaaaaagagatagcgtaagacttaaagaaagaggaaagaaacacgaaacacggcttggcagtcaaagacaggttttctttagttaaaacatgagaggtgctcctggccgattgtggtcaggatcactttctcttacagactaaaagtatatattggttttagggtgagggggcttatcacaagcttggaatgtttatgtgtgtggggagaagtttatggtggggttggaatctctcagttaggaggggaggttgtcttgggacagaaatctttctggcccagagcggagttatctcgaggctggcatcttcctggccggaggggtcttatctaggggccagcatgtctttggttagggaggagtttgaaatgtttctggttggagatgttatttgtggtttatggtcatgctgaccttagccattaggctgatgccctttggatttaggtggttttttttattaaggtgaactttagaattagggccttgtcccaaatggtgatgctcctgctctgtcagataggagaaacggttaatgaatcagtccagggaaagtgaagaagacagaatcctggtctgagccaagtggtctaggtggtctgttggtcttgcaaggcagagtctttgactgcaagatagtatcacccaagatgggcattttgagctgctgaaaggctaatcttttatagtcacagagtcctctgatgagaactgatagtggaagagttcttgtttgtgtctttatgtgattggatgccatcttttttttttaatttgtttattaaacaaaacatcttatccttgttggcaaagtatcctatgaaatataaagaggagtctttttctaagatggagttagttatgtcaagggtgctctatacacttgtgattacagtttattataaaggataggaaggaacatccagatgaggaggtacataaggcaaggaagggggaaaagtgtacagtttccatgccctctgtggcatgccaccctcccagcacatccatgtgtttatcaattcaaaaattccctaaatcccactgcttggagtttttatatgagatctcattatatagacgtgactgattaaatgattggccatcagtgattaaacacaacctctagtgcctctcctgtctctggaagtcagggtgggaggtagggctaaatttctgaccctccattcacagagtttgtttctctggtgaacagcccccaccctacagtaatctagggcccccaccatgaatcacatcattagcataaactcaggcatggtcaaaggggctctttatggataacaaaagacagtcctaccactcaggagtctccaaggattttagaaggtctgtaccaggaaccaggacaagaaccaaatatatatatttttgttacatcacaggataccccttggtctttgaccatgaattctttatagcaaaaggatcatctgtctgagcaacattttgaggaaggagtgtggtataggaataggaggcttttaactcattttttttccaattcatttgactatcgatattggtattatattttttaccaacaatgcaagtgtaaaacaatattacattatggtagatgtaactaaaaaataaagtcgaaagatgctggcatattactagagtcccattcagttcttaataattagttcagtctattatcatatttcatgaaaatgtctcctgggatgaggccactccagtttgcaggctttcatttgatcctgcctagttccaatagcaggagcggtgtcagcaatagatggtttcacccttcgaggcatgagatataactgagtaaaagataataacatcttttgctctgagcctctttcaaggtgttaaagtactattgagtttccgtcattacagaacccatttatttgttgcattatcctcatctactatttctccttctctccatttatacaaatttttccacctttggaagggacattaggttcagccactgtgctggtctaattgcaggcagcaatactaatctagcaagtacctctccatcagcccactaccattcacatagggagcgttacatagttatagaaatgggctatttttaccattagacattataattgtgttcacggtcaatcccagtatttctagatgaggtgaaggcacaatctgacccatcaggcctgtaggaattctgacataaagtttagaatagagctatactttattgtttaggaatcatcactgccttcagcacttgcagttgcagccttgagcctgtgaccatgaagtaggaaaaacaaagttgaagtggcacggggaagaaagaagaaagtatagtcatcagtcatcttccctgtgggagaaattgcatagtcataccagcatcttctcccactccctatcctgctgatctaccagaaaaccaggaatctatctaggagatgcttgtctccttgttgttgagtgtgagcacacatttgcaaaggcatgtaagccagctcttcatgcttttatattctcccattttaggcaaccagtgtttcaaatgcccattccaattctctactgaattattatattactctgaggaaaatatctctctgccaattcttgaaattatagattgtgagaggtgttcctcggtctgatgaaatgttacttggtagtccaaattgatgcaatatcttctattccgattctttgacagttctctgaatatttgcatctatcacatggtaaggaaagccaagtccagtgtctattcccatcaagaccctctcatagccagcatcagtcccacctaccagcttgttcagggtcttctcccagggactgttgacacacagccatctgcagtgtctgtctcttatttttggaaggcaaaacagtttttagtggtattttgtgcttcagaggtgcaagaggaatatgtctagagttcatccatctttacattgctgcaggcccccagtgtccactcatttcatggacccaggtggctacttcaagcaagcatactgggatatctactggtcaattgcagtcacctgctgaacctacaaatggattcttctgttgggtaccaatgtgttctaccttaatgcactcctccccaaattctcttactgattttcctatgggtatgcctttaataggcagttttacattgctctctgtctggccacatggtcaggccattggtcaccatccacaaagcagtaaaatctcaagtgggggatttttgtctttgttcaattcttccatcactataaggaaaatagcacataatgttgcccatcaaactggtttgttttttatgttcttcaaacatagaggtggccttccaaataggatgctgtccattcactttgaaactgctatttataaaccaaacaactttctgctagtcatttgagaactattcacagggtactatccatagtatagaatttggcacctcctcacaatattccaaagtcagtcctggggaaaagagtctacctgctcctccagtagtgtattcctattttgacataagaaatatgttttgtttctgctcgcagttactgacacaggtcttaaaacctttggaacttcctgggagataggagtacgctttgttttattgaggtgactcttggcgggctactggatagctttgggatggctgctggtcaccagaaataccaagccatgattagaggtggagaattttcagcctcacaccccgtcctccagggaggggaaatggactagagattgacttaatcaattgtgtctatgtcatgaagcctccataacaatcccgaaaaggctggctttggagagcttccaggttggtgaacacattcacctgctagaagggtggctcactccagcttcatgggtcagaagcccctacactccagacccttccagaccttgacctatgtatatcttcatctgttgttcatctgtatcttttatcataatctttataataagccggaaatgtgttttccagatttctgtgagatatcatagtaaattatcaaacccaaggagagggttgtgggaatccccaatttgtagccaagtcggataagcagtgtaggtcatctggggatccacttcttgtgactggtgtctgaagttgggggtaatcttgtagaaataagccctttgaggtctgcaatacttcaggtagttagtgtcaaaattgaattataggacacccagttggtgtccaggagctggagaattggttggtgaggggaaaaactctgtgtttcaataaaatttaaactgtggtaaaatacatataactgtgttcaccatcttaaccagtttggtagcattaagtatattcatatttactgtggtaaaatacatgtaacatggtgttcaccatcttaaccagtttggtagtattaagtatattcatatttactgtggtaaaatacatataacatggtgttcaccatcttaacctgtctggtagtgttaggtttattcgtatttactgtggtaaaatacatacaacattgtgttcaccatcttagccagtttagtagtgttaagtgtattcatactgttgtgtaaccaatccccagaactttttcatcctgcaaagctgaaactctgtactcattaagcaacagctgttcattttcccctcctagcccctggcaactacattctactttctgtctctatgaatttaactagacacctcatataagtaaaatcatacagtattagtctttttgtgactggtttatttcacctagcataatgtccttaaggttcatccatgttgtagtatatgtcagaatttccttccctaaggctaaataatattttattatgtgtatatagaatagtttctcagtatttacggggaattggttccaggaccaccaaggataccactaagtccctgatataaaattatgtagtatttgcatataacctgtacatattctctcatatactttaaatcatctttggattactgataatacctaatacaatgtaaatgctacagaaatagtttttataaggtattgtttatgaaatagtgacaagaaaatgaagtctgtacatgttcagtacatacacagtgttttgtgaaatatttttgatcctctggtggctgaatccataaatgtagaacccacagatatggagggctgactatgctacatttttaaattaattaatctgtcaatggacacttgcattgctcccacttcttggctgttgtgaatactgttgctatgtgggtgggtgtacaaatatctaagaacctactttcaaatcttttggttatatatccagaaatagtgttgttgaatcctatggtaattctattcctaattttttgaagaactgtcatactgtttttaatagtggctgtaccattttatattcccactagcactacacaggggttccaatttctccacatccttaccaacacttattctttttgtgcttttgacaataactatcctaattgatataagataataagattattacattttcttcagtcatggggaagtttcaattaatgtccgagattgagctagtaattgactcagatgtaaattctccacttcaaagtacctgtagttgttgctggaaggccctccaggcttttgccacaagccctaatctaccctccacacaggtccactatgcacagaatttgtgcatcctagcacttcaggttttattctatactgtgtgggcttcaacaatcttgttcatttctatttagcaaatataattaatattgcttaaaggcagaatttatatgccttgtgttttatagcactaggtagggaaacattccccagtcagacacaatatccattcccagaatacattcaggtaaaagagacacaatcatttcacataaagcctgtgtaagccctccaatttttgcccaaactttgatcttgatcctatcattttttgcagagcagagaccctgtttcaggggcctctgcaacccctctcccacaaatatggaaataaaggaaaatctggagttcctttaaaggaaattccatgcatctagctagccctgaggaatgaagttaaggaacttcatcagattccttaaatgaataaggaacttgataagcaagaaagtaataggaacctaaaacaataaccatggaagttaagagtcaggagattttttgttcccctatagacactaaatataatgtcttaacatatgtccctgagttgtctttcagaaacccagatcccaccaaacagttccacagacaggtagacctcagataagagggaactggggactaaactctgacaaccattctttgttctaaatatcttcctgaggggcctggatggagtcacactcaggagccaaagctcattcttttctgctgactgcaaattctcttccttcaccaactgcaaatcagaaaatctttgaatctacctatgacctgtaagccccccacttcaagagatatctctcctttgggccaataccaatgtgtaacctccatgtattgacttatgattttgtctgtaacttctgctttcctgaaatttacattttcctttaaaaacctttacctgtaagccatcatggaggtcagaatttaagagtagctgcctggtcttccttgcttggagccctgcaaataaatgccctcctttttcctgctgcaaacctcagtgtggctatctggtcttattgtgccaggagagcatatctcagttaggtttgattagtaagtggcacaagtgaaccctctggagtgatggaaatgttatagattttaatgtgggtcatggttacatggatatacacacgtaaaattaagcagtaaacttgattttataagtaaatttataaacttagcatttttaagttagcattcaataaaaacattaagggcagtcattcgaaaaagtagaaatagaaggcataacttcttccatagtggaggaaaaagaaacaaagacaaatcacttactacaagaaaaggcaagaaagatggaaaaaaggaagaaggaaaggtttggctgatagcaaagatttaggaagaaattgcaaaagtaccgaaagttataagcatcacacaaaatggactaaggtaaaaaggtttttacgaataaggaggatcattacataaaaaaggtattcaccagaaatacgtagcaattctcaatttttatatatctcacaatataaccttaaattacatgaagcaaaaaccagacataaagacaaagagaaatttacaaatccacaattatggtaaattttaagacagttctagtgtttggcaattctatcaaataaaaaacaagttagaaaagggaagatttaaatatcagaaaataagaaagaactttgtccaacatttagagaatacactttctgctcagtatatatggaacattaattacaccatattaggtcacaaagcaagtctcaacgaaaaacaatggatatcgtacagagcatattaaaaaataaccaacaggcacatatgtttgaaaatttacaaacatacttctttaatacatggtccaaaaaggaaataacaaagatgagaaaatcttaggaactgaacaacaatgaaaacaacatatattacagctcaaggcatgatattaaccagtgcatagagaataagttttaaccttaaatataacaattagaagaaacattttttaaactcttaatgtgctaagtgtcttatttaaaaaattagaacaaaataatataaacaataaatccaataaatgtagaaagaataaagacaatagcaccaaataaaatcaaaacagaggatagacgaggctaaaagctgattagtttaaaaagatcagtaaggtaaaatttaaacttgttaactgttattactctatttttcaataattgaaaaatgatttttaacttaataattttagtaatttaaaaaattcatactatttttttctgtttgaaaatggtttgggtagcttaggtttgggatcattacaattgttctcattaaaactaatagaaaaaaatttttttccacctaacggcttttccctgagctttcaggaggccattgaagccgttaagaccgggtcaggtgaacaggaagttaaagactgaaaaggagacacaaaactgccgactttcccgacggcgaattggccctctggaaacagccgaccaatcacaggcagcaggggcgcgccctgcagcggggctccggctgcggttccgtggactcggcgactaggcgccgcctgaccagtaggagccgccctcgacgagcgagctcgaaggctgcgactggcgccgcctcaccgcctcccaccgccactgaccgaccgttcgaccggcaaacatggttgaagcggatcgcccggggaagctgttcattgggggcctcaacctcgaaaccgacgagaaagccctcgaagccgagtttggcaagtatggccgcatcgtcgaggtgctcctgatgaaagaccgagaaaccaacaagtcgaggggcttcgcgttcgtcacctttgaaagccccgcagacgccaaggccgccgccagagacatgaacggcaagtccctggatggtaaggccatcaaggtggcccaggccaccaaaccggcgttcgagagcagccggcggggcccgccgcctccccgcagccgcggtcgcccgaggttcctgcgcggaacccgcgggggtggcggcggcccgcggcgttccccatcccggggcgggcccgatgatgacggcggctacacggcggatttcgacctgcggccctccagggccccgatgcccatgaagcgtgggccgccgccgcgcagggtcggcccaccccccaagagggccgcgccgtcgggcccggctcgcagcagcggcggtggaatgcgcgggagggccctggccgtgcgggggcgagacggctactcaggcccaccgcgccgggagccgctgcccccgcgccgcgacccctacctgggcccgcgggatgagggctactcgtccagagacggctactcgagccgagactaccgcgaaccccggggttttgccccctcgcccggagagtacacccaccgcgattacggccactccagtgtccgggacgactgtcccttgagaggctacagcgaccgagacggctacggaggtcgcgaccgtgactacggggatcatctgagcagaggctcccatcgagagccctttgagagctacggagagctgcgcggcgccgccccaggacgggggacaccgccatcttacggaggaggaggccgctacgaggagtaccggggctactcacccgatgcctacagcggcggccgcgacagttacagcagcagttatggccggagcgaccgctactcgaggggccgacaccgggtgggcagaccagatcgtgggctctctctgtccatggaaaggggctgccctccccagcgtgattcttacagccggtcaggctgcagggtgcccaggggcggaggccgtctaggaggccgcttggagagaggaggaggccggagcagatactaagcaggaacagacttgggaccaaaaatcccttttcaacgaaactaacaaaaagaagaacctgttgtatggtaactacccaaggactagtacaaggaagagttgtttttaccttttaagaatttcctgttaagatcgtctccatttttatgcttttgggagaaaaaacttaaaattcgtttagtttagttttggaattgttaacgtttctttcaacaagctcctgttaaaagtatatgaacctgagtactagtcttcttacatttacaagtagaaattcgattaatggcttcttcccttgtaaattttcttgataaatgaggcaaacagttctaagatctttgataaacatctgctcacctaaaatggaaaaacggatcattctgctcatttaaaccaactagattttgggtggagagtgggagggattggtgtatgctactcttaagatttcagggtatctttcaaactgaatctttgtttccagtattaaaaagcaaacaaccagcaacaacaacaacaaaagtgatttagatcaaatgtttatgtaaagaaaattattttcactcagtaaatctgaaaagtaaatggataatgttggccatgttttgcctttttgctttttctttgggaatctacaggatcacctgtcccctcactcccaaaagtactatctatgttttgaacaacagtggaatactatatcaaaggtttggccaaccaaccacaaagctacaaaacaagcaaatcccaaatccttcaattgatagcattcattttcactaccaacaaatttattaagaaacaagtagaaaataaatcagtggtcgacttggggaccgtaatggcttccattcctaactccaagctacttgcctttggctctagagccagccactgagtcctgtggagagaattgagcttcttcccttaggggtggaggaatcaaaagtgagcagcttcagagctcaggagcaaaggtcagagaatccctgaaagagcttggcgtttcaacctctgaggatctcaaactggcatgaaggggctggttttcctgtccacaaaaggcgaggggttggatgggttgtttcctagttttaaggtggggagaagggcttcaacagaaaaagattagagtctttctccaagatctgtcaagaggaacgtaagtttcctcttaaacatcttttccattcagcacctgtggattccccaatttatctgtgagaaaggtaattgtacagtcaagggactgtagcaaccagagaaagaaggatggggttaaggttgatgacccatgttcagtgtaataattgctggaggaaacagataagggaacaacagcaaaaagtacttaaagggatctgaatgcaacacacatacacaacttttaacaacatgattttttttgacaataataaagtaggtgcattaaaggagaggacacactagtggctcagaagagcaaatgcaagaaatagctaaaaaatgatccaggaattaatctaacaaaaatatgtaagatctttatgaaaaaattaatctttattaaaggacataaaagaagaactataagagattgatatactcatggttgggaggacttcattatcaactattctcaacctcatcaaattaatttggaaaaacaatacaacttcaaatgaagtcacttcatgatttttttcacacagctcccctcccctcttcccgaataacaccatttatttgtgttgatcaatgatggaataataaaagatttggtaaaccaaccacaaaaaatcaatagcttcatttcaccaccaacaaattattaagaaacaagtatttagaaaagagacactaatgggagatatagctaatcttcaaatttgcatggtggaataaagagcaagaaaagccaaatcaattcagatgaacagttgttaggaaggactcatcctacagataccaagacttattacaaagctctagcaatttaattgtatgatgtcagcaaacaaggatagacagaccaatagaccaaaactgtgatcctagaaacaagtccacttctgtcacattatgcaacagaggtaattttaaaagtcattggtggcaaaatgaaattctaaaaaaaaaagactatttgttaaaagtgagattccataacagcatacacaaaaatacattccagatggtttgaagatttaaatgtgaagaggaaatttttaaacacttagaagaaagtgaagaaatgtatacaccacggtggggttgagaattccgttttaagacaaaaagtacaaacttggaaaatattgataaaattttccatattattattaaggtattttaatgataaaagtgactattaacaaagtgaaatttcaagccataatattggaagaatatatttacattgaaatgacttccaaaagaatgcttaaaaatcaataataagaaaaaaacaagaaaaaaatggacaaagacttacatttttgatagatgtataaattgatacaatcattttggagataattttagcaatgcctagtaaagttggaggatgcatactttacgacccagaaattccatttcaaggaatggacttaaagaaatttgtgcatattcacaaggagatacgcacaagattggtcagtaaagcaccctttgaatgtttacaacaaaagtagtctacctggagtggatcaactgagatttatgatgaagctcagtgtagaagctaatatgaatcagccaggtctacatgtatcattatgataaatatgaaaatattaatatttggtgaaaaaggcgaatcgcataaatataggtatagtaaacaaaataggatttgaatgatagcatgaaaaatcaggatatttagagttaagaggaaaggaaaaagatgggaggaggagtgaactttagctgaatgttttatgtctttaaaagtgatggctcttaagcaaaactgacaagtttaacatcttaaatttctgtggtctgtacattggcatctcttattccgtaagttcaaaatattttataatacacattttaatattaaaaaatagagcttagcataccacccagcatgtaattactgaaaaatgtttgttattaatatgctgaaactcagctgcaacattcttatcttggcaatgattctttctcctggctttgttctttcatcaatatgggtgatgccttattctatttaaatgagtttttaaaacctttctatctcggactgtgcccacagcttgtttaccataatctcaagggtagaaccggcaatacctgagaaccagatcttagaggaaggtgcagtttttccttttgttgtctgttttgaagtgtaatagcgatgaaaaacgttttccaatcaacaagctgtttctgaagagtaatctcctgaatattgaaactattaataaaaacaaagtattaacattaggaaaataaagactcactggagttcagtgagttaattttagagattatagcatacaaaggttgtagatctctcatacatatataatacaacagtctcaatatttctttactggaaatatttttgtaggaaaatatgccagaggtctagtcaattgagaactctttataatcactttcataatgatgagagagagagagagcttatcacatgttttccagaactcacccactgagtaaaatttaaggaatttgtatctcagtgaaaacctttatattttctatcatgtgcttttctccgattactcctgaaaccccatctcctccatatttccttccaaaatggtttcaggagtattcaaattgtccatgtggcaactgacagcattaccgaatccccacaagatgaaggctgaacatcttctgtttctgatcacaaccggaattctactgtggctcctgtgactatcttaaagagtgctagaggtagaattttttttttcccccatagggcaatagttcccttttccccttgccttaggccaagtgagatagagaaggcttctctgctagtgttcctcctaactggggcctctaacatttttcaacctttatgtggtttccatgccccctcccttttagcctttattttaaaagtgatgtaactttccttcttttcctccatataaatgttctctctggggatagttactgtgttctcataaatgttttcctctttagaatgtgtttaagaactcaccaagcaaaataaggctgtattgctcttgctgtgcacacatgatatccaatgctcatggcaatttctttcagaacctacatgttctatttgtggtgaagtttattctgaagctaattactcttacagtgtagcacatctaagaatgattttaaaatgattttgataaatattttgtgagtgacattgaatgaacatatcaagcacagaaaattagaggaacgacatagcaatgatgtccttgttgaatgcatctcactatcatatttattaaagtgctcaaggggaataaaaaatatgaggacctattatgaaaattttagagaaaacagtaggaagaaatagtaaagctttctcaggtttgaaggctgcttgttatagtagagagagaatcttttgatcatatgcagaagctctcattctgttattcatgtagcttggacaactttcttaaaactttagaccttccgtttttttcatgtgtggtgataatacagtttcatcatatttatggaagttttaaataagatgactcatatacagcacccagcacagtgcctggaatgcagtggggttcgttaagtggtagtattacggcattctgcaaagcagtagcacagactttcctttggaatttatcatttatattcctagtaaaattgcttctatactcaaaagtcttcagaaaaagtacacttgagagttttaattgtatttactcaagctgcactcatccagcttgaaatcttggagatatatttgactctttatagtccccattaattttctgctgcctctttcttcttcacctcttcagttgaggggaccagaacttccaccatgggctcagtgccccattcctaaccagtcagaagtaaagcaggttgatgttattataaaggcttgattccttcttatctgttagggtttagaattattgctctctggcataattggcttagactcaattttgccccagaaataaagtgcctagtgcagtgcctagatttttaaaaaatgtagctgtttttattgttatttacagttgactcaggctttggggcacctagagaaatctctgagttgaagagtgtagtaatttagaataagtaatatgtaatcttgtagacctgaatttaaatcctgtgtccaccattcaccaactgtgatcttggtcgggttacttaattactctttgtgtttttttccccttacctataaaatagggtcaagaatgctcccctcatgagattggttgtctatctatccatttattcattgaatctaatttttatttatgtagtacccaccaaatggcaaacgctgtgctaatatcacgccaactaaggcaaacagaaaagcagcaccaagatcacagttagtgaatgatcttggtcaggttgctctttgtttttttcccttatctataaaatagggacaagaatgcaatcatacttattggccagattaatattcattaaggacgattcacagagacagtggagtagtacttgctagttgcccagatgcattctgtgggaatacacagagatttagcatgactggacttcagctttgggagaggaactcccacatttgggctgtggggcttttgagttgcataatataggagattccagcccctaccctggaataattaggggttaggatataatagcaatatgtcatggcagaaatagctataaccctgtcacttcagtgctcgtggttgtggatttgcaggagttgaggacttgataataacatcagtctgccctagacaggttgacaatgggtcactgaaccttgcagtcaacagctggagaagggagagacagtagaatataaatggggctgagaagaacatgttttttgtgaataatacttttatctaaggtggtaaagggctggagtcaaagtcttgtaattgaagctgtatggcagcaaagcaaactagaggcaggacttgctacatcagcattcaagattgagaatgtactaacattatagctgcaggggtaactgtggcccaggctgtgcagctgaccatgattgactgcattaaaaatgggctaaaagcagctttcagtgaaatttgcagaaggccaatcctttccaggatgccaatctactgaggattagttttggataaattaatccttgtctcttagctaagcaatggagacatattggtgagccaaagtagacattgttaatcctcacatggaacagtgttcaaaaggtaagatagactggttaaattgtcatacaaaaagcaacattttaaccatgacaagcactatgaaagagagatacatagcactatgagacatgtttttaaaagcttgatgtagtataacagggatccccaactcctgggccaggaactgggctgcacagcaggagctgagtggtggacgagctggcaaagcttcatctgtatttacagccgctcccatcacttgcattaccacctgagttccacctcctttgagatcagcagcagcattagattcttacaggagcatgagccctattgtgaactgcacatgtgagggacctaggttgcatgctccttatgagagtctaatagttgatgatctgtcactgtctcccatcacctccagttgggaccatctagttgcaggaaaacaagcccagggcctccactgattctacttatggtgagttgtataattaattcattatgtattacaatgtaataatagtagaaataaagtgcacaataaatgtaatgtgcttgaatcatcataaaactatctcccccgactccctggtccctggaaaagttgtcttccacaaaattggtccctggtgccaaaaagcttggggaccactatatataggacacctagagaatgcatccttaagtgataattgaactaagatgtgaaggatgtataagagctaaatttctgtgaaaattaaatgagataatatataaaaaagcatgtagcacatagtaaccctcagtgaatgaagactgattttcttatacctattctcttttgacatcaaggtagttttcgctgggagtttgtgctatataaataaaggtgaaggaatgcaggtgaattactaacagacactaatttaagagagcatatcttgaggttgattaccaggagaggggaaatgagaaacacagaatgtgaatcaacaaataggagaggcaaataatgtgagatcagttcaaggtcaaactagtaagaaaaaaacagatgaaatgaagaagttgggaaaaagacaagtattggctggattaatgccctgggagtaactactgataccccctttaaagtctcagagccaagttcacagataaagtagcttttaaaggtatcagggttgtttgaatctgagatgaatcagaccctctttatccttcaggcactcatagtttagtgtgggtaacatttttctgcataaactacctaaaatgcaaaacagagcaagaaatgttatcaaataggcatgggcaatgtgctaagcaaaccaattaattctgatgaggaggctttccagaggtggtaaaatttcaagatattccatgaaacagggaaactcctctttcatttgtgtatgttatccactttaaatacagctaggttcatttgtttctatttgtaattaattttaggagtgtcttcatcttgttgattttatatcccatctctgctaatttacatggaaactattgaaacttctgaagatgggagtgattatctgagctgcagtttggcacctgagagatggaccgaagagaaaggttggagggagagagccatctaaacatactaaggcttgcatttttatttgtatttaaaattgccctagttgattaagaagctgagtggaggaaagcatgcttcctgacacggaacagaagttaccatatgataacagtccactagatgtcactaaaagctcaaggattggtgctttatgtttcctttcttgaacctgccccttggaacttgaactctagggtctgtggatttaggctaggtgctgcttatgcttttaactggaaatccccatataatcaggtactgcaagttatgtacagttgaaaagaccagaagtatatccaagtatatataagcattcaaattggtgggaaaagtaattcaataactgatgctgatttaattggctaaccactttggaaaaaagtcctaatgattttgatcattatacaccaaaatgagttctaggtggattaactttttttaggtaggattttaacttttttttttaagtgtggtaaaatacatatgacaaaatttaccatcttagccatttttaagtgtacaagtttagtggcattaagtacattcacatggttatgctgccatcaccaccatccatccatagaactcttttcaacttgcaaaattgtggattaattttttttttttaattgagatggagtttcgctctgtcacccaggctggagtgcagtggtgtgatctcggctcactgcaacctccgcctcccgggttcaaccaattctcctgcctcagtctcctgagtagctgggattataggcatgtgccaccacacctggctaatttttgtatttttagcagggacggggtttatcatgttggtcaggctggtgatccgcctgcctcggcctcccaaagtgctggagattacaggagtgagccactgtgctcagccagattaactttttaaatgtaaaaatagaaacaacaaaaagtttagaagaagatctatttgtgtttttatataattgagttttggaaaatttttctaagcccaacagtaaaggaggtatcaaaagttatatattgataaattttattacctaaagattaaaattttgtttacatctaaatgcctcaaagtttattcatttattatatatatgaataatttatcatatattcattatgatgtggttataggacttgctggttttcagctatggagctgctgtcagttcctagggacctcccacaattccttgccatgtgctcctctcacatgtccttttacaatatggcagtttatttcttttatgccatagcataaaagctcagatctctcttttatgatatcaatctaagtagctcagttctcaccctaaagttttaggaaaaattaataaataaggagtattcactctctaataagcatgcatattatagaaaaatatgtaatgagaagcagaaatacattaaaaattagtgtatagattacttaacaaagataaagcccacacaacatctagtttcatccaatatgttaatacctttttataactccctctttgtacttcctccatggaaaagatacatgggtaggacatgaggacatcctggatatttggtatggcgttctttgctgggtactgactatttttaattattttgaccattagcttccttacagttagcatattatcacttaacttgacagttgttttgaattaagaaatctcacaatcaatcttgaattggaactgatatgtgtgcttttaaaaacaaaatctatagtgttgtttggtatcaaatccagagttaagctcagctttgtcagaatgttggggcatacttccttcacaatggctgctttctagtggcagttgtcagggtataacttgaggttaaaccattctcagtgttccattccctggtttaatcatgcccttacctgaatccttcaactacctcacaggcagcaattcattgactcctatctggtatgagattgtaaactgaaagatgtcctgatttccccgttacaagatgatattgtcttctgttttatccatcagctatctttatcagtaacaccagaaaattatatataatatgattttatctctagtctcaaatttgtgctgatgaacttaatcatcataatgttcttattttcatttgtgttttgtcttattatgtggccacaaatacatagacagtgtatgtggttttagccttccattgtatctggaaatttaattgttataagccttttcttgtagaccttattctgtatttgtatgagattctaaaccttctacagtggctacaattttgttggtccctatcaaaatcagagatctgggaaaacaaaccataatgtttatattttccattaggggaaacgttcttgggaaagtaatcactctgggtatttagacagcctggaaatgcagttccacttttcagatgcttactggtttccacgaaaatgttcattccatgaaaatgttccgttgaggcggaatgaaggggctcgtgacagggaaccactgtgtgcttggcgttgtcctcagccttctgttcactcatttagtatagaccagtatatactactggctgagcatggttctgaagggtagaaatgcaaatatgagacactaattatgatctctatctttgaggatttatttctcagccttgtgaggaagaaaaacactaactagaaattgcaatccaactcacatatgagtacaaatgaaaacacttcatcctggaagcagaaaatacgcttctgctttggaatagaagcaaaattgaagactagaagtgaacctgaaaagaaggcagaagtgaagtaggatctgcataaactgttacatgttttctcttttatgtccagttaaatatttttgacagtagaactgcaaaaatacttaacattgaattgaagaatttctttgtagaagtgttgaagaaacaccatttctctgatttaaggaagtcataaatatatttgaatgtttgatattctaaaattgtttagtaatattagttttcactaaatggattttatgacctcagtcataacactgctttatttacttttattatttccagtggagtaaacactccacatataactaatatatttggaataactcctctgtccttcatttgttttaggaaggattagaacaaagctagatttaggatcctcgcgggaggggtgtgctttactgaaacactcatttgattttataaatgtttctagatatccaggagagatggaattaaccagtcctcagctccttaaggatgtaagtgctggctaaccagaacaataactatcaaattaaaaatagcggtgaagcggtactcaatctagggctaatccagtactatggcaacaagcactattcttggccctagtgagggacaggtactgctcctcctaatcattttgggttgctctttccccagtctcagatagcttcctcacacatttgcatgaatcaatacttggctaaatattctaggtggactctctggagatgtctggagttttttcttagtgcagcctcttttctctgttactctggcctgcaaatggtagcaccttttttcccttctgaactgttgtctttctatcttcaactaaggttatcagccaagctctgcctgagttcttcctccctgatttccataaaaatggatattttaatggaaaaatataattcatagaaattgactcaaggataagtaggatatataaatagggtaataaccatgtaagcaattttaaatctgtgaaagaattctctgaaagcatgcttactttggttagattgcaaataagtaaaataaaataatttccctgttatataaatcactgaagtatattttaaaagatagacaatatttaagttcattttacaagccagtgtaaacttgctatcaaaatctggcagatatgaaaacatgaaaattataaacactttttacccatgaatataggtaagaaaatattctaaataatagtaagagttggatcacacaaagtattgaagaatatcatgaacaaataggaatgtggttttgtaaaacttattaataatttatatcggtagaccaaaaaaaagtcacatgagcatctccatagacgcccatgaaatattaataaaaattcaatatccgcttttgatacaaactcttggtaaaccaaatgtagaacatggcaaaatgtatcaatctcaaggtatcagctgacagaaattttaatagtaagaaggaatctgaagtaagaaatgagaaatttatgattgatctagaatgtcagaaaatgaaaaaaagcaagttacaaagggaagtaaaggaataaataatattaaaatataattatttgctgacaacatgattatttacatttaactttttaaaatgaggaaggacctatgctttcaatgtcaagaatgaaagtatttttgccccccaccccaatttttaaaaagaaaactataatgtatcagtttcctagtttcttcccatctccctttggcagttttgaatgaaatcattgggattttaaacttttacaatttatgttatagatgctctgccaaaaatagtgacaaattacattcaattccatttggatattttaaaattacatagattaaattttgttttcaatacttactaccaatttttttttaataccatcttcccttttattaagttaaaatgttaacaattgattttgtggttggctgaaatagaaccagtaataacttttaagaatggaaatgtggttggtagattttctgagttcttatatggttggtaatatctttcagcagattttctaatgaatgtgtgcttgatcaaatagaaaacgttcctactgtatgtctgtcgtttttaagattctttagccaatgctaaactggcattttttgttatggtgcagaaatctgaggccagcaggacactatttttcctttcaccttttctttctagtgagaatttatttttttaatccttaacattcacaacttttatgaagctatgccctcttaaaaaattatatttgcttttagttgaagttagacatttcatcccccaaattcaagcagtcttttagtttcaggcatgtttgtcttttatttcattgattttgcttttcttctgttggtttctcttttggggatggtctttacatgcatattccatgttcttgatttgtcctccatgttgctaacattttctctcctcagttaagtctatattgggtgatactgagttatttctcttgaggtttagtttttcattaaaatgtatctatatctagttcattatctcaattttttctcctgacaaatcttctgtttgctgactccattaaaataattcagcaactatgcttttcaagtcttgaaaaaatatttcctgatctcatattgtgcttttttcataattttctattttagtttcataaatcgtaatgtccccccccaatctttttgaatgtgtgaattatagatttttcgatgattttttctttctaggaaacaagtcagtttacttggggtggcagagggtgaaacattgctgggatttgtcagcttgatccctctttttcagtgctgagcatttttacagtccaattatcttttttatttttcattatgtctacggaggagtgtctctgttatatcagtaggaaatcaaggtggctttttcagagactgtgttggttcctttcaaatatttgaaacactgacagaaggagacattttagatttcctcaaagtttacattgccattttagaaatctagaagcctataaggaaaattaaaactgtagaactaagagcagccaacacagagagcattctcttggtgttctaaagctaggattccacaattattatgacaattcaagttagagaggtgtgtgtcctcatctttcctccttttcttgctccttctccactgtcgtcttcatcctagtagtagtatttattttgtcatagttttctatttaatgtttattgaaaaatgtatcatacctgcataaaagagcataaaattatttatacactttacagtaaagctgtaaagtgaacacatgtgtaatcactaactagatcaagatagcacacaaggagtccttcattgcctctccccaaatgtaactcctctccctcctggaagtaaccactttcctgacttttgtaaaatcatgttcttgtttttctttatattttaataacctagttatattcttaagtaatatgatatagttttgctgaattttataattttatgtgaaaggaattatatatgcttttttgccttttctttacattagtactttatttgggatatttatttttttgaatgaggttataatttgttaatttttgttgctatctggtattccattgcatgactataacacaatttattcttccattttatggttgtacatgtcagcatcacttctagtttgggacagttataaacaatgccactctcaacatccttgtatttctgtacctagagtgattgctaagcaatgccaaactgctttccaaatgtgataatttcaatatatcattcacctagctgtaaatatctattgtttcaccccctttccaaccctcgatatcatcacatattcacttaccaatccatttagtggatgttcagctcagtgtcaaagcaatccccaggctgtgtgagtaggtgaggcagtttatgtctgtcttgctcttaccctgagagcacagctctttggattcccagctctatgagaggaaggtctccttttagaatcctcatcaatgtgtaccgtggatttggtcttctgtcttccgagccacaacaagccttggaaactactgttaaagttcagaggacttggcaaatgctgtcctatcaaaagttccttcgcttacatattgacctgataactccttactattttggcatatctttgatgcatttaacatttttttgttatgtcttttgttcagtttttcgagtttttatgaaatgtctccagagcagattgggtgggtccaaatattaagtccacactttttggacaatgtaatttcccgtaagttaattgattgattgattgattgattggtgtataagcatccccctttctctgcaatctcaccagcatctgttattttttgacttttaaaaaaatttagttcaatagtttttgggggagcaggtggtttctggttacatagatgagttctttagtgatttttgagattttggtgtacctgtcacacaagcagggtacactgtacccaatgtgtagtcttttgtcactcacccccatccacccttccccctgaggccccaaagttccttatattattcttatgcttttgtgtcctcatagcttagtcccactgataagtaagaacgtaccacattttgttttccatttttgagttatttaggttggtacaaagataattgcggtttttgcctcaatttcaatggcaaaaccacaattgcttttcaccaacctaatacttcacttagaataatggtctccaactccatctaggttactgcaaaagcagttatacacacacacacacacacacacacacacacacacacacacagatataccacattttcttcatttatttgatagatggacatttaggctggttccatatttttgcaattgcaaattttgctgctataaacatgcatgtgcatgtttatataatgtgtctttttcatataatgacttcttttcctctgggtagatacccagtagcgggattgctggattgaatggtagttctacttttagttctttaaggaatctccatactgttttccgcagtggttggttatactactttacattcccaccagcagtgtaaaagtgttccgttttcaccacatccatgccaacatctatttttttttttaattatggccatttttgcaggtgtaatgttgtatctcactgtggttttaatttgcatttctctgcaaattcgtgatgttgagcattttttcatatgtttgttggccatttgtatatctccttttgagaattgtctattcatattctttgaccactttttgagattgttgtttttcttgctgatttgtttgagttccttgtagattctggatattaatcctttgtcagatgcatagtttgtgaagattttctcccactctgtgggttgtctgttcactctactgattatctatttttctgtgcagaagctttttagtttaattaggtcccatgtatttatttttgttttgttacatttacttttgggttcttggccatatctctttgcctaagccaatgtacagagagtttttcccatgctatcttctagaatttttatggtttcaggtcttagatttaggtctttgatccatcttgagttgatttttatgtaagctgagagatgaggatccagtttcattcttctacatgtggcttgccaattatcccaatatcatttgttgaattaggtatcctttcctcacttaatgttttttgtttgctttgttgaaggtcagttagctataagtgtttgactttatttccggattctctattctgttccattggtctacatgcctatttttttaaatttttttttattatactttaagttctagggtacatgtgcacaacgtgcaggtttgttacatatgtatatatgtgccattttggtgtgctgcacccattaacttgtcatttacattaggtatatctcctaatgctatccctcccccttccccccacctcacgacaggccctggtgtgtgatgttccttatcctgtgtccaagtgttttcattgttcacttttacactgttggtgggactgtaaactagttcaaccattgtggaagacagtgtggtgattccttaaggatctagaactagaaataccatttgacccagccatcccattactgggtatatacccaaaggattataaatcatgctataaagacacatgcacacgtatgtttattgtggcactattcacaatagcaaagacttggagccaacccaaatgtccatcaatgatacatgcctgtttttataccagtaccatgctgtttggttaactatagccttgtagtttcaagtcgagtaatgtgatgcctccagatttgttctttttgcttagtcttgattgactaagtgggctctttttaggttccatatgaattttaggatttttttttctagttctgtgaagaatgatgatggtatttggatgggagttgcattgaattggtagcttgcttttggcgatatgatcattttcacaatattgattctacccatctatgagcatgggatgtacgtgttaccatttgtatagtcagtgatttctttaatcagtgttttgtagtttttcttatagagatctgtcacctcgtttgttaggtatattcctaagtattttattttatttttttgcagccgttgtaaaagggattgagttcttgatttgattctcagcttggtcgttgttggtggatagcagtgctatcaatttgtgtacattgattttgtattttgaaactttactgaattcatttatcaggtctaggagctttttgcatgagtctttaggattttctaggtatattattatatcatcagcagacagcgacagtttgacttcctctttaccaatttggatgccctttctttctttctcttgtctgattgttctagctaggacttccagtattatgttgaatagaagtggtgaaagtgggcatccttgtcttgttccagttctcagaaggaatgctttcaacttttcctcattcagtgtaatcttggctgtgggtttgtcatggatggctttgattacattaaggtatgtctcttctatgttgattttgctgagggttttagtcataaagggatgctggattttgtcaaatgcttttcctgtgtctattaaggtgatcatgtcatttttgtttttaattctgtttatgttgtgcatgacattcattgacttgaggatgttaaaccatccctgcatccctggtgtaaaacccacttgatcatggtggattctctttttgacatgctgttggatttggttagctagtattttgttgagaatttttgcatatatgttcattggggatattggtctgcagttttctttttttgttatgtcctttcctgattttggtattagggtggtactggcttcataaaatgattcagtgaggattccccatttctgtatcttttggagtagtttcagtaagattggtaccaattcttctttcaatgtctgatagaattcagctgtgaatccatttggcccttgactttttttgttggcatttttttttattactgtttaaatctcactacttgttattggtctgtttagagtttctgtttcttcctggtttaatgtagaagggatgtatatttccaggaatttatccatctcctctagattttctagtttaatgatcttttgtatttctgtggtattggttgtaatagcttccattttgtttctaattgagcttatttgtatcttctcttctttttttggttaatctcactaatagtctaaatagtctatcaattttatcttttcaaagaaccaacatttcatttcatctatctctctctctctctctctctctatctatagctgttgttgtttcagtttcatttagttcttgtttcatctttgttatttcttttcttctgcttggtttgggtttggtttgttcttgtttctctagttccttgaatgtgaccttagattgtttatttgtgctcttcagactttttgatgtagccatttagtgctatgaactttagcctcctgaaacactgcttttaccatataccagaggttttgataagttgtgtcactattgttgttcagttcaaagaaatttttaatttccatcttgatttcagtgtcgacccaatgatcattcaagggcagattatttaatttttatgtatttgtatagttttgatggtttcttttggagttactttccattttttttttttttttgagatggagtctcactctgtcacccaggctggagtgcagtggcgctatcttggctcactgcaagctccgcctcccaggttcatgccattctcctgcctcagcctcccgagtagctgggactacaggtgcctgccaccacgcctggctaatttttttttgtatttttagtagagacggggtttcaccgtgttagccagaatggtctcgatctcctgacctcgtggtctgcctgcctcggcctcccaaagtgctggaattacaggcgtgagccaccacacctggcctactttccacttttattccagtgtggtctgagaggatacttgatgtaattttgattttcttaaatttattgagacctgttttatggcgtattatattgtctgtcttggagaatgttccatgtgctgatgaatagaatgtatattctgcagttgttaggtagaatgttctgtaaatatctgttaagtccttttgttagtttaagtgcattgtttctgtgttgactttctgtcttgatgatctgtctagtgctgtcagtggagtatcaaagccccccactattattatgttgctgtcaatcccattttttaggtctaatagtaattgttttataaatttgggagttccagtgttaggcgcatatatatttaggattgtggtatttttgtgttggactaattctgttagttttactggatacacagttcttggctgacaattattttgtttcaggaagctaaagataggaccccagtccctctggcttgtaaggtttctgctgagaaatatactgttaatctgataggtttacctgatgcttttgcctcacagctcttaagattctttcctttgtcttgactttacttgatgactttgtgcctaggtgatgatctttttgtgataattttctcagatattctttgagcttcttgtatttggatgtctagatctctagcaaggccagggaagtttatctcagttattccctcaaataagttttctaacttttagatttctcttcttcctcaggagcaccacttattcttagatttggccatttaacataatctcaaatttcctggagggtttgttcatttttaaaattcttttttcttggtctttgtctgattgggttaatttgaaagccttgtcttccagctctgaacttctttcttctacttgttctagtctattgtggaaactttccagtgcattttgtatttgtatttctctaagtgtgtattttattactagaagttgtgattgtgatctgtcttcaggtcctgtgatctgtcttcaggtctctcagctgtggataccagcacctgctcttgtggaggtggcaggggagtgaagcagactctgtgagagtccttggttgtagatatgtttagtatgctggctttctcaaatgctgaatatactagcagtgaaattgtcacatggacagactcaggacctctgattagccaggatgttgcaggcagtggaattagctgttgttttctccttcctggaagcaaggttattctctccagtagtatttcagtgggcctcttttcctgaaaatgttgtagccctcccttcagcatcagataaagacgcagcgaagatgactatggagccaggtttgattaattaggagttatcttggcattgagttccacttattcccagacaggctttcctgcttcttgaatggtattacagtttggtgttcctttttactaccttgtatttattatattttttgatatatgctcaatgtaactgacatgtaaaatacaaccttccatagtctgctcactgattgatttcctgccctattcattataaccctttggtcctttcaatggcaatttggaaaggattgaatgtaggtgttaaactattatgtttgtgatgccactctgagcaagaattttgtgtatcctgaaactgtctttcagtaaatgttcattttgttatgtttttattctgggatttactatgcccctcaggtatttagcaagtatttaggaaaaaaattttgttttaatttcagcttcttccctttgactaacttttccccatcagcatttacacatgctcaggtctcttaaatttaaaactctcatgaccctccacatcctctctagctatcacctacgaccctccctcttcacagccaaatttgtctccatttttttatgtctcaagtcttgtcaagttttccctgtattataaaattggaaaccagcttgtaaagtttcttaaaaattattttagcttttgattgggaatataccaaaattatagataaatgttgtaagaactggtatttctaaaatactgaattttcacatctaagaatacagtttgtttctccatttaatcaagtttcttttacgtccttaggtaaaattgagtccctttcttcatatagattttgcacatttcttgtaaggtttattccaaggtattgaataatttatcttctgcagttaatgcttttccctctcagtcttttctaattattattactggttggtaaaggaggctattgatctttgtagacatgtctcatataatacctacttactcaatacttataatttcgaatagttttcagttgattgtattgtatattctagggagacaatcatatcgtttgtaggccaggagcggtggcttacacctgtaatttcagcactttgggaggccaaggtgggcagatcacttgaggccaggagtttgagaccagtctggccaacatggcgaaacccagtttactaaaaatgcaaaaactggcggggtgtggtggtatgtgcctgtaatcctagctacttgggaggctgaggcaggagaattgctgaacctggtaggtggaggctgcagtgagcctagatcctggactgcactccagcctgggtgagagagtgagactgtgtctcaaaataaataaataaaaataaacccatttttattagtagcagtaataatgagaatccttattaactttactgcagttgtttagtgggattgcttttgatatttaacatgaggcatgttatttgctgtggggtttgttaagagaattttactttattcctagtttactaaaaatactggggcttttgtttgtttttaccaggaatattaacaatgttcagttgttgaacattaacaactgcttaagggacatctctcaatcaggttatatgttttccttcaaaccaatgatgtagaaatgtcttcagataaacctacagagtcacgatgtgttattttttaatgtagcactagattcagttttctaagattgatttatatttttttcatctgtggtcataactgagattagtctgtagtttgtgtttatgttttttcttttacttttctagtttagctattagggtaggttagcctggtataatgttactattttgctgtaagtctgtgcgttacttgaagataatatgattttcattataatacttcagataaccaatagaaaaactctagtatttgaattaatgagagaattaggcaagattgctagatattaacttgtaaaaataaatgtcattcctctaaatgggcaattactatttgtaggaaatagaaaatgagataatattacaataatggcaaaaagtgtaaattacatggaaactaacttaaagtttttctaagacctttaaatagaaaaatactaaaagctatatgaggatctaaagaaaacttcatatgccatgtttaaaggcagactgacttaagatttgtagaggttcaaatttcttcaagtaaacatataaataaaataaaatttgaacaaaaatctagcaagttttttgagaaaaaacatatatttctcaaaatatagagtctctatatatgaatgtcttctcagttttagattttgcagatatcttcttccaattgataattcatctgtgtcctctttctgtgataaccttgactaaaaagtaatccttaattttgatgaaagatatcagtgctttattgtctgatttaaaaagcatttttccttcaaagatacaaggatattaacctatattttcttctattagaaaatatatatgaaataatacgaaaagaacaaaaggaaagctcattctaccagactttaagaccgattacatagccaagtaaggtgagaatgacaaaagtacaatggaacagagtacaaagcccagaaatagattatagatttgtgtgtatttaacttcttatataatacaagtagcagtgagggaaataattgttcaatagattttgttggggaaactggcttgttctattgtgaaaaacagaattagatcactatcttatatcataagcaaaggtaaatttaagaccatgtaagttgaagaccaataggtaaatagttaaattatgaaattagttgacaagggattaatatctgtaatatatgtacaattctatataaatcaaagtaaatagaaagaaatgggcaaaggagagctatttacagaaaggaaacactgaatggataacaagtatatgacgagatgcttagtttcacttgtaaatagagaaatacaaatgaaaaccatgaaataccaactcgtactaacaaaaattagaaggttaaatgtggtaaacaagaaccttcatgctctgctggtgggaatataaactagtacggttattctggagagaaatctggcagcatatggggaaattaaaagggtgtataggctgggcgtggtggctcatgcctgaaatctcaacacttccagaggctgagacaggcggatcgcctgagcccaggagtttgagtccagcctgggtaacatggcgaaaccctgtctctactaaaaagaaaaggaatagccaggtgtagtgttgtgcacctgtaggctcagctaccagggaggctgaagtgggagaattgcttgagcctcagaggttgaggctgcagtgagctgtgatcacaccactgcactccaccctgagtgcgagagtaagacccccctctctctaaaaaaaaggtgtatattctataatccagcaaccctgatcttggaacttaactgaagagactctcccatgggtttaatgaagagaaatgtaaaagaatacatgtcactgcattttgggtgggggacattaaattgtaagcccattgtcataccttaaaactagtcattgcattttaatgcaatccctccattacctctactcctactttttgctctcaaacaagaagctaccaccttatgcttcatcttttaggcaccatctttattgcaaccaggaatccatttaaacctaccatttttcataaaaccttcctttcttcatgtcttcacttctttcctacccaggttacattttatggttcaacttaatcacttcattaactcctttgtctctctcttgctctgatattttcacctggcaaaaccccaaccctgttagatctaactctccacacttcacaactataccaagggagataaatatggttagggaaattttcaaaacactgctgtctggtatcactttaaatttatggtcatatatatcaagtagattcttagtgctgccagcaaacaatgtgttgccaaatctgttcatcctcctacttttcagaatcaatgaatgtgttatacacagagcaatatgggaagataattaaaacaatgttgattgaaaaataagagagtgaaatctacaataaaatatcctttaggtaaatttaaaatgcatattgcaaaacaacactaaagtatatataaaatgttcccatttttcatgaatacatacatgtttaagaccttatggaatgcatttaactgggtgcccatgaagggaaatggaatacaaaccatatgagataataggaaaagaacaaaaggaaagctcattctgccagactttaagactgattacatagccaagtaaggtgagaatgacaaaagaacaatggaacagagtacaaagggtggatgggaaattaagagaaaaaagaaatagactaaactataataagagaagtgccttgcacagactaatagtgacctgtggagtatgatcgatttcattccctgcacctggagtttagtttttatattgaataaaagaaaacagacaagcaaatgatctgtccagagagagcaagggcagctagtcgggtgtggcacttcagaataaagttgtcttcatcctactatgtaagaattctccagcataaagtttcatctcctgccttcttactctcaagtagatattttcagttctgatgtcaataagaagcagataggtcacacatatacacatgtgtaaaatgggcttcaagcagaatagctaccaactggtctgctgacatttgtcaatgtgggcctagtattgctagaacatttacagttatttttaaaaagaaatcagaaatataaattttatgtgagacttcccagttttagattatttgcaatctaatttataaagttcaaatcactacatgagtcctgattaggctcatgggccaataatttggtatatatgaacagatgtgaagcctgccagttgctaaattccacttatttacacagagctcgtcaatactactcccttattcttaaatatgaatgggcaactgtgagccattatatatttaaggaatgcctgtagcatgactaaggtatacatattgaaaaaagcaatctcttgggaaacagagataattctggaaacagaaaagaagtttaactatcacatatcatagtaatctgctttccaagtctaataactatttctgagttcctacactgacttttaggaggtcaaaaattagtctccttattgtccagctgggctttttggacattagatatttattctagactgtaactcacgttgtaaaatactactgtgttcatggattagttacttttgactttttttctccatactgtcttcagaataagataaatgtcactacatcaccagagttctcaggtggctggcagaatgatgacaaatttaattatcgcaagaaacaccgctgtattggtgctgtacattgttcttgagaaggtgtatcggtctctccagacccaaatccagatttgataacaggaaatcatcaactgcattatgttaccctattaactctaaataaaatatcatgatattttaaaataaaatcatgattttaaatcatgattttttaaaaaaacattatattttaaaataaaatatataaatattttatttatattaaaataaaactaaataaaaatattatgatatttttagttacataaaaagaaagtgtcaattccttcatctctttttttttttagagtaataagacagaagaagcccaagagcaaatattttattataatgggctatatgcttttaagggataaaaagagggaattacagacatccttcgtttgaacttcagtcttaccagggattttaagattgatgaattctgaccttttagtagaaaagtaaaataaaaatttgcttggaaatcttggccatttattaaagttttgtgcctttgataatttttttgttgactaaagtttacattctccattcagaactgtttgccacttgccatagagttttgttttttcatttgtttaactgaaatatactgagcaactgccaaagcgcaagacctgggatggggtggaggagggatacaaagatcagtcagatgtaggctgtgctgtaaaaatgctcatgctcaccatgctgaaaactgctggtaatttgcattaggtccaaaaagaatgttgtattatactttgcccaaaatagaataattgcaggatctggagtcagactgccaaagttcaaatcagctgtgcaacttaatagtggtgtgaccttggatcaatttcttacattttctgtttctctgttctcttatctgtacagttgcagtaaaaaaaatagtgcagacatagattgttgtgaagatttaatgcaatactacttgtacaagggaggcgaattgcctctggattctcacattatatagaaatttggggatttaattcttgtaattatctttgaaatagattttattatgtctggcgattaaaaaaaacaaaggtttttttaaagagtgaataacatttttaaaaattcatagacaataccagagccaaaactgaatccttattcaatttttacattgcaaacagggttatagaattttctgagagagtcacattttcagatattctgtgtcattataccacagtgtcccaattttgggtctgtaaaccataatctctataatcctcactgcctcttatgaatttggagtctgaaatgcctggcattttcaagccccaagccccaaaaagcaatcagagaaggagaaaggagcaactcctgtttcagggaaaattaagagattttggaagaccatgttcttcttgtttcttcccttcaacccacaagcctggtcttgcacagtgatgccacttggtatgatttaaggaaaatctccctgcatcagcctactttcctgagaggttcattgaacaaacacccagaaaggcataaaatggctattaggaactaacacactagtgtggcttcatttaatcagcttgctttcctaatgcaaagtaaagtccaacggaaagagcagtaggaattgtgtcgagttaaggcacaggataagaatgaagtgaggaagataacaacattattgaatgccagaataaaagctacagatgcatagtggatcagcagaaaggagtagagggcatagtaacgttgaaagaggcatcaatggggaaataaaagggcagagattgagagaccatatataagaatgtatgttataaacaggtggagatgtgagaaaaatcctttctactcgaagtgtggtcctcagatcagcagtgatgtatcagctggagcttgttagaaatgcaggatctcagactccacctataattaaaatgcatttaacaagatccccacttgatttcagtgcacattaaactttgaggagggtgcatcaaaggtacacacatggatgatgagaaaaccttgcagatgggtggtggagggagcagcttgatggatgagatgaagacatatatatatatatatatatatatacacaaaaatgtgccaggaggaaggtggtcatggagtagtttgtgggtagtttagctgattatgaattatatattagtttccactcatgctttcagagcctcaatggtatgagacaaagcatgagagtgttaaggaatggagtgggagattcctaaaagattctgatgttattaggaattggttttaattttaggcttttgtcactgaatgtacatttttcttcccttttgtttgtttggctatttttaattgagaaagctgtattgtggggagctattcaaaagtgacttaaagcaagaagtcactcccataagcttggcttctgaacattcttgcttcttcctctcattcttcaatcattttctcataggctgttttgcaagtcttcaagtcttctaggcatcccttggatgtttttgttttcaggatctgttctcggctgtctcttctcttttcacagaacaaaattctctaggttgtataatcgattattgcagtttccactaccactaatacactagtgactttcagagttttatcttcagtcttgttcaattgggagcgtcagacctactgctcagttcatatatcttactggatatacaacaggcaactcacatggttatggactgaatgtctgtgtccttccgaaattcatacattgaaaaatcccaacccccagtgcagtggtactgggggagggtctttgggaggtaattaggtcatgagggtgaggccctcaagagtgggattagtaccctcattagaagatacacaagggaggtgatacctatttctgctatttgaggatataattagaagatgggcatttgtaaacctggaacagggccttcaccagaacccaactatactggcactctgatcttagacttccagtctccagaactgtgagaaatgaatgtttattcttcaagccacctagtcgatggtaatttgttatagcagcctgagctggctaagagagagactcaagaagtcacaagctgaattcatcatcttctttctaaaacaccctctctatactctaccagtgaatgttactaccatgatctcagtctcctatgcagggatcatagatgtccctgtatgtttcaagtttttccacgttctccatctctaattatcattaaaacatattgattctatctccttaacacttctgcatccaccttcttatttccattcacatggctattgccttggttcagtgccttctagatcccttccctgatatatcacagcagtcttttaactatttgccaccttcagtgtagccccatttcaattttaatctcaatgcttcagacaaagtggcattttaaaaactcacatttagaactaaaatatctctcatgttaaaactagacaatagctccccattaactattgaataacttttaaacatttttgtaaataatgtataaagcttgtatcctgcatattgtacagctttatctctcattgcagttctctctgcaggttttgtcttctgcttaaaattttctgaatagaaaaatctgtttcatacctccatatctttgttcgtgctgtgcactctacctgtaccttctctgtctcttctctttgccagatataattttaagggctgaacagtgattagcttatacataaagtctttcctaaccaccccctccatcttttgtatgtacactgaaccttatgcagccttggattatcactcacatgttccaccaacacggcagttctaaggccctggtctgtttacattattgttcttactcttctgatgcttaattgcaaaaatgtctattcctgcgagactgcaaggcctgggtggaggaggcatttagggcctaggagacagcattggctaatggatcctgtggggctggagctaaaaaggcattgtttataaataaaggaaatggccaaaagtaacgggagccaagtttctcactgtaagagaaaggatattcaataatttaaagggtgaaaattagaacagaatggtgttccatcagaattggagataccagtatgatgaactcttgagagagatatatatttatattatacacacacacaaacacacacacacacgagagagagagtgaaagaaaggaaaaggacatagccctgtatgtgcatgtgtagatagatacatgtgtgtgtgtgtacattttctatattttctagctttttctgctgagacagcctaaaagcaatggagccccagcagcaaagaacacacatagtgtccagatctggacttatatatgtatgtttctccaataagagaaacaaagactttttagagaaatgtttaattccagggctggggcaaggaaagtacaagatgagcccaaaatatcttgatttgtcataaaacaagagaatgattaaaaacaatgtggacttatcaaaatgacacagtaagcagccagaaggaccactgggagagtttcagcatcaaaataaataaagatagtaatgaattataacctattgattaaaataaggatcagtgagtccatagtgagataaatgattaaagaaatatgggagaagcaaaagctctttcttacagtacagaatcaactagtaaatgtagaaggaatgatagaaagttaggaagtcattattagcaaacatcatagtaattatttaggcatgaatcatcaatagagtataaaactagtgggtaaaagtttgatgaggaataagatattaatgtaatatcaaaggatctctccacaaaatacttaattgtaaagggaagactacaaatttatagtgaagaaatttggcaagcaccacctttatctagtgataaaaattaacatcatttagaatgatacaaatcaacattgtcttcttgttatgatctgctgagaagaacatagcatcatttctgtgatgttcctgccataaatgcataacctgaatctaatattgaagcagcattattaaactcaagttgaggggaattctacaaaatagctagcttgtactattcaaaaatgtcaacatcatgaacgagaaaagacagaaactgtttcagacggaagaaaatgaaaagtgacaacggtagcattttatctcaggcagaacttgaaccagaatattcttgtactttcctttgctataatgtacaatattgggactatttgtgaaatttgaatggaatttgtgaattttatggtctcaatgttcattttctcaattttgtacttatataggagagtgtccttttcttagagatataggcataatggattatcatggcttccacttattttcaactggtttggggggaaaatgtgtgtgtgtggataaaggcagggtggagtggggagagagaatggcaaagaaattgtgtcaaatgttaacaattgggaaccctgacaaggcatactgaaattctttttactcatcttacaacctttctctaactttgaaattattataaaataaaatgtttttaatcactatttctttgccactttttgtacttcaattttctttcccaacttcaactaccttctagtgatcttcaaaggctcatggaaataaatttataaaatacagaaatgaattcattaaaataagaagtgtaacatggtgtttaagcttttgtgctcttgaatcaaacttcctgagttcaaaattccaacccatatgtggttttaaggcaaatcacttaacttctccatgtctattttctcatctgtacaataggaatgataaaaaaaaaaaaaagctcactttatgattggggagaattaagtcattcagcatatttaaaacacatagcacagtgcccagcacatggtaaataattaatgtatattcaaaaaattttgaaggacttattgagaaagattactgcagaaaaaagctgatttgtgtagcattttgtttactagaatctctgtagaacctgagtggctgacaatcctaaagaacctccatatccacataataataatttaatatctgcaagccatgaaaatctgagcagaagactgaggaatcaatccacgtgagaattttaattataagaatgagtgggttttcttattaacatacttaaaaaccactgccaccactgcccagattcatcagacagtagggaggatggggaagcataaggcagctacttttactgagattcagaacggaacaaaccctggatactgcaggcaatgcccaatagtttttccatgagctatttaaaaactggagaagtattggattttatgaggtcagtcagtgaagcagaaaaagctcagtttgcctgtgatgctcctggaatacaagtaatatatctgcattgcagcagaggagcaatgtagggaaggaaatgtaagaaaactgggtgaagagaaacacaattaaaatcacatgctccaagctctcagtctaaaataaaatccttctcaagttattgtctttgaaggacattatggcagtcaagagcactggttttatagccagacagatctaaatgtgaatcttggctttgtcacttgatgctcaacagttaatcttgaataagttacagaacctctcgaagacttagatacctgaaatagaaaatgggatgatagaacttgcctcagagttttatgtgagcaccaaatgaggtaatattaaaatgactgtcacacgtgttcagtacacatatttattgctccttttctgacagaaagcatgaagcaacaagaaaaaaagacaaatttgggaagaaaaagtttttatttatttttcactattaagttaatattcttgtagttttttgttaactttttatttagagatatacattattaatataatacattaagaaataagaaaatattaaattattaagaaataatacagaaatattccagtttgaagaacctttattcaatttagtcagtttagagtaaccctcattaaactcttccaagcacgaatctcctccatttctataattttgtatttttaagaatgttatataaatggagtgatgcagtgtgtaacctttaaagattggctgttgtttttttaaactcaacaaaattctctggagatgcattcaggtttttgcatgttttaatagtttgtatctttttattgctgattagcattgcaaggtatagatgcatcactattttttgttgttgttgttgttttagacagtgtctcactctgtcgcccagtctggagtgcagtggcttgatcttggctcactgtacccttgcctccaggattcaagtgtttctcatgcctcagcctcacaagtagctgggaccacaggtgcccaccaacatgcccagctaatttttgtatttttagtagagacagggtttcaccacgttggccaggctggtctcaaactcctggcctcaagtgatctgcccacctcggcctcccacagtgctgggattacaggcgcaagccactgagcccagccagatgcatcacagtttaatcattcactccttgttttttttttccagttttttagtgtaatgaataaatcagctataaatatttgttcacaggtttttgggtgaacataagttttcatttctctgggataaatgcccaggatcataaattgctggatcatatggtagttgcatgcatagcttttttaaaacactgccaaattgttttccacacaggccgtaccattttacattcacaccagcaatgtaagagtaagccattttctctaaaagcttgccagcatttggtgttgtcactatttttaattttaaccattctgatagatgtgtaaggaggtctcatttgtggttttaatttgcatttcctgagtggctaatgatgttgaacatcttttcatgtgcctatttgacatatgcgcatgccagaggataactacgcatatctgctggtgaaatgtctcttcatatccttttcctactttgtaattgagttgtttattactggttagttttgagagttccttatatattctaaatattagtaatttgttagatatgtggtttgcaaatattttattccaccctgtagcttgccttttcattctcttaagtgtttttcacagagacaaggtttcaatttttgctgttccatttatcagtttttccttttatgaatcagtgtatcaagtcaaggaaatctttgcttaactgtgattccttaagatattttcctaggttttttctaaagttatcataagtgttacattttacatttatgggcataatttatattcattttgggttaattttggataaggtgtaaaacaggttgaggggtgtgtgtgtgtgtgtgcacacacgcacgtgtggctacttttggtctatggatgtccagttgttgcagcaccatttgttgaaaaggcaatctttcctttattaaattacctttatttcctgtgaacttttgtcaaaaatctattgaacattttttagcacatttctgaattctctattgtgtcccattgttctactgatctattcctccactagtactacatagtcttgtttactctaactatacaataagtcttgaaatcatatagaccaattctttctgatttttgtttttaatttttttttttttttagcttttttagttccttcacctttccatataaattttaggattgtctatctcatctgtatatgaaaaatcttactgggaaattgataggagttgtgttaaacctgcatatgaatatgggaagaattggcatctttactgttttgagttttccaatctgttaaaccagtatgtctctcatttcttttgatctttgatttctttcaccagcattttgtagttttcagcatccaaatcttgtacatttttttagatttatacctgtgtcatttttcaagtgattatacatggtactgtatttttaatttcattttccatgtgatcattactaatgaataatatttgtatattaatcttgtatctcattaccttgctgaacacacttactagttctaggaattttgagggtttttttttttttgtagattccttgatattttctatctagacaatcatttcatttgcaaacaggggcagttttatttcttccttttctgtttgcctttcgtttctttttcttgtcttattgcactggatggaacttccagcattattttgaataagagtggtgaatgccttgttcccaaccttaatggaaaagcatctttctccattaaagataatggtattataggtattgtgtagatgttctatcaagctgaaggtatttccttctactcctatgcttctgagagtttttacaatgaatgggtgaagaattttattaaatgtcttttctgcactggttgctatgttcatgtggttttgcttttatagtctgttaaaatagtgaattatattggttgatttttaattattgagccagccttgcatttttggaatcatttcaacttggtcatggtgtataattctttttacatattgctgaattgtatttgctaatattttaaggactttctcacttatattcatgagggttattgttctttaacttctttttcaatatactgtcttgttttgatatcatggtaatattacttcataaaataaattgggaaacgatccctcatcttctattttttggaagcacttatgtagaatttatgttaattattcttctaatgtttggtaaaattctctggagaaaccatctgagtctgtagatatattttgggggagtttttaaaattcaattttattgttatagaattagattatctcttttatattgggtgaattgtggtactttgtgttttttgaggaactagctcatttcatccaagttggcacatttatggtttcagtaatgttgatactatttccttacaatcctttttatgtctgcagggtctatagtgatatcctctgtttcattccatatattggtaattcgtattctctttccctctttcttaatatcaattttgttaaaggtttgccaatttcattatctccccaccttcgtccgaatgatttttctctttttttctgttttcagttttattgatttccatttttatcttcattacttcatttcttcacttgctttggatttattttgtttccctttttctaggttcttgaggtggcaacttagatgatcactttgagacttttcttcttttctaatgtatgcatttctttcttaacattgcgttagctgtgttctaaaagttttgatatgttgtattttcctttttattcaatgagatatttttttaaatttcctttgagacattctcttaagaccaataggttatatagaagtgtatttatattttccaaattatttggacattcttctgttatgtttctgcttttgattcccagtttgattatattgaccacactatctagaatttcatttattttaattttgttgaggtttgctttatggaccagggtatggcctatcttggtatatgttctgtgggcacttggaacaaaaatacgttctgctggttttaggtgtagtgttctataagtgctgattaaatcctgttggctgataatgttgttgagttattcatatctttggtgattttatgtctagttgttcaatacattgttgagagaggtctccacatgtaactgtggatttgtcattttcttgtttctgttatatcagtttttgctttgtatattttacagctcttttttttaggatataaacatttaggattactatatgtctttttggtgcattgacctttgtacctccctgtcactggtagttttctttgttctaaaatatattttatctgacaatattgccactcctgctttctttaatgtttgcacaatatctattttttgatccttttactctcactctatctatatgcaatatatgaagtgagtttcttttacacagcatataatcaggttgtgctttttaatttcactttgcccatctctgtttttcaattagtgaatttagataacatataattattgataatgctatggtttaagtgcacccatttttctttgttttctgtttttttccctttattttctttttcttgtcttcttgtggtttacttgaaatattttagaattccattttgatgtatctgtaatgttttttaatgtatctctttatatagcttttttattgcatgctctagatatcacctgatatctatctgtatttatagctgtctatatctatgtctttgtatatcacttatcctagtctactggtatcattttaccagtttgcatgaaatgtagaaaatttattttctattacatccctttctactcccccatttatatatatatatatatatatatatatatatatatatatatatatatatatatatataattttttattatactttaagttctagggtatatgtgcacaatgtgcaggtttgttacatatgtatacatgtgccatgttggtgtgctgcacccattaactcgtcatttacattaggtatacctcctaatgctatccctccccactccccccgccgacaacaggccccggtatgtgatgttccccttcctgtgtccaagtgttctccttgttcagttcccacctatgagtgtgaacatgtggtgtttggttttttgtccttgcgatagtttgctgagaatgatggtttccagcttcatccatgtccctacaaagaacatgaactcatcattttttatggctgcatagtattccatggtgtatatgtgccacattttcttaatccagtctatcattgttggacatttgggttggttccaagtctttgctattgtgagtagtgctgccataaacatacttttgcatgtgtctttatagcagcatgatttatgttcctttgggtatatacccagtaatgggatggctgggtcaaatggtatttctagttctagatccctgaggaatcaccacactgtcttccacaatggttgaactagtttacagtcccaccaacagtgtaaaaatgttcctatttctccacatcctctccagcacctgttgtttcctgactttttaatgatcgccattctaactggtgtgagatggtatctcattgtggttttggttcacatttctctgatggccagtgatgatgagcattttttcatgtgtctgttggctgcataaatgtcttcttttgagaagtgtctgttcatatccttcgcctacttgttgatggggttgtttgtttttttcttgtaaatttgtttgagttctttgtagattctggatattagctgtttgtcagatgagtagattgcaaaaattttctcccattctgtaggttgcctgttcactctgatggtagtttcttttgctgtgcagaagctctttactttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttcttcatatggctagccagttttcccagcaccatttgttaaatagggagtcctttccccatttcttgtttttgtcaggtctgtcaaagatcagatggttgtagatgtgtggtattatttctgagggctctgttctgttccattggtctatatctctgttttggtaccagtaccattctcttttgctactagtaccatgctgttttggttactgtagccttgtagtatagtttgaagtcaggtagcttgatgcctccagctttgttcttttggcttaggattgacttgacaatgcgggctcttttttggttccatatgaactttaaagtagttttttccaattctgtgaagaaagtcattggtagcttgatggggatggtattgaatctataaattaccttgggcagtatggccattgtcacgatattgattcttcctatccatgagcatggaatgttcttccatttgtttgtgtcctcttttattttgttgaggtgtggtttgtagttctccttgaagaggtccttcacatctcttgtaagttggattcctaggtattttattctctttgaagcaattgtgaatgggagttcactcatggtttggttctctgtttgtctgttattggtgtataagaatgcatgcgttttttgcatttatattatcattgtcttaaacatttcttctacatgtatttagaactgtgtcagacaatattatgactttctgctttaaccatcaaacataactcagaaaactcaagaggaagaggaaagcctattgtagttatttatatttttgtttagcatactttttttcttcctaattttccacaatattttctgctgtcatttcatttttgtttagccattgttttaggtaggtctgtaggtaacaaattattttccttcatctgacaatttcttgatttcacccttcatttctgaagaatattttcacagagaataggattctgagttgacagttctcttagcacttgaaaagtactgtgctacttccttctgacttcagtggtttctgatgagaaatccactgtcattcaaattggttttcctctataggcaaagtgtcattttcctctgactgctttcaagacttttcatttatctttagttttcagaagtcaagttaatataagtgtggttggatatctctgggtttatctttttagcttcttcagtatatagttaatgctcctttccaaatttgggaagattttatccattacttctttgagtacttcttcagtccctccctctttctcctttcttcctgggattctgatgacacaaacattaaatcatttgttatagtctcacagatctctgaagctctgttaatttagtctatttttttctctgttgttccaattaaataatttctacatttctttcttcaagttcactgattctttccttggcaaatttatggcaggcctgaatatgcacaggtctttaggccctcagcttgaaaacatgattgtcagcataatgaatgcctagatctgaacctcaaagtgtactcacattaaacaagctcatggaggctaatgacaaaaaccttaaatgccaattaatttacttaatttaaaataagaagtttaaccatcaggtagacttagaacaaatggtttctcggtaggcaaatgaaaatggaaaaccttaattataactaaaaggctgcttagttagcctgcaactaggaaaagaggagttatttggcaattttaatgcctgatgtcatagagccctggaaattactaagtacatctccaccacaggatcatatctgccatatcacctggttggttatgatactgggccaggacactctctcttctgatcgtgaaataaaatactaccacggtttgactttcctttttctaaacatcttttattggctaaatatcttaaagacagtcatgtttttactctatatgtgctagtacatttaaacacttctgttcaagtcttggctagagcttattctgtctctgctttgtgactttatatacctctctaatttaaatgattatttaaaaaatagtttaaaattcaatgtgcaactttctttccaactttctgaaggttctctcattgttttctctatgaaccacatactaaaattactggacaacaaagaccaagtaagaattggtctttttcttttgggcaaaagctttttttttttttttaatggagtcacagctgacaagaccatgtctgctctataaaatcagctttaagaaatagaaagagaaattagagctcttagaaggtgggagagagtgagttcagtttcatgcctatacttctggttttaggggtttgagggaaagagtggcagtagggggcaaaagttaggctatgagggccatgtccaaaagtccctcaggttctgtctttggagaattgtagactgcctttaagggaactgcaaggtttccttcagtatacgttggattaattggttcctctggttaaatagttaccatgcttagttttaatacaactaattgatttcttatcatctgtctaataatttagttcaaattcttttccatttaaggacagaattctaatgttctcacatttaagaaggaaatttagccaggtgcagtggctcacacctgtaatcccagcactttgggaggcctaggtgggtggatcacctgaggtcaggagttcaggaccagcctggccaacatggtgaaaccccatttctactaaaaatacaaaacaaaaattagctgggcgtggtggcacacacctgtaatcccagctactccagaggctgagacaggagaattgcttgaatgcagaggcggaggttgtagtaagccgaaattgtgccactgcactccagcctgggtgccagagccagattctgtctcaaaaaaagaaggaaatttatattctgtcctgtttaattgttcaataacaatttgccgagctcataactaatctgttaagcataaaacagtttctatcactgaaagtaagataatagtaaaattaaaaatatctcagatatgatatttcattgcccattggacaactactgacttcagagtcaaagtcaaagtctttagcttaacctacaagtctttatggcatagcctttgcttaacttcatctttctcaattctctctgcttctaaaagaaaactttctgactatagggagcaagtagtctagtagggaagatgggagagagtgagtttggtttcgttcctacatttctgattttagaggctttgagggaagagtggcaggaggtcaaataatcagacaaatagaagtaatatcatagttgtaacaaatgccacaaaggagaaaagcatgtttttataataacataaaataaaatgtatttcattttatccaggatgtaagggaagtcaaaaaagtcttctccaaggaaatgattccgttgaattctaaaggaaaatatagaattaacaagacaaagagggggagggaaaatgttgatgtaaggaggaaataatatgttcagaaaccttagcatgaaagcagactgtcgtacacaaaagacccatgtgtcttgtgtaaagtgagtgactgaggtacacggcttcagatgtaattagaaaaatagatatggaatgaattatattaaggaatttatctttattataagagcaatgagaagctgctgaaatattttaaacagaaaagtaacatgaaaaaatatatattttcaaaataacatactggctgctatgtggaaaacaaggacagatgtggattcaggatgaccattgatttgtaagcctattgtaataagactattgtaatagaatagttaattgatgacagtggcctactcagggcaacgtgataaaaatgaagtttagatggatcctagagacatttatgaagcaaaatcaagcagatattgtgctttgttagatgtggggttttgagagggaggtgggaaaccttttttttactgcatgctccccaggattgggttaggaccaccttctgtatattcctgtaactccttgtactgccatcttaggatttctcatttgatattaaaattgcttgcttacactatatattgtatattgcaagctccatgtcttgctcattattatatttgttgcacctactaccatgcctagtacacagcagttctcagaatttgtgcaaggaaaaagtagaaatgtagagactttaaagttgaaattattttcatagatgtttagaaaaaggacaattagctttcaatataaaaagcagtaaggtgtactgaaaagcagtaagatatcctcaatgtttaactctcagcagtgttacaaatgttttcaagtttagagatggacaaagaatgcttgcatactccaataatgtccacctccaatgaaagcaaagcaaacagcaattccatttgcagttatgcaggacctcaagaaaggggcttatattaaacaccttcagacacagatactaattctaagacctgataaatgcagcatttcttcaacattctcttcagcagttatcctcagagcttaagtcaattcttagagctactacctgtggctgaattggaggtgtcccaatctccagactctcttaaaatggaaaatagtactctgcatgcaccttcatctaagggaatgctattttctcaaccctcttcttcttttcctttggcccatcctccctttttgttgtttgtaaaatctatgcaaggataccaatcagtgtttctaatcatttgtattgtttttaaatcctcttctattccttcatgaaccatcttgagtcacatttcacatttgattaccttggtcttttccttttgtacttcagattttttccatttatctggtaattctcttttgcctactgtggcagccaacctccaagtaagatggtctccagtgatctcaccttctgacattcatgttctctcttaaaaaaaaaatagaggcaggatctcactctgtcacccaggctggagttcagtggtatggtcatggttcactgcatccttgaccccctgggctcaagcaatccttcaacctcagcttcctgagtagctaggactacaggtgtgtgctaccatgcccagctaatttttaaatttttttgtagagagggagtcttgctgtgttgcccaggctgatcttaaactcctggcttcaagcaatcctcatgcttcagcctctgaaagtgctgggattacagttgtgagccactgtgcccagccagctattcatgttattttatagttaccttcctcattgtatttgatttgctctgtctgaccagcagaatatggctgaaatgatggtatgcaattttacaggttaggtaataaaaggcagtgttgtttcctgcttcctattttggatcattcactctagagaaagctgacttccataacatgacaagcggcccacatagcaagaaacagacctcttgctaacagccatgtgaatgagcttagaagctgatccttcagccccaattaagctttcagataactgcagcctcaaccaacatctggactgtaacctcaggagagaccttgagccaaaatggcccagctaagcagcttctgaattcctgaccctcagaaagtatgtgagataggccagacgcagtggctgacacctgtaatcccagcactttgggagactgaggtgggcggatcacctgaggtctggagttcgagaccagtctgaccaacatggagaaaccccatctctactaaaaatacaaaattagccaggtgtggtggtgcacgcctgtaatcccagctactcgggaggctgaggcaggagaatcacttgaacctgggaggtgaaggttgcggggagccaagattgcgccattgcactccagcctgggcaacaagagcgaaactctatctcagaaaaaagaaaaaaacaaagaaagaaagtatatgagataataaatgtttgttattttcagtcattaagttttgaagtaatttgttacatagcaatagataagttaaacatctatcctttttaagaacagaggataggagagctgactaggagatctgtgttttagggtgggcttggtaactggaagtctttccttaaaatgaatttttagaaaaggagaaagctttgtgaaagtaggggctaactttggtatgataacagcttcattagacaccctcgttttcccttaagagttcatttaatttattcattattctttttcctactgatgattctttctgttatggcgagggttgaaagactgttctatacacagatcttcaactaatcttttagtttgcaaccaacttctgccctcatctagggttttgtcaggcatatagttcccttttccctttggtgccttgcagctatattcagactatgattccctccaatttattgaatttgtcagcattcttctatctgcttttcatttacagaaatatgttgaaatatttgctggaactgcatcttcacactttcttttaccttctgttgttctctttgctattttgattatataagttaaaaagcttattttactattcttttagtaggattcagggattagggaaggcgaagtatgctcaatctgccatctagaaccagaactcttctatgtggcatattttattctattcattcagtacacagcacttcacttttaaggatctacagcagggtatggctgttttgtggtctttatcaagagatctcgtgggccattgccctccctttattcactcttcatattgtcttgccagtggggtcactatcctctctctaggctatttttccattcattcaaaaatttccttcattccccaagactatcaaaggtatcttatggaaccttaggcctctggaagagtgatcctctcatgtctagggtcatatagtggaactcagttgggaatgatccattgatacagacctctagtcaagtcctggccctctttcatgtagctatacaaaatggagcaggagggaacaatccctgctaccaaggctagcatagcaagtcagtatgatgagagatgaagactccattcacctttcccctgccagaagtatcctcaatctccatggtctacaatatactccttctcatcaatccctgtatcacaagaaacccttgaccacagaaaaagaaaatgtagttcttagaataaaagaacatctcttcctccctaaactagagaaaggcagctctacaaaagatactcttggtaactgtccaagttcctaaactatctgtgcatatctgtttcacatcaaggtttataaaataatgtttgcaattttggcattttaagtttctgagggagtggtgctgtccatgtctggatgaatgatttctcctttttgcctgtaaaatattggtgaacaaaaaagacaatttaaaattttgaatctggatcctttattgccaccatattgacccctgaaaagatgcatttcttttgtgtctttcttttttttaagtataagaaaatgatatttatttatttatgttttcctttttttatttcttcttctaaaaaaaaagaggggatacatgtgcagaagatgcaggtttgttacacaggtatacgtgtgccgtagttgtttgctgtacctattgacccaacctctaagttccctcccctcacccctcaacccccaacaggccctggtgtgtgctgttcccctctctatgttcatgtgttctcaatgtttaactctcacttaagagtgagaacatgcagtgtttgcttttctgttcctgtgttagtttgctgcagatgatgcttccagctttgtccacgtcccagcaaaggacatgatctcattctttttagggctgcatagtattccatggtgtatatgtaccacattttctttatccagtctatcattgatgggcatttgtgttggttccatgtctttgctattgtacgtagtgctgcatgtgtgcatgtgtctttatatgtgtctgtatagtacgtatagtacgtgcatgtgtctttatagtagaatgatttatattcgtttggacatatacccaataatgggattgctgggtcaaatggtatttctggttctagatcctcgaggaatcgccatactgtcttccacaatggttgaactaacttacattcccaccaacagtgtaaaagtgttcctatttctccacagcctcaccagcaaacagacatatagaccagtggagcagaacagagacctcagaagtaacaccacacatctacaaccatctgatcttcagcaaacctgacaaaaacaagcaatggagaaaggatctcctattcagcgaatagtgctgggaaaactggctagtcatatgcggaatactgaaactggaccccttctttacaccttacacaaaaattaactcaagatggattaaagacttaaatggaaaaccccacaccataaaaaccctaaaagaaaacctaggcaataccattcaggacataggaatgggcaaagagttcgtgactaaaacaccaaaagccatggcaacaaaagccaaaactgacaaatgggatctaattaaacaaaagagtttctgcacagcaaaagaaactatcatcagagtgaacaggcaacctacagaatgggagaataattttgcaatctaccaatctgacaatggtctaatgtccagaatttacaaggaacttaaacatatttgcaagaaaataaaaacctttcaaaagcaggcacaggatatgaacagacacttctctcaaaagaagacatttacatggccaaaaaacatgaaaaaaaaaaaaagctcaacatcactgatcaccagagaaatgcaaatcaaaaccacaataagataccatctcatgccagtcagaatggcaattattaaaaagtcaggaaaaggtgtatttcatgtgaataggcagtggtaaagaaacccaagataattgcgtggtatcttaggaatacagtgtaaatgatatttagaattatctgggcaagtttttggcatttggaagatctgatcacagaaacagggtcccagattgaggattcacttaggaaataaactccatgacactgggaaggagtttttcaagaatgtggcaggaccacagttacagaaaagaactgacagatgaggcaggccataagtcagtaagtaaggggctcaaagaacttcaatttcatcagagaccttggggaaatgccagaattggacaatgtgaaaagtgtatgctatgcttttcttcttgcttgaactaagttttaaagaacttacccacatcaaataaagagaaacctagacttagtatggtttatctctggtggaagaattaccaggagtggaaaggctgcttaagatagtggtgaatttgtgctctgaattttattcactccttgaaggactctctcagctcagtttcaactgagcccatccttctaggcctggtaatcaccacatctttggcctttgcaagtccaagacagactgaagctgccaaagatagaatatgagggaatagcatagaaaaaaaatcagaaataggctgggtgcggtggctcacgcctgtaatcccagcacttcaggaggccgaggtggatggatcacgaggtcaggagagcgagaccatcctggccaacatggtgaaaccccctctctactaaaaatacaaaaaaattagcagggagtggtggcgtgcacctgtagtcctagctacttgggaggctgaggcaggagaatcacttgaacccaggagacggagattgcagtgagctgagattgagctactgcactccagcctggcaacagagcaagactccatctaaaaaacaacaaacaaacaacaacaacaacaaaaatcagaaattgatggaatgtcaaaatactttatttaacaaaatccagtggtctaatcccttcatcgtagttttgtagcattttaccatccctttgtagatttgtattggccctagttcattgaaatctcatctgtgtcccttgctttttagtttctggtcagtctctatgtaccagttttaattttgaccaccccatttccaccctctcactgatgaacttcattaaaaaatttcatcacttctcaggtcaaaagagaattttttacatatctgttacatatatatcttttgaatatctatttgtctactttttcagttccagttttcaatctgaaaaatgggcttattctttgtgtgactgacaccaggaataattttatatacctgtgggttttattgtaggctgagatgtttagccatctcattcaaatgcagacacattatccttacgaccagggttgcacatataccctgtggtaacgggtgagttattccctcatataaggaccagttacatatatattaaaagcagctcagtctttctgtttcttaggaagtaaaggagtataagaagggttactctactcttttacttatggagaggacacagagttaccagtgaaaatgggggaaatactgtaaatagtgaactcttaaaaaaagaaactgtgaacaactagagatgattcctacagaggaggagacagattcaggggagatagctcaaaataagtaatgtgtccttgtcaggaaaaaaaaaatgctggcatttggtaaactgtaggtgttattattttcagggaacctaggaataactgaattgtgtatcacaccaaagctgtacatccccattaagttccgaagagaaatcttcctacaaggagtaatggaaaatgggaagccaaatagactgggcccttagctttaaggctgagaatgcatctaagttgtactggaggacacagttaaggggcttctatttcatgttccttcttagaagccccaaggcacaatctcagaattgtgcatctactgggagtggcccaaaggcaatttgccattttgtgaaaaagtggaaaagaaaggagagagaaccaacatacgggcaatttttaaatctacaatcacctttttcattattaaatgtggcccaattagtgatctggatccaactaatcaaaatgatgttcctttttggtaggaagaattcagaaaaggcaggcatggtataggagaagcattgataattttgtaattatctctgagtttctgttcccagtccagcaagaggcacatataaaaaggatgttctggtgaatgctcattttaaaaaataatcttactctaaaccattctagctctcttcataatattttacttgaatgttcaccaattcctccttcctatctatataactgctttttgtttttgccttttgtatgattgctgattttttctacttgatctattaaatcttaataaagttagattaaaatagccttttatgatggtagacttgttaatttccccggtaattacaataaattttgctttctatgttttaaagctatgtcattaatgcctacaattttaaaatgttcatatttttccagtgaattgaaacttttgttaattaacagcacctattcacaatgaaaatgaaagctctataggcacatgcgtcaacatagataaatctcaaagacataatgctgagaaaaacatgcaaattacaggagaatacgaacattatgacacaaaaattcaaaacattaaaaaaaataggaacgcattatttagggacacgctatatagatgggaaaaatctttaacaaaatccaggatagtggcaacttataggtgaagtgtgaaggttgtgattatggaagagtactcaggggactttaaaggttctggtgatgctctgtaccttatgtaggttggtaagtatacaggtgtatgttttatttgtattatatattcttttgtaatgatatattttataataaaaatcagtaaataattgtatgaaaaaggtggttaaacacaattttaagactctgacctgcccgaatacctaaagcctggggtcattaccacctcaccggagattcttaaacacatgcttataaggtcgggctaatctataaagccacactctcagcaagggtttctagacctggaccaagtgtaacaggatagattgttttcactcccacatttatgacgatgttacagtcacccaatctcctgttctgagaaaaccttcactaaattttcaaacccaaaaacattcccaattctcacttaatttccttcctataattagccttctgcattagttcctattgagataacctataaaataacaacagaaattaaattggaatgcttacatattctaattgcgaggatttacatatttttagtgtacatatattgatttaaaccactttataacagtcctgtgaagtgagtacttttagtttttttcactttgcatatgaaagaaatcaggataaaaagagattaaatagttttcccaatattttttggctctgaagtgagtctgaaaccagacatcctggctccaaagtctgcactcttaaccaccaaagtcaggccttgttcttgccaattctctttccaaaaactgttgtcttgtccctgaacttcagtccagccaattaagcaaaaatattttgggtgccagcagcctgtctctggtccttcagagtttttcccacaatggattccccatcactgcactcgacctcctgttgtttcagcagcaacttcagtaccatctttctgcccaacactcagtagttctccaacactgagattgtggacgtggcttgacaaccactgttagccaagagggtcactcagtgtctgtttgccctgtccaagtgggtgaacccattgccaggttgtggtgtcatttcctacctgtatttttcttactgtgaataaatgactagctttgcctatgagttacaagccataagtaagtgcaaaataataaataaataaataaataagattaaaaatccaacaagaagaaaaatactgcttgaatatgaagaagaaaagtgcctgcaaggaaacccagagactgagcatggaccctctcctcagagagtgtggacagagctggcagaagagagtaatagagaggaatatgggtgtttgtagccccctgagcaagatgaaagaagtggatgattcctggcaaaatacctgctacataataggtgatcaagacaaaatatttgcttgtggaataaatgattgaataatgtgcatacctgattcaaattatgaacctggcagggacaggatatttattgtatgaaggagaataagaattaactggatatctgtaggaacctctggctgaaagcagtctagaaggacctggattcttcttgaaattttattttccaaaagtagaacaaacactgggagatatagctacaaagggcctgtggtgattaatcccgtgatgattaattttatgtgccaacttcactgggccacaggatgccaagatatttagtcaaatattattctgagtttgtgcatttctggatgaaattaacatttgaattggtaaacaattcaaattgtgtattggagtatacatttggattggtatctaatgtatctaatgtttaacaatccaaatgtatacattgaatatatacaatgtctacaaatatatacactggcatatacattggtacatacattttaattgataaacaattcaagttggtaaacaattcaaattgtgtattggagtatatatttgaattggttaaaattggataccaattcaaatgtatacattggagtagatatttgaattgataaacaattcaaattgtctattgaagtacagcagattgtctttcctaatgtggatgggcctcatccaatcaattgaagatctgaatagaacaaaatggctaagaaggtactcctcctgcttgactgcttgagctgagacatcaggcttttcctgcctgcagactgtacctaaaacactcattcttcttggctttcaaggctgcaagctttcaaactggatcttgcaccactggctctcctgggtctcagcaactgcagatcttggaacttcccagcctccataaacatataagccaattccttttaataagtctttctccatgtgtaagtgcctgcaaggaaatacggagactgagcatggaccctctcctcagagagtgtggacaaagccagcaggagagagtaataagaatatatatataatatatacatatattatacatatatatatgatacacacacacacacacacacacacacacacacacacacacacacacacacagtttaccaattcagtcatgtgctgcataacaaagtcttgctcaatgacagactgcatatatggtggtggtgtcataagattataatggagctgaaaaattcctactgcctagtgatgttgtagctctcatagtatcatagcataacacattaccttttctgtatttacatatgtttagatacacaactactaccattgagttacagttgcctacagtattcagtacggtaaaatactgtacaggtttgcaccctaggaggaatatgccacagcattcaatctaggtatacagtaggctgtaccatctaggtttgtgtaagtacactctgatgtttggacaacaatgaaattagctaacaacacatttctcagaacatatccttgcaattaagcaataatatgaccataacaggatatatatatcctgttggttctgtttctctggagaatcttgactaatacagggtcgaattcttataaataaggagaaattttttgctgctgtaaaaattgcacaaaagtgaaagggtcatattaaatttggaaatagagatatgaaatatttaacgtagatattctaaagataagaaaaatgatgatcatagttctgtaccatgagactttaaattgaaagttggctttgaaagtattggaaaattctgacttaaaaatacaaaatatactaagtaaagagaaaaaatagaagaggcacatgaagatgctaagaagactgtagagggagctgtctgatcagcttagatactaaaggacaatctaagatgaaagaaaagaacacacaatcaaagactgccttacatgcactattctctgagaagtaacttattaaacatttgtgtgaataaagctgaaataaaagacaattatgtttaagaattgtgtctagaaaatttgtgttcaaatatgctagaattgcaaaaaatgctgtgtgggaaagaaagggtagggtgctttgtttttagccactggcaaaactaagaaagagcagaacagaccctgcttgaggatcatgctctaataaatatttttgcagatggagagaaagtagatgtctcagtcctggtttggttctgtcttctctttcaaggtataatattgggctgggaaggactctggacttttgaaagaaggaaaagagtgcagagggagagtggaacatcagagagtttcagctcataccagacctagagtttacagtccaccttctaagagtttgcaaaggggattcttaatatattcacagtttggtcattgaaataatcatttattaagcattctgtcctattcctgtcaccaggccagacactgggaatacagatgaagacaatacaatataatttccttgggagtttgaagaattccagagtataggaccacagctggagatgaggaaatgttctgatttctcctgggggaatgaagtgtgttccctgaattagtggcttcctggtttttagacaataaggcttcaaaccaggttgacacatcccatgtcaaacatttggtgggcaataaaagtgagattcagtcttctgagtctataactcatcttactttgattctgctctagcccctagtccttcttctttgctatgtcctcctagcttctagtccttagcttggtctcttggttataactctgtcctcactctctgactaaaatactgaattgactttaattcattcatttaatcaacaaatattgactgaatgtctgtcatatgccagcctttattctagatgctggggatacaccagtgagtaaaacaatgtctctgttttaatgggacttacctctggtactggtcaaaatataaactctctctctccttctccttattatatatatatatatataatatatattatatatatattatgtatatatattttatatatatatgctgtatactgtgtatttatggtatgtgttatgaagaaaaataaaatcagtgtaagaaagacaaggagactgggggttataacacctgaacagagattgaaaggaattgagagtgagagccatgcttgtatctggtgagaagaacatttcaataaagggaaataccagtgtaaaggctggaacagagtgagtgggggagactggtaagaggttatagttgtagtgagagcaaggggagcataggatgtagagcctgctaagccatggtaaagattttgactataatctgagactgtgagctcctgaagggctttgagcagggaagtgccatcatcttatatgttttaatagtgtatcttggattgtcatatatagaataggattggggtaggggtagataaaattagaagaagagagaagagttaggagtctatcggagttatctgagaaagagttgatggtagcttggaacaagttgtaatagtacacgcaggaagaagcgatgcaactgtgaatatattttgaaggtatagcggaaaggatttgctgcttgattagatgtgggctatgtagaatagagacgtaacattcctggctttggccatagtgtcctctaagacatggcttatcctcatcttctgattttatccacttctagatactttggaggctgactcttcctacttccattgagaatcctggcacccaactctgacactggccttccttgactgtgcccctgctaggcttgctctaacctccccacaacccttcccaaaggagaattaaacaggctttttcttctctcaagttaaataaaccccctaattaaaatgactttcattgtgtcttaaaaatgtatgtaaatctaaggaagattggggttaactatgtagaaatctgtagcattttatttatgtttcttcttgactaaggaatcaatgtttagggacttgagtgatcataaaataaaaatgggcacagaaatcgtgactaaggaggagaaggttccaggaagatgaacttgtgttttcatatcaagccaaaagacagatgattcagaagtcttttcctccatgtcatggtgatgaatttattccagaaacgtctaacttattctaccaagagtctaatggctacgagagaaactaagtgctgattactgttctattttctacagttgcagtgcatgtcatgctttctcccctttacactaattggatcccaggccaatgtctttgtaatgggagttaagggtggtattactgcatccctggtcagaccaagggaatccagcttttcttctctgttttgactgttgcacagttgccttgccattcccaaaaatgaacaggaggtgattagcactctggtgccctatttaagctttctggctccaaagagaagctattttgaaaagtgaaaagattacactctgataatagaccagaggccttacacatgtgaatggctcacagaggattaaaagagcagacccagaataaatgcagcctatacctgatggagcaaagagggtgaatcgcccgcacccttgactgcaggagctgtttgaaggaagcaccttactcagattattgatgcctctgtgatccaacgtaatggtgggaggtttaggggggcaatgtctgatccaactgttgtcttctcaagaaaccaattagactgcttcatagtcttctgatgtctcagggatcttagttcctaattggtagactcttcccttccaactttgatctctttctgagtgttcctgcctgggaacattttcccaaggtcaccaatcatctgaagaagtgtatgcatgagggaattcacaattgttccaacttattttaaacacaagatgatgcaaattggaattttgttaatttcaggccaagacccctagaagttgcactaagaggggcccattagtgcacaaggcctttaagtcctataggtcagatttaaagaggccaaagctctgggaagactagttcactcaactgtgataattccagtatgttaatgtgttcatgtactaggaaaaattatatgttctgaggaatcaatgtttattgtaaaattggtctcaattattttctgtccaggaaagctaacctaggaaactaagaaattaaacaaatatattcaataacgtgattgttattaaacacatattatgtgtcaagagccttcccttgacacataattaggtccacttggtccagagctgagttcaagtcccgaatatcccttgttaattttctgtctcattgatctgtctaatattgacagtggggtgttaaagtctcccactattattgtgtgggagtccaagtgtctttataggtctctaagaacttgttttatgaatctggatgcttctgtattgggtgcatatatatttaggatagttagctcttgttgcattgattcctttaccattatgtattgcccttctttgtcttttttgatctttgtgtgtgtaaagtctgtttaatcagagattaggattgtaacccttgctttttttgctttccatttgcttggtaaacattcctccatccctttactttgagcctatgtttgtctttgcacatgagatgggtctcctgaatacagcacaccgatgggtctcctgaatacagcacaccgatgggtcttgactttttatccaatttgccagtgtgtgtcttttaattagggcatttagcccatttacatttaatgttaatattgttatgcgtgaatttgatcctgtcattatgatgctagctggttattttgcccattagttgatgcagtttcttcatagtgttgacggtctttacaatttggtatgtttttgcagtggctggtaccagttttaccattccatatttagtgcttccttcaggagctcttgtaaggcagtcttgggggtgacaaaatctctcagcatttgcttgtctgtaaaggattttatttctcctttgcttatgaagcttagtttggctgggtatgaaattcgtgtgttgaaaattcttttctataagaatgttgaatattggcccccactcccttctggcttgtagggtttctgcagagagatccactattagtctgatgggcttccctttgtggataaccagacctttcaatagatgcagaaaaggccttcgataaaattcaacactgcttcatgctaaaaactctcaataaactaggtattgatggaacgtatctcaaaataataagagctatttatgacaaacccacagccaatatcatactgaatgggcaaaagctggaagaattccctttggaaaccagcacaagacaaggatgccctctctcaccactcccattcaacatagtattggaagttctggccagggcgatcaggcaagagaaagaaataaagggtattcaaataggaaaagaaagtcaaattgtctctgtttgcagatgacatgattatatatttagataaccccatcatctgagcccaacatctccttaagctgataagcaacttcagcaaagtctcaggatacaaaatcaatgtgcaaaaatcacaagcattcctatacaccaataatagagaaatagagagccaaatcatgagtgaattcaaaattcacaattgctactaagagaataaaatacctaggaatacaacttacaaggaatgtgaaggacctcttcaaggagaactacaaaccattgctctaggaaacaagagaggacacaaacaaatgaaaaaaacattccatgttcatggataggaagaatcaatatcatgaaaatagccatactgcccaaagtaatttatagactcaatgctatccccatcaagctaccttaacagaatgagaaaaaactactttaaatttcatatggaaccaaaaaagagccttaatagccaagacattcctaagcacaaaaaacaaagctggaggcatcacactacctgacttcaaactatactacaaagctacagtaaccaaaacagcatggtactggtaccaaaacagatatgtagaccaatggaacagaacagaggcctcagaaatatcaccacacatctacaaccatgtgatctttgacaactctgacaaaaacaagcaatagggaaaggattccctatttaataaatggtgtggaaaaactggctagccatatgcagaaaactgaaactgggccctttccttacaccttacacaaaaattaattcaagatggattaaagacttaaacataagacctaaaaccaaaaaactctagaagaaaacctaggtaatagcattcaggacctaggcatgggcaaagacttcatgactaaaacaccaaaagcaatggcaacaaaattcaaaattgacaaatgggatctaattaaactaaaaagcttcggcacagcaatagaaactatcatcagagtaagcaggcaacctacagaataggagaaaatttttgcagtctatccatctgacaaagagctaatatccagaatctacaaggaacttaaacaaattgacaagaaaaaaacaaccccatcaaaaagtgggcaaaggatatgaacagacacttctcaaaagaagatatttatgtggccaacaagcatatgaaaaaaagctcatcatcactggtcattagagaaacacaaatcaaaaccaaaatgataaaccatctcatgccagttagaatggcgatcattaaaaagtcaggaaacaacagatgctggagaggatgtcgagaaataggaacacttttacactgtaggtgggagtgtaaatttgttcaaccattgtggaagacagtgtggcgattcctaaaggatctagaaccagaaacaccatttgatttagcaatcctattactggttatatacccaaaggattataaatcattctactataaagacacatgcacccgtatatttacagcagcactattcacaatatcaaagacttggaaagaacccaaatgcccatcaatgataaagtggataaagaaaatatggcacacatacaccatggaatactatgcagccataaaaaaggatgagttcatgtcctttgcagggacatagatgaagctagaagccatcatcctcagcaaactaacacaggaacagaaaaccaaacactgcatgttctcactcataaatgggagttaaacaatgagaacatggacacagggaggggaacatcacacaccgcggcctatcggtgggtggggggctaggggagggatagcattaggagcaatacctaatatagatgaagggttgatgggtgcagcaatccaccatggcatgtatcccagaacttaaactataataaaaatattgttctaataacttttaaaacctttttattttatactaattttagattcacagaaaagttataaagatactatagagagtttccatatacccttcactcagtttcccgtatggttaatatcttatattactatgctacatttgtcacacctaaggaagtaaccttggtaaattatgattgaactacatactttattcagattttaccagcttttcccaatgtagggctttagaatcattttcatatacaatactagttagtaatatctgatttagcactgtctatgtcagaatttgatatcagtgttatgtttacttcgtaacctttctttatgttctggaaccatttcacagggattggaattatttacctactggttttgaagagctgatctgtgaaattgtatagtcttagtattatttgggggaaggtatatttactgagacaatgggtaagagaggagcatcagtgtactagccaggactttggtcccaaaccccaatgcagtcctcacttgagctatgctggggcacttggagaattctcacttaggacaggttgatctgtatgcccttgtataatacaagctgaaatgctacctgagcctctttcctgtaagctcacacatgaatcttggattttatatctctttgataaagaaagcccaccacagagccttctaattgctgaagaaataagaaaataaaaaccaagtcagaatttgatctaattcttagagatccccattttaatcctttcaggctcaggcccacccacagaattttagtccagtaggtgtaaagtgggacctaagattttatattttgaacagatcttcagatgatgcttgtgttctagggaccacactttgagaagcatttctctaagatatagtttgtgtagagaaaacctgaataaatgcttgatcatttctatttatttctcagtttttggaataattattcagttccttaaaaaccttgaaaggtgaccagtaatttttgttctagtgacattaagaactcaagcatttaaaaacagatttgatatggtccaattacttgtagttgttcattttgtttttggtcctcagattgtctcatgtttggacaatgggagccccttcaaagttgactcctgtgttcttttggaatgacctaccccaacaatctttgaaagcttctccacttttgggtaccaacaaaatgcttcatgcatatcttataaattttatactacaaatttgaattcagccatttctttaaggcatcttgatttcttttaatatgagtttgtattgtattttgctgtgttttctaattataaaatcatattctcaatgcagaaatgtggaaatagcataatagtgtgacaaagcaaaaattatcctacaattttaagggaaatacaggtaacattttaatatatgcttttccagatcttttgcaatgaaattctacataattgaaataatgttacatataaattaatatattgcattttcgtttcaaaaaaaattcataacaactctcatttcattcaaaacttcacgagcattattttaacagtagcatcatgtcccactatatggacttcatataatttccctaaccattctccaaatattagacatttaacttgtgcttataacttatgctttaaaagactgctgtgtatttaagtctttgatctcattatatgtatatttattttaaaatctaatccagaagtagaactcatggatcaaaggatatgaagatatttaaaactctggaaacctattactaaattgctatccagaaataattatactgtacccttgccagcattgagcattctcattttagaataaagtttgctactatgatgggtgaaatattactatcattgttttcatttgaatttgtattccagatatattaacacttgatctgttatgttactgcaaatgttccctggtgtatcatttgattttcagtttttgatttgtttttgatccacagaaacgtatttcatccgccagtatcttcttttgaaacttctttcagtgcatttataatgtctacgttgataacagaaataaaaggcatatttatatacagtttacgtaaattaactataaaactgagtttagtagagcacatatgttccataaagaaagaaataagagcaagaaagagattagctagtgtactgcatggccatgtcagtggagtccctggcctcactgtaatctggatgtggcagagcccttttttttttcagctctgttcatctgtgaggggcaaccaagtctctcatatctggcagaggtgatctctatcaggatagtcactgctgataaccagttgtaatttaacaatccacctcggctaaaacttttttttttgagacggagtctcgctctgtcgctcaggctggagtgcagtggcgcaatctcggctcactgcaagctcctagcctcccaggttcacgccattctcctgcctcagcctcccaagtagctgggactacaggcgccccccaccacgcccggctaaatttttgtattctttagtacagacggggtttcaccgtgttagccaggatggtctcgatctcctgacctcacgatccacccgcctcggcctcccaaagtgctgggattacaggcgtgagccactgcgcccggcccacctcggctaaaactcttaaaaaccaaagtcctttgatggaaccagcaacgacaaagccttcctctggcagctctgccagagtctcactgttttttatcagagcaaacaggcagagctatgataatagaagggaaggatgaggtcatctcaatataggagcatggtgtgggaggaataagctcaggactcattctagaagtcactctttgcacagagttaacttttaaaaatgtaaaccaaacttgccacttccttgctgaaatactcaaatggcttaacatcctgttcataataaaatcaaatctccccatactagcctacaatgccctacaaggtctgactctctccagtcccttctcttagcattcttccctttgccctccagccaggagactttctgtatgtggaacaggaaagttccttcccaccttagggcctctgcaattactattccctttgcctgcattgtatttcctctgactccttagtttccatggcacatccccagagaggcctttttcagacacccaagttaaagtagttcccactcttatcactctgatattttcaaattaccatttttaaagtttttttttatctatctacctatctttatatcatctctctcatctaaactagctactaatatattgtctaatatggtgggggtgggaagagaatggtgaaagatgaatgaataattaaatgactggctagttatgaattcattcactagtatttctcccagaattagcctgcaagttccatgggagtggggattttgaatggattctcagctcctggaatgatgtctagtgcatagtagtcatccaataagtgtttattgaatgaatgaaaaggttgagatgaataatttaaaaaataaagcagatgtgttcatgtatttttcttaagagcatgaagtgcatctcacctattacacataaatagttaaaatgttttagtgttttccaggagaaaacaaatatgcaaaatgctttccagtgtctcctttaatacttacaaccttctgagttacatgctatattagttccattttatagatggagaaactgaggctcaaagagatgaagtaactgctatttaaatcagagagtaggatctgtgatcatttgatgctatctagtgaactgttcatgtggttttatcttattaaaagtgtgcttattgtagttacaccttttctaagtaagattttatacatcttagaacagcagttaacaacaaatggtaaaaagcatcctttcttgcttctttcttgttcagggggtagtgctagcttttggtagaaacagttatctacaaatgaccaggttataaattatcaaatatgggaacaaggctttatctgctccagaatatatatagataataatatagaatgcctcttcagcttgtgggaaaggaataaatgaaggagtgacataatctgttattaaagaatatgtaagagactcagtagcaaactaatgtgtctttctcttatgtaggaaaaacactctgcagtttcctttgggaaatccagaccccttttggaggcagaagtttgcctctcttaacttcatggggtgccccactcccaggagcagcctgctttggaaggtggcctccacttccagctttaagtaggtctggcatttgtctctttgttggctccatgacagacagatggagcttgattctaaaccgacctgctgggcttgggtatgaggctttcagacatgaaatcttgattaacagcaaatgttaattgaagcagtgaattattaaagtgtttttccataaatgataaatgctgttgttggctgttttacccttcgtgacatcataaaactttccaagaaattgctagctgtgaccaagaaaaacaggaagagatggcagcatttgatggtgttcacagtgatctgcttatgctctgtggccaggcccagctggggatgacacatctttttttttttctggaatcccacatcatctcaatgaaaccaacaaatcatctttccctcaaatgcagaactctctgcaagtgatctcatccagcctcctagcttcagcttgtaccaatagctgatgactctcaatctttacctcaaacccagattttctcctgagctccagacttacaaatactacaattattattgagcaacttcacctgatgtctaataggacctcaaactcatattcattcatctaacaaatgtttatcaagtacgtgtcttatgttctcagggtcactttattctaggtaccagggaaacaataatgaacaaaatagctgtagctccttatggaacttacattctagtggtgacaggaggagaaaaaataaagcagagaaagaggatcagggagtgctgagcattggtggtggttgtggtggtggcagtggtaggggtttgtatagggtgctcagagaatatcttgttagatgacatttgagcagagacttagaagaaattctagatagatctatgtttttaacataaaaagtaaaattatgaaatataccacaaatagattctctgtctttctcttcaatttcccccttttcctgcatttgaaatcttggggaatgtgttgtgcagtcattagagtcacatgcatgaggtcatcttcctcccccattctgatatttgtaagggaaggtatcctgtcacccatcctgaattcctgccagccccaagcaggaacttatgccctcacagaggtatcagatagggccttctgcctcttgtccatctttcgttggcttgctcccacgggagaagaagtgatggatctaatagaccagatggagaaaataatctactagtctagtttctcagcacttgtcaaactgtaatgtgtataagagtcagctggaggatcttcaagtgcagactctgacccagtgggtcttgtctggggtctaagattctgcattttgattaagctcccagataatgctgaggtggccactctgtggatcatactctcagtaacaagactcaatgggggtgcgagtcgacttcagttctccatgctaagtgctttctcagaagctccaactctcctcacctgtagggcccaacatatgagctacggagcaagtgttagggagtgcatttttatagcaaatccaagccagagacaccaatccagatttatcagattgaagctgatattttgatttctatttgacacttgtctgatccccagttggtctagaagtcaggagagagaggcttggtattatcatttctattttacagatggtggcttaatggcaagctgaacaactgggctaaagccaattgggagaaagtgcagactgggatttgaagcagatcagtctggcccttttacctgttgttttatactgtctccagttaaaatatcctgtcccacataatctgtcctccccacaatacgatcctgtctttctttgtatactgtagtcactatatcctgcttcatatcctcaacacctgtcctagcttccttgtccctttttactacttggccaccttctcatctatcaacatgaaatcaaggtctgttgcctttatgaagcttttcttcaatgcttcagcatgaactaggcctttcctatgtggctcctggtttactgtgtgcagaatttcgtatgttcttttgccataattattgtatttatttgttacttgacaatttcctctttctatcttttgaaagataggaatcatgcctgatttatcttttctccccagcactctgctcagggtgtgtatgttattaagtgctaaatatatactgaatgaatacttaatacttaggttggaacttagtggcttaatatttctgtgctcaatcttcctttttctgtctccttttcactcctgtgaagtttgtttgaagtgcctgtttccttctccactgtatgagcagaaatagagagagcaggatcaacatattattatgttagaaacccactcatcacgtgatgaggaacttgcacaaacttgtggtaaaataaaagttggataatattttttttgagatcgagtctggctctgtggccccggctggagtgcagtggtgcgatctcagctaactgcagcctccacctcccaggctcaagtgattttcctgcatcagcctcctgagtaggtggactacaggtacgcatcaccaagcccagctaatttttgtatttttagtagagacagggtttcaccgtgttggccaggctggtctcaaactcctgacctcgtgatctgcccacctcggcctcccaaagagttgggattacaggcatgagccaccgcacccggccataataaaatatttttatatcctgagaagtgcgtaatcaaacatttaactcaaaggtaagaagaaccagcttttttttttttttattaattagtgtatggtcttaagctagttacctaaattatctgagctttacttttcttatctgtaaattggtggcttggacatctatatcacagtattatcaaaagattagataaaacaatacatcttgaagagcagcagggctccaaaactgccagtctccttgcttgctcttattcattcagctaccgtgatctttaggctctcatcatacttgcctcttttttactttctgtctctcccatttccatacattttacatctgctcccatgtttcactctccacatgtaatattcatcccaatgctcttctgctctaaaatcctatcaccaagaagataaaatccaaagagccttataccaagcttctcctgtaatcttcccgcatatcctgacaccagttcctgctctgggcaaagtgggcagccactctttttgaaaataaaaattttttttttgtccctgggatatttctcacatgttccatctactaatggaatgaccggctagttatgaattcatatgcccaattatttaagaatccaaatcccctcctcaaaacataatgcaagtcttaatgcaaataccagattcaacgtgtgcttgcttatctgacctgtgtgtcccatttatatagtaattagtttttgcattttcctgttggaatagtactttttctgttgtttgaaaacaccctttaaattttgtctcaccatttttttctctcctaccggatggcaccaggcactatgggttactcaagaacagggactatgtcttgtattccacatagatttgtattctgatcactgcctaacatgcaactgatatttattcactccatattgagcagtttacactgtgccagtcactcagtacattaaaatcagtatcaagaggaggctcatgaagattcctcaatctagttatggagatagacaatacacaggtggaatgcactgaattagtggataaaaatggccatggattctttgcaactgttttcatcgaaaggtgaagtctattctcttgtctcttgaagctggctgctcttgtgatgtgatttttcaatggaatgtagcagaagccacattgtataactgtttgcagcatcttctctcatcccttgggacacttcaaccatgaaaacaagtcaacgccagcctcgctgaagatgatagaccatatggagtgggggcagcccagccttcccagctatctctctctagatgagtaaacccagccaaccatgtggagcagagattctgaattcaacccaaattaccgacccactgaatgatgagaaataaatgatcattattttgagtgactgatgtttgggaatggtttttggtacagtgcactaagtgatgtgatacattaatataataaaacccagcctactggggcagaggccagctagggaaaatctctagagatgatattttaccttaatattttatgagtagaagtttccagaatgaatagctaaagggggaacacatagtaggtacttaacaaaattgtgttgctttggttatcaaaaatactctaaataaaatttaagaaaaaatacaattatgtcatcatctcattcctacccacaatcagacatttaacaaagatgtaagttactggacaagtgaatggagacaaaaaaatattataagatgagttactactgtgaagcagctaacactttaagtgaaatacagcgcacataggcaaaaacaagataccaattcaaggcatatgtaataagtggaataggcagtggactagcaggtgggcagagggaggaatattaaagaaccaggtcccttaagagagcttcatagaagaggcagtatagggacaagattgtaaagtatagagagtgcataaaacagagaaaactgagttcgaaataggaagaaataggacattattcacaaaggaaaatgtcaagagcaaaacacggaggcaagcctatggctcatctggatcaggagcagacacttggaagtgcaagtgtaaggggatggttttgtaaaggtagttaaggaccttatagtaattggtcttgaatgccatagtaagaaaatgttggctgggagtggtggctcacgcctgtaatcccagcactttgggaggccgaggtgggcaaaacatgaggtcaggagatcaagaccatcctggctaacatggtgaaaccccgtctctactaaaaatacaaaaaattagctgggcgtggtggcgggcgcctgtagtcccagctactcgggaggctgaggcaggagaatggcatgaacccgggaggcggagcttgcagtgagccgagatcgcgccactgcactccagcctgggtgacagagcaagactccatctcaaaaaaaaaaaaaaagaaaaaagaaaattttattttattttattttgagtaaatgggagccattaaagactttttaatgtggtgaaaaaccaacctcaaagtcttcctggtggcagcaacactgagacttttctcctgaagcccagaggctactttccaaatatccagtctgcttttttcctaaatttttgtgatcaaatttggtttaggaaagtattaggaaattccccatatatgtggatctggagtttgggcatattccaatacagaaagtggtatgctagcatacctacttgtcatttgagaaatggctgaatttggtataatagatcttgcttttccagtccatatctggcttttcaggctcacccgctggctcttcagtatacatggagcatgtcaagtcaataatgagcccaacagtgccccatattctcctataaacttggtggcaatataaataggagatggtaaagaactattcttcattctacaaatatctcttgatgtcatgtctgggctaagtatttgggattagaaaagtcatataagacactgttgcacccctttttgacccactagtgaaagcaaatacatcaaaatatatcatgcaagataccataatgagtgatatggattggctcgctcagcttcagttttcttcttcctgctgagccttgctgtttgcaaaggctgaaaagttaaagccttaatttcctagattccttttcagctagggttctggttataaatttggttccaccaattgaatgaatccacacatgatttgaaaggacaaatttctttccctttgataattttttgttggcaagcgaggtcctggggactgcagttttctgctgcaacatctagaggctcatctaccaactttatgactgtcaagaggcaatttcagctgttgtgtcagcaacgttccaactctgactttctgatagggtcgtggttaggatgtgtgctcttgtactaagctcagttctgtagtgttctgagtcatttcaagagacccaggctagaaaccttgtaacagttttataaacatctaattccctgtattaaattttctgcccaaattactaagagtggtttctgttttctgcactgagcatttacagattgtataaaaggtgtataaacaaaataatgagagtttagccaagtgtgtgactaattctgcttgggggagttggagaagtttccatgtaggaaatgataatatcatgtatctttaaagatgagtagtaattattattcaacagtcagctaaggatggaaagggcagtctaggcattgaaaacatctggtgtagaagcacagaggtgtttaagagaatagtgttagagaatgataaatagactattgaatttccactgacatttccaggccatttttagtactttattttaacaatagagttttacctcagtgtttctgcataaagcgtcaattcattattctttattttgcttttcatatcataagtagcatgtacctatatttatatacatatacatctatattagatatatgagtataattaacatatatctttcccacgttcagtcaccagcacagtagagagatgtcagggagtagtatactagagtggttagaatatgggcttgagagtcagactgatgttactttctgccattattaacttgtttttgtgaatgatttcaacactttctggttattaaaaaatatgccaagggagttcttgtagtgccacaaaatttccaaggaaaatttttatgccaattttaaaatgtaaagttgacagtggttcaaggcatttgatgtaatggacaagacaacagaaggtaaatatcagtagaaattggtggaaatcttttgacatttccaagaaaatgttccttgcactaagtataggctatgcctatcctttcatttaaaatttatactatttacacttccctcttctcatccctgtacatctcctacattccatgagatcttttggatctgacgttttgttgtctattttcttggaagtgatagtgttcactcagtaagcttcagagttgtttgtagcagagtctctatgtcactgtccatagtgccattcaggtgtgccaaacagttattagtctgcagtaatgtttacaataccctttaaaatgtcattggttgccagaggttcagggaagaggaccattgaataaatgaaagacagggatttttttagagtggttaaactattttataatatataatactgtaatggtggatacatgacactacgtatttatcaaaacctatagaacattagaaaagtagagtgaactttagtgtttgcaaattttaaaagtcatttagaaggtcagggatttcaatgcagacagtggcagaagaatctaattgtattacaattatgttgtatgaaaccgtcttactgaagggagcgggaaagtggcagaaaaagatgctgacaaataattttgaaaatgaatgaagtctctaataataaagacaaaggaatataagcatcatcctctcattgataatttgatgcccatggggatatggattaataattctgaaaccactatatgtgtaaaccgaaatggaacaattaagtacatggatggcagatggtgtgagccaggtttctcactgctggaagttagacaagcaaggggagtaagctagaattgtccatgtggtaatggatttgagtcacagatatcagtatgaatgcatgtttagcttaatatacatacagatgattatatacagaaataattatatattatatataggattacatctagaatatacatttatataaatattataaagaaataattatagacatgtgtatatataagttagtatacacacatgtatttccttactctgtcatctgaaaggtcctagaagcaacaacaccctaatagcaatgagcatacttagcacccagatcttactttccaataccattctccaacaagaggaactatggattcttagaaaaatgaatgtttctgggactggggttggaaatagtcaatatgaactgggaggatcttatgccagaaaggaagtgcccaaatacacatgcacacatacacagacacatgcacacatcaaaagaacagagaagccagctgagcaataaaataaataaaatagtattggattataagccaaagtataaaataaatattcatgagtccgcactaatatgaatataaataagtaactgaatatgtaactaaacgatggaggagagacaaacctcccatgatgaagaattccaaataattcatttagacatctgcccttaagaaggtggagcataactcaccaccccactagtgtgggctccatctatgacttcctccaaaacagcatagcatggaaagcgggaaaagaaaataactttcagtggagaaacccgacaaacactacctcatctaagtgatcaacagcagcactgataaatcacgttgatagtatgcacctctgaaatgatgtgatagggatgccgcttttccttcctgatctgcttcccagaaatccatagccctagtcaaattgtcagaaaaatatcagacacattctcactgagggacagtctacagaatacgtgaccagtactcttcaaaactgtcaagggtcatcaaaaacaagcaagatctgagaaactgtcacagctgagaggagcctcaagagacctataactgagtttagtgtggtattccagatgtgttcctgagacagaaaaatgacatgaagttaaaaacgagggaaatctggataaattatggactttagttaataatgtatcaatttttaaaattaattgtgacaaatgtatcatattaatgtaagttgttaattatagcggaaactgggtgtggagatatatgggaactctgtactatcttcacaaatttaataactattttaaaataaaaattttatttaaaaagtaaacacacacatccatacacatacattcgtgtgcacacacacataggcacagtcaaaattaaaagaattttattagcccaatatggaacaatctgagaatcaaaagaataattattacaatagtttgaaacatactaaatatacagaaatccatgagtttataataatatttcaaaggaaaaaaaccagggtcaaccagggcatcaactcctaatgctgaaaagtagtaataaaagagaaagaattaaacatttattgggcgcagtggttcacgcctgtaaccccagcactttaggaggccgaggcaggtggatcacctgagctcaggagttcatgaccagcctagacaacatggtgaaaccccgtctctactaaaaatacaaaaaattagccacgcgtggtggcaggcgcctgtaatcccagctactcaggaggcggaggcaggagaatcacttgaacccgggaggcggaggttgcagtgagccaagatcgcgccattgcactccagcctgggcaacaagagtgaaactttgtctcaaaaacaaacaaacaaacaaaaaacaacaacaaaaaaatttattttgccttttttatgcaaatcccgtttcaaggtatccaaacagccatagctaataagggaaagttcctgaagaattatagataataagttaggaaacaataatagaattagaaaaataagtattttgcaacccctaatgaaataacttatagataaaactattaaataaaagataaatgggtaactttacaatacagaggccaggttgtcaccatctaaaactacaggtcagtcttagacaagcagacattgtgagcttcctcatgtgaaactgaagctatactatttataaaggattcttgctctcccttcccaaattaaacctgaatctactcaagcctaactccaatgtacaggaagcaggcaaagagaagaacagattaaatgacactataaggaagcaaatagatttatccagaatgtggacattcaacaggacaagttacatggtttcgtcaacaaattagataattttttttaaaagaaggaaagattgcttaagattaaaagacttttaggaggtatgataatcaaactcaatgtgtagactatgtttgaattctgactcaaaatcaactgaaaagatagttttgagacaattggggaagtttgaatatggatttgggtattagataatatcaaagaattactgaaattttgttcatttaataatggcattgttcttgtgtaagaaaatatacttttaaaacactatacctacttaagcaactgaagctatgcaatttgctttaaaatgcattttcaccacaagttaaaagaaatagatgaagcaagtagagtgaattttgatgaccattgaatgtggatgatggttatatgggagctgataacaatattccaatattcttcctattttgtgactattagagaatttttattacacttcgtaaaggtaagtgaaaattttaaatatagatatatacataaatacatatatagatatatatatacacacacatatatatacacacacatgtatatacacacacatacatacctgtggtgttgcaggttgcattcactggaaagtagatgctgcgatggagtttaccaaacaggatgtttattaaggagtatccttagaatcaacacccatggaagagaggcaaaggaagaaaacaggaatatatagaggggaaagtcaagctgcaatgcagacccaacctcagtgagactcgggagcacaatggccctttaaagttgtcccaagttgggtctagatggccaagactttacactcctgcatcagtgagtcactggatgtgggccagcccaggaaggagtaaaacactgggaaaggcagctctctgcaatctctaaaggggctggcagctgaaggctgtgactgacagcactccaagcagctggtgcagcaagttcatcattgggtctaccaccagatctcacagatatgagaggcaaagttagccaggatctataaccaggggtgtctggatgtcgaaagaagaataataggacggatccaagatcaggcaggccccagagtccagggaggcacgcaagaggaggagctggcagaaagccaaagaggcaaataagagaggcttcccagtgcctcaggattagagagctttgcaactgtagcaaatgtgtagcctagccagaaattttccacccaaaaagccaagagcaagtgaccattaagcaatggatggaggaaggaagaagcagtaactaagctttgaaagacatgagcttggagttctgtaacttggagaagaatctatgcttagcctgcttagtagtaatactaaccattgcttgacaggggaaaatgctttagttaatgcagaagcctctttaagtgtgaatgtttaggtaaacctgagatacctcccacacatagaggggtgcagtagcaaactctccagtccattgtgccttcttgttctttgccagtgaaatccatcattgctaaaatccgaggggagcctcatctcatgtacactgcttattcctggattcatacaggcatgtggtgtgactagccatttgaccatttccatctttcctttatactgttctgtatgaaacttccatttctagtgtaaatctggaatgtccataactggttttgtggattttttccccattcccataattagtgaaaaagatgaaaatttttctagtttttcccctacttcttacctctaatattattaaatcttgccaattctctttgttaaataactctcaagcttatcacctcatctcaattcccatgacacacagtactcctgcctaagttcaggttattattacttattgggtaaatttttaaaatagatggctatttctttcccctttatacttcgattgcatgattatcatggaagtcttgcttcacggtctgtggagatacttgtctactcatctatttactcgtattcccacaagaagaaaagtttaaaaatagagaaattaatcaaacctatcaatcaaaaagagttggcataggcaatggtcttgttcaaaataaagcagtacttgtcttttttttaaagcaaacaaatatagactgtgtgtagctgtcaacgtgaaacagagccaggcagtagttaaagctatcaaaacagattttattcaggaactattgcaatagggtaatagagatattagtctagaactgggcccaattccaaatacgacaaagagagctggagatttacagccaacgagcaaaatgaaggggtcaatggatgaaaaattactgaggagacatacagaggagggggattcctgccaaatcaacaagattcttgctgaagacaggccagggtgatgagatattaaggatcaggggatgaggaatttgatcaggtattgatgggggatcagatttcaagggtgggagactgtctgtacattaccttagcagaattgtttgctcaaactgggttaggcaggcccagaaggatgggggccaagatcgaggccttgtcatgaagagggctcagaggagcctgactaaattttgatcaaagaggaagtctttgtcagcaaatgaattgtcaataatgaagatcatattgatatttgataaattacccataaatgaagaaatctgaatctcaggagaatgaagatcaatactttaattggcccatttcagatgtagattgttttaggctaacttttgaagtgactaaagcatattagtcacacctaatgccactttttatttgtaaaaaatcctttttgcaaaaattccaaacttgttttcttgacctataaaatgcatgaaaatctttgccttaagtatcttctcacactcctttccttcatctcctccacacgttttgtgaattgcaggcaagctagactggttgtgatctttttcctatatgtgatatttcttaagtctaaaactttactcaagatgttctctctttctaccatggccttctcaactttgtaaactcttgtattatctttcaagacacacatcagtgtcacctcttcccaaaagatttctcttgcctttctagtagggtttaagtgtgccttcctctgtcctccactagggtcctgcctgtacagcagttatagcatttgtaatattgcactgcagttactactttacatgtttactgtccccaagtgacagtaatcctgtttcagtgaggcagtgatactgtttcagtcatcattgtgtacccaacacccacttcagtgcctggcaccaagtagctgctgaatagatattggttgattgaacgaatggatacctgaataaaagaacaaggattctgtagctggttgacttacctaacatttggcagtcagtagaaagaattgttaaaaaaaatcaaaatctcaagtttctccgtgtagcaaggaagagatatttgccattgttattcatgggcagctctagaaaatggcagaatcacagacaaaaattggcaagctgccagacattaatctcagtgaatttctgaaagacattcatatgccctaaacaaattccttcaagctgtttctatgtactgtgtaggtctcataactcagaattgtatctcctcaagcacctaaaccattatgttgtagggacaatgagaaaaaaggatatgcaatagaactggggtaagccttttcacagcggctagaacacaaagcaaggatttcccaaataatctgtcctcaaacagctccttttattctcccagggacccaggcagctgactaacaagatagtatctgccatcccaaattaaggtctaaaagcagagcccagggaaagagggaagagagcattcttaggtaagcagcaggtgtgaacagcacaaaaaccaggatcagtgtaaaatttggctacaaatcaacaaataagcaccacatacaaaattatagatgtaaagatacatacgaacatattttccagaaagtagataaaaattttggaaaacaactattttgtatgctaaagaaaattaaagacattacatactctgtaataatcgagactcaaaaaaagagatcctaaaactctagataacagtaatataacacattctctcagatatataaggatacttataatattatttgttatactttaagttctgggatacatgtgcagaacgtgcagttttgttacttggtatacgtgtgccacggtggtttgctgcacccatccacccatcatctaggttttaagccccacatgcattaggtatttgtcctaatgctctccctccccttccccccacctcctgacaggccccggtgtgtgatgtttccctccctgtgcccatgtgttctcattgttcaactccacttatgagtgagaacatgtggtgtttggttttctgttcctataatattattttttaaaaaatccttctgatgttggcattaaaaattattggtgttcttttcttattttggtttatgccatttttgttagaaactttcttcaagtatctggtgatccttggctaccatttatgtttggcgtgagatagtataatgccggttggaagctttgtgttcataggagtattgtaaacagctgatcttttctattgggtaaatactaagtgcaaatctattttatttgaggaccacaaagtgtcaatatccacatgttttatcttggtcagatgtttgccccataagttaatcccccaatttcctgtgtatgtatatagttcggggcaattctgactgtcaccaatttagaagctgagagggcaaaggagggttaaaacgtgcttatttaatttcttcctctagtttacactgccttattctagctcttatatgtgcttgttgtctccatactaaatccctccagtttatcttctctacataattaactttcaatcttctgctggggtggagggtcagacaataatctgtagaaggtcaaggagaggatgtggacacttaattacttcttttatggaattttttctgtcgttatttttcaaggccctatggaacaccaccaaggtactccaattctagaacctttctgaagtttaggggtgtgagtcagtctacttatgggactctaccttttctgtttttggttgcagcactctttttccaattggcaaaattgtttgcatttgtctatttgttttccaactccccagtttcattactatcacctccaatcctttattctttctccttgagatttttattcctcttccataattgggggtaaggcatagaagagagggcactgggtgcatttaggcaatctgccattaggaagtcctaatccatgtttgctcccaactttttattttgaaaaacttcacacatacacaaaagttgaaatagaacagaaaacactcgtacacccttcacccagatttaccaattgttccaattgttagattttaccataattgctttcactcggtttctgtctgtttgtctccctatctggctaaattttggatgatttgagcatcaaaaaagtaaataaataaaatcataatctatttttgctgactcatttgaaattaagttgcagttaccgtaaactattcttcaaaatatatacacaaccttaagtccctgagggattaaaaaaacacaaatcctcctgtccgggcacagtgactcatgcctgtaatcccagcactttgggaggccaaggcgggtggatcacgaagtcaggaatacaagaccagcctgaccaacatggtgaaaccctatctctactaaaaatacaaaaattagccaggcgtggtggtgtgcacctgtaatcccagctactcaggaggctgaggcaggagaattgcttgaacccgggaggtggtggttgcagtgagccgagattgcgccactgtactccagcctgggtgacagagcgagactccatctcagaaattaaaaaaaaaaaaaaaaagaaatactcctacataagcacaatatcattctcacacttaaaaaaatagcatcatctaatatccagttcatattaaaatatcctccactgtcacaaaagttttttgtatctatttttgtttgtttgtttagatgaaggatctagttaaagatagcatagtgcatttggatgctgtatctctttagtcattttcaatctaaaacagctctgctaatttgttggagtttgtagaaagtccacattctggagtaggttgattgttttctcatggtgccattaaacttgttcttttatccctaagtttcctgcaaactgaaagacagatctgaggcttgatttgattcatgttaaaccatacacttcacaggtgaaattgtattcttcttactgcattttatcaccaggcacataaggtcaggtcgtctcagtcttagtgctaagtttaatgatgtgattaaatcaatgaacatgagatctggtagaagccaacggttttcctttgagttagtaattgatctgtggggtgatacttttagacgatgtgaatctcatgctccccagtcaccatctgcctagtagtcattttttaaaaaataatctcagcttttattttagtttcaggaggtacatgtgtactcatttgttacatgggtatattgcgtgatgctgaggtttggggtacagatcccatcagtcaggtagtgagcatagtacttgataggtagtttttcaacccacaactcttccttccgtcctgtctctagtagttcccagagtctgttgttcccatctttatgtccatttgtactcagtgtttagctcccacttataagtgagaacatgtagtatttggttttctgttcctgcattaattcacttaggatatgacctccagcttcattcatgttgctgcaaaggacatgatttcattcttctttatggctgcatagcattccatggtgtacatgtaccaaattttctttatccagtccaccactgatgggcacctaggttgattccatgtctttgctattgtgaatagtgctgtgatgaacatatgcatgcatgtatctttttgttacaacaatttatattcctttgggtatatacccagtaatgggattgctgggtcgaatggtagctgtttcaagtttttgagaaatctccaaactgcttttcacagtggctgaatgaatttacattcccaccaacagtggataagtgttctcttttctccacagcctcaccagtatctgttattttttgactttttaataatagccactctgcatctagtcattttagaatcaatccataatccttgactgaatcaattttgaaactgtggttgcaaatggtagtttgctaattctatccatccttttacatttactcactagcatttcttccctagagaagagctttccctttttactttagctgtgtgtatagatgtatcattacagactcagaatttatttaaatatttttatttattaaaaatcaactgttattaacattttcatgattttttatgttcaaattctctaaaatgtggatagtgaaaagtggaagtcccttcaaatttgctcctgtgtccttttggcaccactccattactcattgagcaccttcttgttttcttatattatacaatatcctaaattaaccttgtatttttcctgtactagacttggaatcatccatttctccaagaagcctttattcctcaaagtgggaaatggtatttagcaaccaaaatgtatgctttaggcatttgtttattgttgtttagagtagtattgcttctcagcatttttaaaggacagaacaaggaacaaatatagaaaattatgacttcatactaatattcccaatgaagattgaccatattagacattttattgtgttcacttatatcatattttgtctttttcttacagtgaaaatcttggtacctacctatttactttattctacaatatacataaaactatttcagaattataataccaatattactaacaataaactataataaatacttcaagatttctttgcagttcattttgtcctcagaatagatgctactaaagatgtaaggacagtgttaatttaaaataattttactttcttgtgttatgtcatcaatttatatatggttagacacgtgtttatattctgttttaggtgttttgtttttaaatccttgttattttgtttaattttttgaatatataaagcatatacattactcaaaaatcaaaactatatgaaaatgtgtactcagataaaggtaaactataagaaaaggtatagtcagatagaggcatattcatgtttttgctcctaattttatccgctccccctactcccacacacttcaggtagccatataaggcaaccacccaatttaggtaatcgttatcattagtctctgattcatccttcttgagtttctttttgcaaaaatgatcatatgttttatttttgttttcccttctttttttacacaaaagaaagcattctatctatatactcttttgtacccttttttctacttatctgtggaaattaaaaatggaaattactggccgggcacggtggctcacgcctgtgatcccagcactttgggagtccaaggcaggtgaatcacttgaggtcaggagttcaagataagcctgaccaacatgctgaaacccctactaaaaatacaaaaattagctgggtgtggtgatacacgcctgtgatcccagctacttgggaggttgaggcaggagaattgcttgaacccaggcggcagatgttgcagtgagctgagatggcgccactgcactccagcctgggcgacagagcgagacactgtctcaaacaaacaaacaaacaaacaaaccaaaaaaaggaaattacttcatatcaattcatagaattcttcttaattatttttacagctgccatagtacttcattaggtggatgcagtttatttaaatatgctcctactaataggaatttgtgttgccccgcatttcaatagattttactattataaatcatgctgcgataaaaaaccttgtgcatatgttgtttcatatttgtggaaatgtatcttcaaggtaaattctagaactaggatttgctcagtcaaaggataaatgcctaagtatttctttagtcctctccacagggagctaatcaacttttaagaacatctaaacttactacctgactacttacatccaatcttgacgcctgtttgaaaagaactgtttttaaaaattcaactattgtggaagacagtgtggtgattcctcaaggatccagaactagaaataccatttgacccagcaatcccattactccatatatacccaaaggattataaatcattctactataaagacacatgcacacatatgtttattgcagcattattcaccatagcaaagtcttggaaccaacccaaatgtccatcaatgatagactggataaagaaaatgtgtcacatatacaccgtggaatactatgcagttccatagttcatgtcctttgcagggacatggatgaagctggaaaccatcattctcagcaaactaacacaagaacagaaaatcaaacaccgcatgttctcattcataagtgggagttgaacaatgagaacacatggacacagggagggagcatcacacaccggggcctgccggcgggtgagtggctaggggagggatagcattaggaaaaatacctaatgtaggtgacgggttgatggatgcagcaaaccaccatggcacgtgtatacctatgtaacaaaactgcacattctgcacatgtaccccagaacttaaagtataataataaaaaaaaattttttgcacgaccatctggagaactagagtttcattttattttcttttactgtttagtccttttacttttaacacttacctgcatttaatcttccttgtaatttcctgataatcttaataccttttatggctttttttctcagaccttatagttactgtagtttgttttctacttcacaattgtcccttgttagcccacccatgcatgttaagatgttgcccacttatctcttcaatgtatactctctgtaaaaccagctcaatcaatcatcatagtatttgccagaggcagggaattttctgttattgtggtttggaagtgttttcttttttccttcaaagggaacagcaacttagcaagataattgatctgtggtaagaaaacataccccataagtgctctataaggattttcccagactcttcagccctctaatctttaggttgtgaaagtgaagattttcttttttcaccacctttggatgttaggtctcctctccttctatctgcatgtagttcgatttctttaaatttgtaatctgagaagttaagtaacatatctgtgactctctgtctcccttccatgctaatgatggaagacatgttcgatctctctcaaactcgaggatacatgttttttatcaattcaggaaaattgctttaggttaatttcttagttttgtaattgtttaattttttcacatctcttttggcaccacaattatgcacaggttggatttgcatctgtgacactccttaggttttatgttcagctggttgtgtacagttgccatctattctagttgtagcacccatcttgattggttagtacccatttcatcagttgaacgcatttctaaatatcttcctggtatgataacctttcaccagtctgtgagccagtgccagtcccagatgaagtttgcacttatctttggctaattgaaaaaattgggataataaaattagtttgtaataaagataagtgtcttcgacttacaaaactcatctttattctgagtctctatatcatccctaaattttttattacaaagtattctttgtcttatgaaaaaatgataatggtagtgtttttttttctttaacattcttacttggctcaaagaaagataacactaagttagtcttcaaattttaaaaaaagagaaaaatttgtaaaatataagaatctggaaacaggaatctttgtcatttctttctaagttaatgtctaggctggcctgttagtttatgaatccatctgcatcatttctctaggaaagatatttgaaatttaacttttgagttcttaattatttttgtcctatttgctgtttctagaatgtttatgatattttgtttttagccaaactgttcagttcttgtatactttcatagttgatgttgtctaaaccatgtttctctggtcacaaaggccaagtaacatattaaaagtaataaacaaaatctactaataaactagatttttctggctgtggtccttacttaccataaggtatttcccattctgcaaattctctttcagttgtttctggaagtctccaatgatcatcccacatatgtgttatgtctcttaggtcctctaattacacctctgtagcccacattgctaatgaatgtgctttgttgtcatcaatgacaccagtgctcactcttgtggataggatatctggacagtgatgctgtgttctcttactccaatagaagaggtcagtaaatactggaaatatcggagcaatattttattacctgtagataatttctgtgtagttagaaaatctcaaagaattggcaagagctaacagcattaattttttactaaagaagatatatcacttccaagacaaaaacaaatcattaatatttgaatgtattaatagtaaatacagagaggaggcagagcaagattgtgaaatagaaagctccagtagtcatggctcccatcctctgcaatgacacccagttaacaactatctacaccgaagcaaaaatcaggcgagcattcgtagtacctgcttttaacttcttattgcggaaaggggcactgaagtgatagaaaaacaaagcagccctgaatccccacccaaccccgacactgactgcatggcagcttggtgcagggagcatctctgggtgctgagggagggagaatacaattgtgaggcactgaactcaatgctatcctgttagagaagaaagcaaaaccagaccaaactcaactgatacccacccacagagggagcatttaaaacagccctagccagaggggaattgccaatcccaggggtcagaactcgcatgcctgcaatcctaaacctcagcaccaaagattacagcattctgtctccaagtaaacttgaaaggcattctaggtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaatatgtatattctgttgatttggggtggagagttctgtagatgtctattaggtccacttggtgcagagctgagttcaattcctgaatatccttgttaaccttctgtctcgttgatctgtctaatgttgacagtggggtgttaaagtctcccactattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactagtattgcaacccctgcctttttttgttttccatttgcttggtagatcttcctccatccttttattttgagcttatgtgtgtctctgcacgtgagatgggtttaaaccgctcaactacatggaaactgaataacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcataactgaaagaaatagagacacaaaaaacccttcaaaaaattaatgaatccaggagctggttttttgaaaggatcaacaaaattgatagaccgctagcgagactaataaagaagaaaagagagaagaatcaaatagacgcaataaaaaacgataaaggggatatcaccaccgatcccacagaaatacaaactaccatcagagaatactacaaacacctctacacaaataaactagaaaatctagaagaaatggataaattctttgacacatacaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaattcattttatgaggccagcaacatcctgataccaaagctgggcagagacacaagcaaaaaagagaattttagaccaatatccttgatgaacattgatgcaaaaatcctcaataaaatactggcaaaccgaatccagcagtacatcagaaagcttatccaccatgatcaaggggcttcatccctgggatgcaaggttggttcaatatacgcaaatcaataaatggaatccagcatataaacagaaccaaagacaaaaaccacatgattatctcaatagatgcagaaaaagcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtcccagtttgcagatgacatgattgtatatctagaaaaccccattgtctcagcccgaaatctccttaagctgataagaaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaccttacaagggacgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaaactgacaaaaacaagcaatggggaaaggattccctatttaataaatggtgctgggaaaactggctagccatatgtagaaagctgaaactggatcccttccttacaccttatacaaaaattaattcaagatggatggaagacttaaatgttagacctaaaaccataaaaaccctagaagaaaacctaggcattaccatttaggacataggcatgggcaaggacttcatgtctaaaacaccaaaagcaatggtaacaaaagccaaaattgacaaatgggatctaattaaactaaagagcttctgcacagcaaaagaaactaccatcagagtgaacaggcaacccacaaaatgggagaaaattttcgcaacctactcatctgacaaagggctaatatccagaatctacaatgaactccaacaaatttacaagaaaaaaacaaacaaccccatccaaaagtgcacgaaggacatgaacagacacttctcaaaagaagacatttatgcagccaaaaaacatgaaaaaatgctcaccatcactggccttcagagaaatgcaactcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccttttgacccagccatcccattactgggtatatacccaaaggactataaatcatgctgctgtaaagacacatgcacatgtatgtttattgtggcactattcacaatagcaaagacttggaaccaacctaaatgtccaacaatgatagactggattaagaaaatgtggcacatatacaccatggaatactatgcagccatgaaaaatgatgagttcatgtcctttgtagggacatggatgaaattggaatcatcattctcagtaaactattgcaagaacaaaaaaccaaacaccgcatattctcactcagaggtggcaattgaacaatgagaacacatggacacaggaaggggaacatcacactctggggactgttgtggggtgggggaaggggggagggatagcattaggagatatacctaatgctaaaggacaatgggtgcagcaccccagcatggcacatgtatacatatgtaactaacctgcacattgtgcacatgtaccctaaaacttaaagtataataataataaaataaaaaaaagaatgatacaattgtaacaaagctgcacattctgcacatgtatcccagaacataaagtataataaataaattttaaaaagaaaaaagaaaaaaaaaagaaaggcattctaggccataaggtctgtaacccttaagtgagtcctggtgctgaactaggctcagagacagtggactagaggggtacacaacaccagctggggtggctgagggagtactggcatcaccccttccgtaatcccagaaggcacagctcacaggtccaaaagagacctttttcttctacttgaagagaagagagggaagagtggggaggactttgtcttacatctaagataccaactcagccacagcaggatagggcagtgttcagaatcgtgaggcccctttccaggccctagctcctagatgacatttctagacacaccctggaccagtagacaagccacttccttgaaggaaatgacccagtcctggcagcattcagtgactaactgaagagcccttgggccctgaataaccagcagtgatgcccaggtattacaagagggccttggataagcctctgagacttgctggcttcaggtgagactcagcacattaccagatataagggatatggggcaaaacccttctgcatgagaaaagcagagggaaaaataaagggtgattttgtcttgcatcttaggtaccagcttggccatggttgagtagagcacaagcaggctcttggggtccgtgattctaggacttgactcttggatggcatttctggaccttccctgggtcagagggtagcccaatgccttgaagggtgaatcccaggccaggcaccatttacgactagctgacttaagaggctttgggccttatgggaacactgccggtagtctggcagtactccttgtggcctgggatggcaatggatatggggtcagactcccctgcctttggaaagaagagggaatactgggaaggactacatattgtggtttgagtgccagctcagccacaatgcaataaaacaccaggtagactttaaaggtttttgattctagttcctgactcctggacagcactcctggatacctctggggcttgggggagcttgccatcctgaagggaaggacgcaagcctggctggcttagccacctgctgattatagagccccagggccttgagtgaacataggcagtggccagggagttgttacagcaggccttgggcaagacccaatgctacatgggcttcaggtctgacccagcactgtcatagcggtggtggctacaggggtgcttgtgtctcttcacccccagctttaggtggctcagaaaagagagagagagagagaaagattctatatgtttggaagaaagtaaggaaagggaacaagagtctctgtctggtaatccagagaatcctcctggatcttgtccatgaccatcaaggcagtacctctacaagtctgcaagaaccacagtgttactgggcttggggtgcccgattacaacacccaggtcctttcaaatatctggaaagccttcccaagaaagacaactacaaataagtccagacagtaaagactacaataaatacctaactgtttgatgcctaaacactaaagcacatctactagcatcaacaccatccagaaaaacatgaccttaccaaatgaactaagtaaggcaccagggactaatcttggagaaacagagatatgtgatctttcaaaaacagaattcaaaatagtggtgttgaggaaactaaaataataataataataaaactcaagataacacagataacacagaggaggaactcagaattctattagataaatttaacaaatagattgaaataattaaaaagaatcaagcagaaattctagaactgaaaaatgcaattggcatactgaagaatgcattagagtctcttaatagcagaatggattatgcagaagaaagtaagcttgaagacagtttatttgaaaatacatggtcagaggagacacaaggaaaaattcaaacaacaaaacacacctacaggatctagaaaataacctctaaagggcaaatctaagagtaattggccctaaagaggaggcagagaaagagaggtagaaagtttattcaaagggataatagagaatttaccaaatctggagaaagatgtcaatattcaattataagaagatcatggaacagcaagcagatttctcccaaagaagactacctcaaggcatttaatcattaaactccaaaaggtcaaagataaagaaaggatcctaaaagcaacaagagaaaagaaacaggtaacatacaatggagctcctatatgtctggcagcagacttttcagtggaaaccacacagaccaggagagagtggcatgacatatttaaagtcatgcctagaatagtatatccagtgaaaatatcctgcaaacatgaaggaaaataaagactttcccagacaaacaaaagatgagggattccatcagtaccagacctgtcctacaagaaatactacagggggtatttcagtcagaaagaaaaggacattaatgagcaataaaagaatgacctgaaggtacaaaactcactggtaatagtaagtacgcagaaaaacaaagaatattataacactgtaactgcagtgtataaactactcttatcctaagtagaaagacttaactatgaagcaatcaaaaatgataactacaacaacatttcaagacatagttagtacaataggatataaatagaaacaataaaaagttaaaatgccaggggatggagttaaggcatagagtttgtattagttttctttttgtttgtttgtttatgcaaatagtgtttttatcaggttgaaataagtcattataagatagtatttgcaagcctcatgggaacctcaagccaaaaaacacaatggatacacaaaaaataaaaagcaagacgctaattcatattaccggagactgtcacctttaccagaggaggataggaaggaaagaaagaaggaagacaagaccataaaacaaccagaaaacaaaccattacatgaaagacacagaaaggcagacattacatgttctcacttatttgtgggatctaaaaatcaaaacaattgaactcatagacatagagagtagaaagatggttaccagaggctgagaagtatagtgggggactgtgggggaggtggggatggttaatggctacaaagaaaaaaaaagaagagagagaatgagtaagacctactacttgatagaacaacagggtgactatagtccataataacttaattgtacatttttaaagaacttagagattgtaattggattgtttgtaacacaatgggtaagtgtttgaggggatggataaaataataataattagaaataaagggtctgaacaggaaaggtcctccctcaatataacaaacacacaaggcattgggataaaataacccacagtttcatgaaaataataaaacctgataaatataaataaaagttttgagcagatatagcaaagtacattaatagatgggagaatgaccatctgctaattttgactggagttctaggatctagagctggaaagaggaaacaggaaaggctagcaaacagttcaatataatagaatcagagtaatagggaaaaaataacacctaacagagaacacaagctggcaaccagggaaattatcaaaagaatgtgaccaataataataataaagcagtaaagaaaagagaacaaagttcaaagccaaagttctactttgaagagaattcaagcaagcaagggaagggagaggaggagggcaggcgtgcatggtggggtgggtagaacctggagtttcctatgaatgctgattcaaatcctcttttatatgcagttggcagttacatccacaggtgttacagatgccaaactattcaataataattttccaatagctaatttagaagtcacatacaatgctgattaacactccaacaagattttaatcttagaaagcagcaaaatgcttcgcaatttcatatgaataatgaagatgtcacataatcacagaacttacaaagcagctgtgcaggggtctgtcctaccagtgttataacatgggcagtgctaaaatgctgggctactgagtctactatagaataaagagatcactggaacagaatagaactctaaatgctatattataaagtaatcagtatcacaaaagaattctaaaggcaaaaccattcattaaatagcaacttgatacctggatgataattcaaaaaaaaacagtaatttaaatccaacacatgctaaatttagatgtcataaaaatgaatttcaaaagaataagtgagtaaaaatttaatgaaataaaataatagactacccagatgaaaatcattcaggtattagcatgtacagtatccttttcaaaatttaagtcataaaatacaacaagctcaagataccacttcttatgtggacctttctgtgactgctctgcctctgattctgctcttccccctttatgtggttcttaactgcatgcttacttctctggacttcttaaagaattcatataaaacaccaaatatatgtaacaataaatataaatatttaaaatcagctgtatagtgtttctatttgtgaggaaaactataaatgtgtgtgtgtgtgtgtacacctgcctttatatgcatgggagaaaaaggatcatacctgagaaattacaattatgttcttctctggagagtggtgttactctagaacagtgatcctcaatttgtttttaactcctttagacccttaaaaattattgaggaccccaaggagctttgtttatgtgagttatatctatagaggtttactatatcagattttaaaactgagtaacagtacctaacagtctttaaaaaagacttatctatggtgttttaaaattattgttattcattgacacaataataataatatgtacatttttatatggtacagtgtgatattttgatatatgtataccatgtgtaatgatcagataagggtaattcacatatccagaacctcagatatttcacatttttctgtggtgagaacattgaaaatctgctcttctagctatttaaaaatacacagtaaattttttttagtatagtcaccctataatgctgtagaacactagaacttattcctcctatcaagctatattttggatttgttaacaaccctctggctattatcccattcccagcatctagtaaccgctattctaccctctacttttatgagatcatctttttttagctttcacatatgagtgaaaacatgccgtatttatctttctgtgcctagcttatttcacttaacataatgtcctttaagcttacttatgttgccacaaatgacacaatttcattcttttcgtggctaattagtatttcattatgtatatattccacatttcttttgtccattcatctgttgatggacacttaggttgattccatatcgtggctattgtgaactgtgctgtgataaacctgagagtgtagatatctcttcaatacactgatttcctttcctttgaatatatacccagtagtgggactgttggatcctatggtagttctgtttttagttttttgatgaactgccatactgttttccaaaatgcctgtactaattatagtcccaccaacagtgtataagtgtacaatttcatttaaaattgcagcaataaatccattacatgttaacataaataacatctttatgtagtaaaataaccatatttttcaaaaaaaaattgtgagaggagttttacattctctttaatgtgtggataactaaaaataactggatttttatatctgcttctaaatacaatctcttgtactccactttacgctactaagggaattagagtaaaagtggaaactaaagttttggtgttattatgaaaatcgttttgacccaggctccttggacaacactttgagaactgctgctctagaaagtaagagggggatttttgttttcaccacagatggtttgtgttttagagttctctaagccttctctgttaaatagggaaaataattttgctttatagaatctttgtgaggaatgtgtataatgtgcttagaagagaaataatcacatttaggcaagtgataaatgatagatgctattataacactcatttattatgatggttaaattcaaagactggatgaaaacacctctgaaagtaaatgtagtgtccttttcactgaggccgcagtgtagcttagaggctatagacaagggtgcaatggcctaatatgcccttgtggaaaactatgggttttgagggcaggcaaagttctgtttgccagagtgggcggctagagttgcagagagaaataccgaagccagccttggccactgacaggccttgggcactggtattttcaacaaaatgaaagaaaatggctgctcagaccttgaaggagaagggagaccagggaaaatgtgagtagtgaaatgtagtcagtgcaaccaaataattgactcagggcctggcctatgatgagcccacaagggttacactctgggaagagcacaaaatgggtgttgaagccggtagcctgagatgtaaagttcgatatgatgattttgaaaaagtggaacaggcaggtcagtgtacaggtatatattggccttagtcttaattagccatggcaggtgcaatggtgttctcccaaaattttatttgtttccctacaatctcaatcctcttatgattaagtggagccaacgtgaatggttttgaacaatggttataaaaaaggattaaaaattttacttatttttaaatgttaatttaattttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgttaatttaatttttaaattaattttttcaacttttattttagcttgaagaggtacatgtgcagtgcaggtttgttacatgggtacattgcatgatgctgaggtttggcgtatggatgattccatcacctaggtactgagcagaatacccaatagtttttcaactcctgtccatctctagtagtccctcgtatctattgttaccatctccatctttatgcccataagtacccaatgtttagctaccactattgagaacttgtggtatttgattttctgttcctgcattaattcacttatgataatggcctccagctgcaaccatattgctgcaaagtacatgatttcattctttcttatggctatgtagtattccacggtgtatatatgtatcacatttgaataaagaactttaatatataccttgtgaaatgatggctaaaagccctgagggatagttatttggtaagagtaaaaaagcaatcgaatggataggccaggcacggtggctcacgcctgtaatcccagcactttgggaggctgaggcaggtggattacctgagatcaggagttcaagaccagcctggccaacatggtaaaaccccatactaaaaatacaaaaaaatattagctgggcatggtggcaggtgcctgtaatcccagcgactcgggaggctgaggcaggagaatcacttgaacctgagaagtggaggttgcagtgagctgcgatggcgccattgccctccagcctgtgtaacaagagtaaaactctgtctcaaaaccaaaccaaacaaaacaaacaaacaaacaaaaacaatctaatggatagagtgaaagatcataaatatgtgaagagataaaagtaacgttttcagaatcaaataaatatacaggtcctcagactgaaagtgcactcctagaaccaaacagagtactgataatcctctacatctagacatttcagagtaaatctgcagaacatcaaggatgaagataaaaatctttaatattgttaaagagatagccaaaaatacagactacatatgaagaaacaacaattttcttgaagcagacttctcagtaacaacagatgtcagaagataaaggaataatattgaataataaactactgattaagactaatggcaaaataggaatggtttcatcttttctttagtagaacaaaaggttagagggaaagaataagaaacaaataattttaagtgcattgtcagagtctgcactcctggatcctaaaggcataaaatgccaggacaccaggagcatagctaagctaccaagggttctataaccaaatcttccatatccccagtatcacagtgaggcagtaaactaataattataggaccaggaatagaccaggggattaggggcatgcatttgcaaaaccactaaatatgaagaggtaagcatgtaggaaaaaaagaaaataaaaacaagaaaaacatccttatcaatcaaatagagcttgtaaaccaaaattcaaaaaacatgaagagacttaatgttaagaaaacagcccacaaaaacaagtaaattaattcattacacatgatatgtttctacagtagacggttataaaatcagtgtatttaatgtattcagaggtaaatgaagacaaattttcattataaaaataaattatatagcaaataaacagtgatgaaaacaggcaaagattttataagaacaattaaagtatcatgggaatgcagagtatgctgactaagaagctactacaacaataacataaactccacactgaccacagatgatgaaagaattgaattatttggaagaaataaatttgatgctcacccaaaactcagctcagaaagatagagagatttaaaagtatatttatataggccaggcatggtggctcatgcctgtaatcccagcactttgggaggctgaggcgggcagatcacctgaggtcagaagttcgagaccagcctggacaacatggtgaaactccatctctactaaaaatacagaaattagcagggcgtggtagtgcatgcctgtagtcccagctactcgggaggctgatgcaggaaaattgcttaaatctgggaggtagaggttgcagtgagcagttgaagattgtgccattgctctccagcctgagcgatagagttagaccatctcaaaaaaaaaaaaaaaaaaaaaaaaaaagaaagaaaaaaaatttaaccatttctaatcaaccttgtgctcaaggatctagccagagcaatttggcaagaaaaagaagtaaaagccatgcagattgaaaaggaaataaaactatctctattcacagatggtatgatctggtatataaaaattcctgaagaactcacacacatagaaaactattagcgctaataaacaagttgagcaaggttgtaagatacaatatacaaaaatttatatttctataaactagtaataaacaatctgatttcatttataatagcatcaaaaaagaaaaaatacttaggaataaaatataacaaaccaagtgtaagacttttacactgaaaactatgtaacataagattgtgtgccactggtgtacaataaaaatgtaaattaatagaatagaattgaaagtacagatataaaaccatatatctatagtcaatttattttcaagaagggtatcaaaaccattcaatggggaaaaatagtattttcaacaaaggcgcttagacaactggatagacactgcaacaggatgaatctggatccctgcctcataccatatacaaaaaaaaaaaaaaaagagagagaaaaaatcctcaaaatcaattaaagacctacatgtaagcactaaattggtaaaacacttagaagaaaacagcagtaaatttttggtaccttgaattagacagtgttttcttaggacaccaaatgcacaagcaatcaaaaccaaaatagacaaattgaaattaaaaactttttatgtttcaaaggacaatatgaaaaagtgaaatgacagcccacaaagtgggagacaataattgcaaatcatatgtatgataagagcctattatctgggtaatatacaaatgaatgagaataaaacttatattggatttttcatcagcatcattgaatataagacagaagcatttaatttgatataagaacaaaagaaattgtgtatgttttcataaagagaaaaattcactctaaattaatcagtgaattgaatgcaatttcattaaaaataactgaagagtacttttacacaacttactaagctaattctaaaatccttatggagaaattaagggccccaaatagacaaaccatgttgcaaaaaatgactagggcaaatatgtgacttattatcacagtgagattactttttgtccaaaaaacttttatgcagaaagaagaataaacactattatttataactagtttattttccaatttattaatcatatgaatctagaatttatttaaatattaataacatttcattgaatacttacagagcatgtacacaaactaataaatttatgcactaaacggattaaatttcttaaaacatttaaatgttgattgcaaacttaatcaaacacttcttaacctttaattgggatcttttgaataaatcggggcttcttaaatctcctaaaatttcaaaaattcatcaaaatacacatgcagtataattattagaaagctaatcagatacccaccagaaaagctaagtgtaaagtgtttgtgctaggattttaaaattatttctttttgattgtatatatttaaagtgtccaatgtgatgtttccatatacctatatgtagtgaaatgattactccagtcaatcaaactgaacatatccatggtctcatttagttaccttttttagtatggtaaggacacttaaaatctactctctagcaaattttcagtgtactaataacaaattattaactatagtcctcatgctgtacattagatctctagatttaatcattctatgcaactgtaactttgtaccttttgacctacatctcctgttccctgcccccatccccacaccctggcaactcctcctctattctgttgctatgtatacaattttttttaagattccacattttgtttctgtgtctggcttattgtacttaccataatgtcctccaggttcatccatgttgttgcaaatggaggatttccttctttttaaaggctgaataatattccattgtactctacatttttttttttaattgagaagcagtctccctctgttgcccaggctggagtgcagtggtgcgatctcggctcaccacaacctctgtcgcctgggttcaagagaatctcctgcctcactctcccgagtagctgggactacaggtgcacaccaccacgcccggttaatttttgtattttttttttcagttgaaatgaggtttcatcatgttgtccaggctggtctcaaactcctgacctccagtgatctgcccacctcggcctcccaaagtgctgggattacaagcgtgagccactgtgcccggcctagtctacattttctttatcctttcctctgttgtggatatttaggttgcttccatgtcctggctattgtaaataatgctgcaatgaacatgggagtgcagatatcgctataatgtgctgatttcattttgggggagtttatggccagaggagggattgctgggtcatatggtaggtctatctttaagttttggaggaatgcacatactgttttctattatggctgcaccagtctacttttctaccaatagtacaagagttcccatttctccacatcctcactaacacttgttatttcatatctttttgataatagccattgcagcaggtgtaggatgatatctcattgtgattttgacttgcatttcttactattattttacactttaaaattattttgtttttatgttgactttttacggcagttgccttcaagatgaggttcagtaatattattactttcctacattccttttttttttcaatttttcagaccccaaagaaaagaggtaccatatgagaatatctgagattactggacttggatatgggctaacaacagatgctgatgaggctgtggaaaaataggaacacgtttacagtgttgatgggagtgtaaatttgttcaaccattgtgggggacagtgtggcgattcctcaaggatctagaactagaaataccatttgacccagcaatcccattactgggtatatacccaaaggattatagatcattctactataaagacacatgtacacatatgtttattgcagcactatttacaatagcaaagacttggaaccaacccaaatgctcatcaatgacagaatggataaagaaaatgtggcacatatacatcatggaatactgtgcagccataaaatagaataagtgcatgccatttgcagggacatgggtgaagctggaagccatcattctcagcaaactaacacaggaacagaaaactcaacactgcatgttctcactcataagtgggagttgaacacatggacacagggaggggaacatcacacactggggcctgtcagggggtcgagggcaaggggagggagagcattaggacaaataactaacgcatgtgaggcttaaaacctaggtgacaagttgataggtgcagccatccaccatggcacatgtatacccatgtaacaaacctgtacattctgcacatgtatcccagaacttaaagtaaaaaaaaattacatactcagcagcagtctaaatggaccatgttgtttattgccaaagaatatttgatatttatttattaagaaattccctagctcttttgagaacccttacatataatttttatgtatgtgtatttttgtatggttagaaatattgatttgaattttagaagttgattactaaatcaatatacttatttgctttggtttcctaaaaaaaattccaattctatacactgtaaaactgtgaactctcattaaatgtaaagctttcctcattcccaagttgagctttgtttcagatgtggaagtctgcgttgctgtaggggcatgtttggttcctctcttccttctctccttctcctctggattatgaaataatatttgtggcctttccagagagtattgaggagaaagagaggagtgggaacagataaagcttaaaactcttaacttgaccagcaaagttacagttgatgtgagtgcttagagatgtagcaggtgtctgaagctgagacttgctctcatgggacttttcagacaccactcctcccacccttgggaaaaagtctgactggggttttcttattgcagtccctgctgggctacctgcttttgtcttctgctgtcagcaactaggcctttcgcagtcacgtttatttattttttataaattagaactgcatgaaataaaatttattgagttattatatttgtaaggcacaaacctgtggcagaatcacaaataatgaatacagctatgtaagaagttgtctttttaacttcccaatctatcagatttcatcttagtgaatctgatggatcttgtcatctggtagaatcaagtaatatgacacacaattgcaaccatcatgtgaaatggcctaaagaaacatgtgttcgcatgattaaactcctacaagtattcctcaatgagtcaatgtcatcaggataaaaaataatctttttatacaactaagtagctcaacacagcacaaaactaatttaaaaataatttaaattgactttgtgtgtgtcttaatttcagaatgattaggtataattttttttagaatagttgatcattcaaaaactcaattataaatgggaaggaagtatcctaggaggagccaaacaatgtaatttgacagaaagaaagcaggcagaaacttcataatttcagaaccgtaaactataattaataaaaaataaatttgaaaaccatactaaaggaaagactgtgctatctcctctatcaaaaatgatagtaaaaaagtcattatcatctgaagaaacaatcaaaaagcattcaggaaaaacgtgtaaaaaataattaaagatggatgtcaggctgataataaaaagattgcaaaaaaataaataccatatgttttcacttataagtgggagctaagaattgagcacatatggacataaatatgggaacaacagacactgtgaactactggaggagggggagagaggtgggttaaaaaactacctatcaggcactatacttaccaccagggtggtgggatctgtattccaaacctcagcatcacacaatactcccaagtaacaaatattcacatgtagccctgtatctaaaataaaagttcaagtttttaaaaaaagattgtattattcttttgagaatcgtaatatttgtggatattgtcagctttgtaaactttgtaatatgtgatttattttctcattctaaataaatactgattttaataaaaacttttgaattttaactttgtatcatttttcttaaagaggggctcatatgttgactagattaagagctcaaaaatctaggacccactactcttttgcacaaagttcaaagacacaatctgggagaaaatattaccacataggcaaccgacaaaagtaatatagagagcatataaatatatctttatatcttccaagatataaaagtctagaaaatctgtattatcagggccatgagagggttataataattaaggcttttttcttgtatgatatataagtaattaaaacagaaaaatatcatatttcagggtattttcatggatgctaaattacttgtacacaccatcaaaaagttagctgaatgtgtttttagataatgcagtctacatgaaaatagtgacagatttattcttggccttttagttctatatgagaacccagaaaaacaaacatattgcaccattaggcatcaaagtgaaaaaatagtggtgaatgattgataatccatagtatagtttaccaagtgaaaagtactgacatgttagtgcaaaaactcttcttaaaaataaaactaggttagaatcaccaaaaatgaaatcattgcaatgtctaaatctttaaaattccaagcagaaaaatgggtgttgactcagatgtgtaataacatcagcaggttttctccatcatgtcctgtgtcaaggcagatgtgccctccagcaagtgctaagccacagacctatagctatcccctgagggctaatggtaatgcttccaacttgctactaaaagcctgaaataagcatcatctagtgaatactgctaaactcagtttatttgttgctaaaaaaaatctgagaggtgacagataatatgtttgtcatttgccttttgattctctttttcaaatccagacaaaacgccaacacctaattgtcagcattcaagagaacctgaaagttatcaagtgcaatatcccattagtgtttaaatcctccctatgaaatgcccaccaggtgttcatcaagctgattgtacaccagcatggcagagatccaggcctatggtgcagagcagaagtagtacaataaatcagtagggagaagattactttttatgggagaagattatttttatatacatcatccatttattgctatagctgacttccatgtgataaaggaggaagagtcttaccttatacaaaagattcaaaaataaattacatatggattaaaaacaatataaaaaattactcttggaagaaaatctagaagaatagctttatgatcatggaataagaaaagattcttaaagtttataccattttttaaacgaagagttatggagtactttctatatgcctggcactattcgatttgttttataaatactagctcagtaaatcttcattaaaagaacaatataatactattcctcattaataggctcttcactaaaagaagaatagagtactgaaatttgagtattcttattaactttattttaaagatgagtggtggagctagaatacaaactcaggtaatctaactttaaagtgtattctcttaactgcactctgctacctcaaaaagcataacccttaaaagaaaatattgataaacttgactacataaatgtaaaattgatgtcaaaaaaaaaaaaaaaaaagagacaagctttgaactggaaagaagatatctgagacacacatctgagaaaggatgtatagcaatacaggaagcacaactgtgagctcccagagagcagaactcccatgggctggagaaggagagtctaggcctgaggggagtctaggcagtgcaccacagtgtctactccagtggccttccagctgcttctccaacagagatcattctacttgaaggtgtttctagctgctactcatgtgcctgtcacacccttcctccagggcttttgcatggtaggcttctttgtatcattcttgtttctgtctaaacatccttttcttgaaaatatcttccctggccaaaccctctaaaatagtactccatacctctccaacctttcgcatatgaccggttttcccattaaatttttacaattaagatttatttcaaatcttaattttaaaggtaatggtataacaaaaatttaactaatgctatcagtttgccatatttatgcctgatcatactctttgaataaagtaaaacattacagatgcctctaaagcatcctgagtacaactaccgccagtgccacctccttccctccttccctccccaggggaactgccatcctggaattgccatgtatctacgcgacaggctgctacttccaaagccatctctacttcttccttgtaaacagaaggcagtttcattggggatagtgatgtgcccaaccatatgacatttccccgacttccttgcagatagaattaactatgtaattctgttctagtcagtgaaatgtaagtagactttgctgagtgaaactcctaagaaaactaaaggttgccagtttccattagaacacaactttttgtcctttacccttgtccttcttcctgtctgggatgtccagatctggagcaatcgtcttgtcccatgagttactgtggctgagtaaatagatagaaagagcacaagagttgggaccttgatgtccttgaggagacactcaaccaacctgggacttcctatggcaagagaaaagtaaactctgaataagtttaagccacatttttttggtgtgttttagatccttcatgagtataggatccttccttttccatatatgtttgtatccatcagacatatcatattttttgaacattttaacattgtatactaatgagatctacttatttagcaacttgctttatttttattcgatttgattatttgaaaattaaactgaattaatacatgcagatctagattattcattgaaagcccattgtttgaaaatgttagtttggttgttgatttcatacattctcctgttaatagacatttagattacttattatgttttgttttacagttctgcaataaatatctgacatatgttttcttgtgcacatgtgctagagtttctccaggataaataccttaaaatggtagagggtaaacttcttcaacttagtgatatggaaccaagtgacactccaaagtggccatgacaatttatactcccacgaggaggacacaagttttttgttctgtctacattaaagcttggtattatcaattataagttttgacaatcagatgggtgtgaaatttaaattttttatttgcatttccctgattattctgaggttgagcatctttaaaatgtgtattaaccattcaactttcttctacaaattatttttacccattaaatataaattatttaagtatttatggattgctaatatctcctccaaatatgtggtcttttacctttgttaatggtttcttttgtctcaaatatgttttttattttaatgtgtcatttttaattacctttgagtttttaattttgtatcatgttcaataaagcttttctctccctgatattaagatattaattattaagtaattaattattagtttcatataagtggaaagatacgtccttgtttgaacatatggaaatctacatacatccaaatttaaaccaaatgtcaatgttaataacaacactagaacattctcattaaaattaggagtaagacatgcatgtcagttgtgactcttgttattttctattgtacattaacatgatacaattgctagtgttattgtacaagatagtgaaataagatatatgtaaatatatacctagaaaatccaagaaaaccaacaaaacttaataaaactaataaataatgaaaaaagagtgagatgactggttataaaattaatgtactcaaatcaatatatcttacatgtaccaataagaaccaattggaaaatataatagaaatggcatagtttactataacaactggaaaatatccagttatttgtaacatgaataatgaactttataaaattataaaacattaccaaacattgtaaataaataggcctgtattgttttaggatagaaagacttcaaaccataaatatatcaatattctatgtgtgtttatatattcaatgcagttccattgaatatatggaatttcttttcaactttacaaaacaattctaaaaacatacaagtgaaaatatcaaaaatgctgagaaaaaaggcaggagattggcttgccctagcagatagtaaaatgccttatgaagtgaaatcagtttttttatatatatataaaatgggtgtaaataaagaacaatagaaagaatacaactctggacttagaactaaatgtatatagggggtttgtgtctcataaatatagtgttttaagttggtacgaaaaacaaagattagtaaatgaaattaagacaattagctagccatttgaaaaaaagtagatccagatttctccctcacttactatactgaaataaattattgctgaaaccataaaatactaacacattaatgaatatttttatagtcttcggttggggaagacctttctaagtttgtctcaggcatcaaaaatttaataggaaagactggtaaaatcgaccacttaaaaaaatgaaacttctgtgtaaaaataaacacaataaaaggttgaaaggtagaaggctaattggaaaattatttgcagtaaaatgagacaaagaattaatatcctagataaatagtgagctcttaaaaatcaatagggaaaatatttaatgttttaattgaaaaatgggcaaaatactctgaggcaatccaccaaagaaacacaaaaacatctgaaaaatgtgcagcgtcaggaataatcaaagaaatgctagtaaaatatgaatagtctttttccccctatcaagatggcaaagatgaaaattattgacatactttgtgaggggcagcaagtcttcccatgcagtatcgttgaaagaataaaacagtcatatcaccttaggaaagtagcacagcagtatctattacactgtaaaatacttaattatgcaacacacttctgggaatttaccctaaggagatgtatacacattactgcctatttacagtattgaaaacatgaaacaacctttgtgtccatcaataatagactagtaaattatgatgtaggaatttcatacagctcttaaaaatggacactatatttatttactggaaagatcttgttgaataaaaaatgaaggtttcagaatataggctttgtaaaattgtaataataggttttatgtctatttataaatacagagatgcttgaaaggctatccactctctccctcaccccaagaaaagtaattttaaaaatgtgcatttcatgtttaagaaaatcagatgatacagaaatatcaaaagtaaaaggtgaaaatctaagtgctcctctcactgacttccaacacctgtctccagagataagcattgttaatttgatttccaatttttttttttttttgagacagagtctcactgtgttgcccaggctggaatgcagtgatgcaatctctgctcactgcagcctccacctcccgggttcaagcaattctcctgtctcagcctccggagtaactgggactacaggcatgcagcagcatgcctggctaatttttgcctttttggtagaaacagggtttcatgatattggtcaggctggtctcgaactcctaacctcaggtgatccacctgcctcagcctcctaaagtgctgggattacaggcgtgagccaccgcacccagactgatttctaatcttaagcccttcagattcttgtctaccctttcactaacgtggatggatatagagatatattactatttagaaatatatattattcttctactttaaaaatattttatgaaagcattgctcacatctataaaaatgcacatactacaatagtacatctcaatgagttttcacaaaatgaacacacttgggtacccagttccaagatgaaaacaaccaccacaacaaaaataacccaggacactaccagcaccccagaaaatctccctgtaccgctttgcagtcactgctttgactgcagatttctagagggagtgattagtttggctagttttatgttttaaatgaatgtaataatcacaacttcagcaataataaagtattctgcttttgtgtctggcttcttttactcaatgtcatgtatctgagatgcatctgtgtgttgctacctgtagttgtaaattgtttattctcattgatgtctggtattccattgtgtgactacacctcaatgtatttctccagtgcactttagaaggctttgaagtagttttcagtttggagttctcatgtatagtgctgatgtgaacattcttgtgcatatcttttgggaatcatgcatgtgcatttctgttgactataagacaaaggatgagattactcagtcgtggacttttataatattcagctttggtctacatttcaaagacattttccaaacaccatttatactccttgtaatggttaattttatgtgtcaactttgctatggcagggtacctagatatttcatcaaatattactctcggtgtttctgtgaagttatattttagatgagattgacatttaaatcaggactttgagtaaagtagattattcttcacaatgtgggtgggcctcatataatcagttgaaggccctacctgcctggaggaagtgagaattctgtcagcagacagacttcatactcttctctgagtccccagcctgccagcttactctgcagaatttggacttgccagcctccacaactgtacgagcgaaatttcttaaacctcttcttacacatacacattctattgatcctttttctctggagaaccctgactaatacacccctaccagccagtgtttgagaggtacttttcgtcctccacattctgcataaacttgatattttctgtctctcattttagcagtctgctgggtgtagtgtcacttgttttagcagcgtactatagacaacataagacatttggctttcatttgactttaagagctgtagattttctattttatgtgtatagaaacttttatgtaattgtcttctaataatggacatttagattatatctagtttttcattattataaataatgctgcactgaaaatattgcacataaatattttaaaatcttgtgtttctctatgctacatttctaacactgaaaatttgggccataaatatacctatgtaaaatgatggtcaatatttccaaagtgttctctgcatatataccagtggcaaataataatgcctaactctccacaccattaccaagtaatatgtattttaaaaacccacctattttttattttaatttcatttgcatttcttcagttacttgccagtttgacttcttcaaatgagtagtggtcatgaatatttcttttattaattttctgtttatatcttttacctactggttctatcgagttagtttgtccctttccaaatcatggcaagaattctgtatgcattatagatattactgaataaatcttttatgatgcaaatattattctagttttttgtatgttaaggaggcaatgcagtgtacaggttaagtatataggttttggaatcaacgtttgattataagacttagctttgtcacttactagctgggtaacattggtgaagttatttaaccccctcaaaacctcagttttcacaagtgtaaagtacagataatagtagtttcccccataacggagtaattgtaagaattgtgttgcacgtaaagcacctagccattatctatcttagaaaactgcttattattataactatttctcttgtaactttgtatgatttcttaggcagctgagaaaattttagtttttatataaattagtcaatcttcctcatgacttctcattcttatgccatcccctaagataataaaatatcgctctttggtttcttctagtatttacacaactttaagttcttcctttagattatcaagccatatgaaatttatttttatatgctatagagatttacattcatcttccaccagatagagagccaaatactcaaaagtcatttttctaataatcagtcattccctcacagactttaaatgtcaccactttaattctaaaataatatttgtactttgatctgtttctggactctttcttttgttcccattgatataattcctcatttttacactggcaccttacttttgtaagttttaaaaatggcaatttttaaacatctgctaggcaactcttttattattctttacagtagattctcaattattattccaaatgtacactttcaagtaaaataatcagctggcagtcaatcttcttattgatttttagttcattttgatcttttaatctcttcaatgatgttttgatttgaagactatatgtcctctaatttatctggaatgcagaggttttgatttcaagattttcttttttgtagtttctatgaatatgtttcatattctctcctttctggttctcattaatctataataggggagcagggctgctacctgtagctgcacaggttatgtactgtacaactctgtggagcatcgtttatggagatgcagcacaaatcttgcaaaactgttaggcagcaggctaaggatctgttgtatgggatcttttatttactgaagagttggcatggagtaattctccttgattttcacctatggatacctggacactatttcaattgcggcataataaactgaactagagaatcatttgtcttagcttataatctttgtatagtccttcagttattgtcaagagacgggatacaaggattgtagcaaccagtacactgggcaaccttaattcggagacattgtttcacagtgctgtggcagaaatttcaaactgttctccaaacggatttcctctcttgtctgagcacacacttacgctatgctgcccagcccccattgcagttatgtgtggacacacaacaagttctcaccaggggaatgtgagctgaatcatgtgtcatttccaggatgaagtggttagcaggcagacaagccttttccactgtgctatgatgaaaaaatacatttggtctttgtcctgggttcctggcacaccagcttttaaaacctttggcgtcttgtaagtgataaatgtcttttgtatgctaatgagataactgggagagtggggaccatacatagtttctggatgggatttggttgccagaaaggccaagccatgattaaaagattagaactttcaaccccactccctgatctctggggaggagagagggagattgagtcaatcaccaatgcccagtgatttaaccaaccatgtttatgtaatgaaacctccataaaaaattctaaatgatggggttcagagaccttctgggttggtgaacacattgaggtactggagggtggtgtgcacaggaggtcatggaggctccacatacctcctcccatacctggccctacgcgtctcttgcatttggctgttcctgggctgtatcctttataataaatggggaatagtaagcaaagcacttccgtgagttctgtgagtcattctagtaaatttagtaaattattaaacttgaggagtgggttttgggaacccctgatttatagccagtcaggcagaagtacaggaggcaacctgaaacttattattgagtctgaagtggggcagtcttgtgagactgagcccttaacctatgggatctgtcatagctctggatagttagtgtcagaattgaattgtattgctggacacccagttagttttggagaattggagaggtggtgtcaaaggacaccacatctaccctttagctttctatcttctgggtaaatacagaggactccgaggccccagaggaaggtgaaaccacaagacagccggaacctgtggccctaaataaggtagataataaacacctaccaagaatatttgcattagactgttatgtgaggaagaaattgttttttgttgtgttaaaccacacagattgggtgtttgttatgggacatgctgccaagtaaaatgtagaatcaactagtcaaatcaacatgtgccatgatctctcccacttttccttactgggttttagtgtcttttttgtctgttactctctttattgatgttttgagtcacatattacatgccctctttaactttcctgaaaatgtaaagaagtttttatttcaacttaggataaaaccataggatattattagcaatatcctaattaatattaacagttgccaccaaatataacaagttttaaccggtgtcataattctcctcattttttaccctcctttaagccaagtagataattaatggttcagtatgaagctcttggctcacaattagtcccattaactcataaatctttttttagtgaggtagctttaatttttttgttcatttgttttcatatctgctcagttaattttagtcaattgatgccaaactaatctgatggctaagctaaccttcttctaggaattgaatgtttgtatttcatccttattttccttatctcctgctactttccccagtgtagtcctccaaatatatcctgcatgatttcttgtccttacctttgctcctgctatgacttagtctggaacaatttcctttgcctttaccatccctgaaaagcttaactaatccttgcatagtcagctgaaaccccactttctccaagagaatgttattaaacttttcctttctcacatttcttcatggcttctatcatattactttcttaatattgcattatagctatttacatgtttatctccacctctaaattatctcctggagagtaggaaatatgtcttacttgttgtattttcttcatgcctgccgtggagcctagaacagagcacacattatgagataggcattgattcaatagtcctgccaattaatgtgttcaataaatatcatttggccatttactatccaccagacatctaatagaaaggattgtatttcaaagttacttttatgagtgaagagcagccctagtgcctgacccacagtatattctcaataggtatttcattattgaatgtggtgattagaggggggatttgcaaacagcctgacttgataaatcaaccataaattctcctactcggccacttcccaacacagaaaatgtagaaaatgtgaaattttctttgctacgaccactctgatcaaaacatatcccaaatacataggctcagtaactcatcaaaaattagtgagattgctgacatggatgccagacgtggggtcaggcaaggagagtgtttatgtagagaagcagcatggaatggggcgtcagttccacagcagggtgtaaagtgtgttgacatggaagggcagcctggtatgaaatgtcagagaccaagtggcaggagggcgatccacacagagggactccctggcatgggattctggaaccaaccaaggagagcatgcatatagggagaagggtagaaagagggatgggagatgtattacaccacggagctgataaaataagaaaatatagtaaggataatagaaaaaaggcttctcactctcacagaaaagagttcaaaatatggaaagggagaaaaccaggatgaacccatggtgttagactggatttttgacatattggtgtgaaattatggacttctacaaatgtagatggattttgaaaatgtagatgtgtgtggatacatgtatataactctgttgactgaggggtttggaggcctcacttcaatagcagtgagaacatgtagtacctgtatcttggcttcttaataccagaaaggaaagaagtgccccccaaatgatgagatgttaaagggatgcagaaactaccttgaaggccatcagatttaagcatcaaaataaatcatgagagtaatgtattataatccactgaataacgtaggaaaccatagatcattctgatataaaaagaaagtttgatgagcaatgaggtatttacgtagtttcaaagaaccgtttcacaaaagttactgatttcaaaggaaaaaaatgtaacctcctattaaagaagtgtagcataaaatatcttaaataaatgatttaagtaaatattagtagtaatgagacaaattaaaatcttgggtcacctgataggatgcaatgacaaggacacgacattattctgtaatacatctgtcaaattgcataacctgagcctggccatgaggaaatatcagatataccaacatggagagacctaatgcaaaacgacaacctgcaatcttttttgtttttttctttcagacagggtttcactctcactcaggctggagtgcagtagcacgatcatggctcactgcagccttgtcttccctagctcaggtgatcctccccagaagctgggattacagacatgtgccaccacacccagctaattttcatattttttcgtagagacggggtttcaccatgttgcccaggctggtgtcgaactcctgggtacaagcgatccacccaccttggcctcccaaagtgttaggattacaggcgtgagccaccatggctggccacaacctatcatctttaaaagtcacgaacgtcaaggacttggcactgttccaggttaaaggagactaaggagacatgatacctaaaaaggtaacacataattctaagctgaatccttctgctagaaagggcatttaggaaaacttaaatgggatctgaggcctagatgatactgatgtaccacattagtttcctgattttgttatttgtattatggttattaagaaaatatcctcacttgttggaaacacacaccaaagtattcaggggctgatgggtgtcaagtcagtaatttactctcgaaggtttctgtgctgtagtcactagttttctgtacacttgagattgtttgaaaatagaaaatgtatgccaaaaaaaaaagaataaaacagtctgtggaattttctatcatcttaaattatcaacttccatattcagtcccaagtatgctttttccacagggcttgcttacctccaccaccttgagtgaattcttttatggcacttggtcacactgggcactctggtctcctcttcattaccgttcactagactggttttacttagatgtgcttatttttacaacctgcattttaaccaccagaatagaggcataaatgccataggcacatttcagcacatccattgttcatgctgacagaaatgtgaggtcaggttatcggaacccttagtagatgtgatagtataatttgttttgtttgtcccattgcattatgttgattattataaaagcttctatttgttatacaaaccaagtgataatacattagcatatattttctcatagcctacactctaaagtctacacacataaaatatattttatcttattttgaaaattaaaacatttcaaaattatcaatcatttctttaaatattgcaaatatatttagccgtgagaagtgaaagacaaatattgtgatgtattcgtataaacacagtatactctatgtaggaaaccaaattatctgttagggaaaacacagtatgtttattgccatctgcctagataagtaaaaaatatataaatcaagtaactgaaggagaaatgaaaaccaaagatattctttatatgtattagggaaagaaatattattgctcaactatttgggtgcttcctttggaatggaagaacttttaatataagtatgcaccttataactcagcttgaactactattattattaactaataatgcaatattattggcacttctttggtcatttactataggagctagaggcatacattactggaacataaaatgggaaatttgtttggctagcttatctgacagttgcctacatgcctgaagcccataaacgctatgactgtccaggatgtatcagcctgctcacaccatgacaacccaggtgacattaaagcagcacatgtttgtctacaggtaccataatggaccgtatcaatccaatgtgtgttagtgtgtatgtgccatgccagtccattatgctgtgacagccacatgtatcaatctccatgcacaactaattaaatacatgacagcacagcacatgtcagccttgttgcactttgacagccattttacactgtgggggaccagtgtgtgtcaggtgtcaatctcacacaccatgacagactcctatatgtagtaatatattatatattatatatacataatataatatatataatatatatatatatatatatatatatatatatatatatatatattctgcatgtgctttgaaagttcagtatataccatgagagccttgcatgaaccatagtagccattttacaggagcagggggttgagtgggggagcattctgtgacattctacatgcaccacgacagtccagtggatgttaaacatcttagcagaccagaatgcaatgtgacagctcagcatgtggcatcctgcttgtattctaacagtctatgtacactgtggtagcccagagtttatcagcctgcatgctccatcacagccaccacatactataacagccccccaggagccattcagcatgtgcaatgacaagtatagactgtaatcacccagttggtggaagtctgcatgtaccaggaccatcaatacatattgttagagtttataatatatcaagcccttcattctagcaatgcaatggtgtggtatctttttgtgtgtgcatatatgtgtatgcttaacttacctcgattgattttagctgcatttctttccattgcctatgttttaagttccttgctttctgttcccatttgctttaagtgtttatgtcttctttcctataatctatctcagcatttgccgttctcattcccagaggctgcaacagcctattgaccagctatctcttaaattctttttttgaactaaggtgcagaatgtataagtaaataaacaaggtcattttggaggctgacagattttatagtctagcctcccatcctcttttttaaatacctacaattataatcacacacactcacacacacacacaatggcacacatatcacatgttttaagacccttaaggtttcccattgctatagaaacagcttaacatcactgccattgtcttccaagtttttcccaatttttctctgtaactcattttgtattatactttttcccattccatgaacaaagccctgaactttcctacccctggaccttggtttgccctctgccctttgggtaaaatgtacatctctattctctttcaaagtttgatatatctctaactgttactgttaattttccttttccattgcctcaaatatctggatatctgacagtcagaggagtcgtatttcactagggggatagagctcatattaagtatttggtcctacatgtgccctcacatgtgccctcacattttagaggtatattagtccaggacaatatcttctaacaagtgacacctccttttaaccttcagtttcaaaagagaagatttctctacccaaatatacctgttaaccagcaacactgcaaaagacatgtataatttactaagattattttattaatttgtaatatgaggaaactgagtggtctcatctacttcaaatcactggaataagttttttaccacctccctattccttggaagaaatcattactattcacaagttttgtattgtataaccaatattttcttaaggttatgagaaaaatttctgtctattacaatcaaaggctcatattttaatgaagttcagactctattagtcatttttagtgttttattcagcctactaatacatttgaatttgagccccaccacttagtatctctttgaatgtggggcaggtctgagcctcagtttcttaatttgaaacatagggaagttgataaaacctacctcatagcgttgtgagagttaaattatattattcatgctctcaacaaatatttattgagtacctgctacaagccagtaagtattaagtgcatcggacatacttatggacaaaataagaaaaagaatttcctgtcctccagaaacttgtaattctagtagatagtaatcattacagtgtaacgtaagcgttatggtggcatagagcaagttaagagggtctgtgagttctgggatgagggtggggaggctgccactgagaaagtggcatttcaacaatctcgaaaaaggtactgactaaacagacaaacacctgggagaaaaagagtgctgtaggcatggggaacagctagcagaaaaacctaaattttcaagaaactttaaccttgttcatggaatgacaaggagtccaatgtggctggagtagagtaactacgaggaaaggtaaaagataaaatcagagggtggcagagacccagatcacgtgaggtgttattggtcattgcaataaccatggtgttactctcagtgagataaaataccactggagagttttgagcaaggggaggacatgatctcatgtaaattcaaaggatttgcattgaccactgtggctgtgttgagattgaatagcagagagacaagggtgaaagcctaaaggccagttagaaagctaatccaagtgggagatgatcatcaaagtgaatgtggagaaaagtagtcagattctagatatatgctgaacacagatattaaaggattgatttactgatggatcaatgtgagctatgagagagggcagtcaatgacgactgcaaggcttgagcatgagcgatgggaaagatgcccttagctggatggtctagagcacaggtggagcagagagggctgggcaggagaggaggctcagttttgggcatgataaatttgaggtgcctatttgacattcaagaaaagaggttgaaaatgtagttggatatgtgagtcaggagttcaggggagatgtctaaactggagagataaatttaggagtttttcttttataggtgatatttaaagccatgagagacaagtccccaagggatagagaataagcaaagcaaagtccatggcctgagccctgaggtgctacagcattaagaaatcaggagaggaggaagtgccaacacaggatgctgaggaatggtaaggaggatggagggaatccaagagagggaagccaagtgtccaatcctacggactagatgtgaaattaaatactggttcaaaaggaattaaatatggaattaaacattgagttattagatttagcaatcatgaggtcattactgatcttaaaaagtgtttttggggactgatgaaagcagtctgactgaatttgagagaaaatcaaagagaattatatacggcaagtatacacaactatttcaaaaagttttgctgaaagctgagcagaaaaaatggcacagtaactggagacagaaagtaggtttgattttttttgtttttttgtttttttttcaataggagaaatgatactatgttcataggctgataagggagctccagtagagagggaaattattatttcaggagcaagagggaagaattgctaaaacaatgttcttgggtgacaaaaaaggggtgggatctagcacatctactggtgttcttgagccccactcacacaggctcccaagagtgggtcattagcatctcttaccaactccatgttcagtgacatcatgttgtcagcttgtaagaggccgaggttggactatttacaccacatacattggcaaatactgcaaatatggacttttttatcctaaaagagtagggtgttaaacatttatgaggataccactgagtccatcagtgagagccctggccttagatagacacaggagatatccatccataggagagaaagaagagaaagaataaagatgcaggttctgatagatggagagatagatgataacatgttgcttgtcccagtggctggcacacagtcagtgattaattattatgtttaccatctcattcaatcataccacattacctctagctgcagcaaggcttccaggcacaggactaagactttagatgcaatgactcattaatttattaattcaataaacatttattgagtatttctcttggatgcttaaaattatattgtagattcaagcaaataaattcaataaatatttggtaagaaatggcaataaacaaagtattttagtgggtgtcacaaaggatcaaagatgaatctcaaaaaaaagattaaatttatatatcatttctaaaataaataagtatatattatgtggtataaaccaaaataacagtcaaaatgattatagcagaactaaatctattatatatgattttgtgaaatttaggcttatgacaaacatcacatataagtatgcattttttccccagtaattcactaagaatcaaattttatccagtttgaaaatgagaactatggaagaaatctaggagtcagaagaaaatttgataccaattgttctctaatcctcatctcactggaattgtctttaagattaggaaacattgttattccatttttgaagttcattgagttcatttctctaatcacatcatattttcgttcttctatatcattgacctctactttgaagaaatagagaatcttctccctctgcccatgttatttcaggtttcccaagactctggtcttttttgacctcttctttctgcacaatattcctgggtaatcacatctatgcaattgcagtttcgagtatcacttatatgcagacaaataatagcgatgtcttccactttataaatctcctgtgtgctagagctgtacatcccaaccagccattcaatctctccctcatgatgtctcataggtatcttcaatttaacaggttcacctcctagaaaccaaggaattatccgagttcttcctttctctcccgactacatctgctctgacatccattatatcagttcttccttcaatagtcattgacacaaacagtttctgagtgcagcaattacagtttttacctgggttattgctaatagtctcctgtttggtctttctgtttccaattctttttccctgtcattgaaactgtatttctaatatacagatctgattaagttacatttcttcttaaaattcttcaagtgtacctatcctgaggatatactgaaatacttaatggaaacattaatgcacatacaaagatgttaatcatagtataatattagtgaaaaatggaaatgacataaattttcaacagtaagggaatagttatgttcacaataatgtatccattcactggaatatcctgcagccaacagtaataattttccaggaaactaaagtgggcttattctaagggatgcatattggagctagcacaaatttatgttctcatttctataacccacacagaccttctctaacttaacacaccaagaaaattgcttcatgtttatggtgatcatatgtaatttcaataggcctcagaaactctgtctatcttatcccaatttaaatataagtagtcacatatggcaatcaccaaccttttagtgcctgttgctcttgctttcatcatcccagatttttgtctcctgcatccataccccaaatttaggacagcgactctagctctctgcagagttcccacctgcgccttgtgtatgcctttggttttggtaccctctgcctcctacatttttgagcaaagatttctttgctccagttcctagtcctatgtacaatgcatcttcaatgcatcttcagaacttacacctagaattctgaatttccaggcttcccacactcacttgaggcaatggatgagaaatggccactgtcctattactgcagtggggaatgcagcacaatcaaatgagaatgtgaagttacatgatctggaaactgttgtcactacacaactgataactatggagtttgaatctatgacattcacaaggattaccaagaaagatattcccttacccagtctccttcctaagattgatttcaggtgaatgggctgaagagagggggagaagtcttcctaagaaatgcccaggctttctcctgcataggtgacttgcagtttgcaggagcccggaaagacttctctttctgtctgcttatctaaggagagtgggtgatcgacagccctagtaaaataaaggagtcccttttactgagatgcacgggatttggagacgcaagtaatatattcgacagtcctatatgccaggacatagtgaatactgataaaaataataaataaatgtttctttctgagagggtaaaaaaaagaagttggaggcttcttatattctggcattcatcttgttaatttaatatttggaaggaaacttctctctgttgtaggttgaggaaaatacttcattttcccataactatagaccttaatacccagtgagggcagagaaggtgtgttctacccaccatagcccagagtctagcacagcctctggcacataggtgacagtagatatttgtggaatgaactaaataatgactgcctatttgcctcatggcctaatcctgtccgtagaatgccatttcatgtgtgagggtttattcctcagcagagacagatacactcttccctgactgtagcatttgtcaggcaggatgattcattttggccatctgactctccatgtggccagggcatcagtcacctctttagtctgcaatgatcaggcttgctctaagttgccaatggtctcttcatggccaaatctaactatattatcatacctttcaggcacacatcacactaatcctctttcttgaaatcctcccatgctttcatttaaaaaattatatgtccctagcctagatctccctcagattgagttccatatatccactcaattgtctaagaagtatctcaaattcgtggtgtccaaattgagtttatattcattcccaaaaaagctccttgtactgtatttgtcatctcagttaattagctggattaatcaagttgtctttgttcccttctcttcaattgaattcaaatttctataaactttctagttttctaccagtttacttgatttaaatggacatttggaacctatattgttttctagcagtgttaaggattagatagtgtttgtttctgtcccttcaatgacataataaaagtaatagcaagaaacagagcaagaaaacaaagagatagatattatcattctatgataatagatggtgtttgttaagtacttactatatgctaagcattctaaactatatatgtataatatatattatatacatatataaatttatttattcttcaaaacatctctatgaagcagatgctattatcattctcattatactaagaaggaaactaaggcacaagaggttacttaatttgtctttgattataacagctagaaagtgatagaaatatcagttaaccttgagaacctgcattcttacattgctattcacattttaactcaatgttaactcttacattgttattcacatttttcttacattgtgtcccttctatttaaacaattctttcttaataattcctacatatatttcaggaccatagtacccactgttacttaaattaaattaccactagtcgcatcgattgctactgtttcttgtatgttaaaattttgccatcttgagatctttatgctaatgcaaccttcatttggctagagtactttgatgagtttctttttcttatcagaaaggaagcatgcatgtgatactttctgagagcttgcatatctaaaaatacaaatttcttgctctcatgaatgaacaaaatttgattgggtatggtaatgcatgatcaccatctcttttcctaaaaaatccacagatattgcttcattgttactgtatttccaatatcataaatgaaaatattggtaccaatctgagtctcctcctttttaggtaattgctcttttctatatggaagcttttatgactttattttttgattccagaatgtcaccacgatgtgtataaatgtatgtagatatttttcaatgatcttgccaagtatttaggttttcagctcagataaattctcctccagttcaattttcattgttatttcttatccatgagctacttctttccttttaacttaccattgtttagaaattagaacacttgggtttgtctacatgagttttctcataatttctatctctttgttttcttgttctgtactcatggagagttatttgtttcaattattaaattgcttaattcagtttttggtagcatacattcttgtttatcacctctattgattcttttttattttggcaaatataattttttattgaaacacactttcttattgtcaattttttctttattatggcagctggctatgtcttatcaatgcaatatcccattaacagatgacagaatttagaattctttaaagatttttactattcgctgtatcaattcttttttaaaaaaaatggcccatttgccctgatttctcagtgtaatactctattttgaagtgccaattttaaaaatttgctccatgatatttttttttacccttgaagagctacatatatattttttcattgggatgggctccttcaaatcttatataactttggcatctgtagacctagaaaaatagcagttggatttgttttctgaaaagatcatagatgacaggtggcaaaccctctcatgcatggcagataggcacatacatgttcacccaaagtgggtctcttctaaaagataaatgactacaagatccctcttatatgataaaagtggctatgggagtctcatctaatcatcatattaattccttgaaagactataagggagggagggccagaaatatgactaccaagcaggccctttgacttgggcaaccacctatggatagtcttggctcatacctttgtctatttctaggaaacagggcggcacagacttgcttaagccaagagagctgccacttgactatcttctacctgcatttagcaactaatggcaaacaatgggcatgtgcttgtcctttaatccatcctccttttaacatctttttatgaacccagagttgcagttatgttcgtttggtccctctctaacaagggacttttccaatgatgataatttagctgtaattttccttcagtatttactggattgcctcagtagcaaattcaacttaggtttctatcctttcagaattctaagtatcttatatgttttattttctattatttccattttgaaataatgaaagtacatttcttcatccctaagaattaaccattgtctacattcatcttcccctctatgggccacaggttattcatgtaaagcttaccaactggccatcacccctatagattgtttccttggacaatacagtcagatgagaaatgctatgaaaacataactcagttctgaaaaacagcttctctatgagggaaaggatgttccaaatagatcagcaggagcaagacttggtggtatgagaaagatgatagattctggaatgtacaaaatatctggtatgtctgcaatgaagcatggcaaaagataaagctagagacctgggcaagggccagatcatgagatctttaataccatggcaaggagtttgaatgttatccagaaagcaatcagaagttgaaggcttttaaggaaagagcaataagattagatgtgtgttgtaagcaaatcattctggtagcagtgtgggaaatgaattggaggaggggagaatgcagtgaagaaacccattaggaagctattaaacaggtttaggtgagaatttatgagacttctactagaatcagtagcaatgtagagaatagtgaagagatttgaaattacttagtaagtagagcaaacagatttgctgttagattacacaagggaatagaagaagcagccagagcctagaatggcttgttaatgggtgtgcctggtggtgccattacctgaatcagggaaatgggagaggaattgagtgaaggaaaaagagaccatactgtgcctaccttatctaagacatttcagggcaaatgtccaaagatgtccaatatctacaaccatagatcacacatatatagcaaaattattcagtaaagacatataagccagatctatacatatgaatattaatagcatattgttgatatgtaaaaaaggataataaaactaaatacgatttttgtgttattagtgtggtctagatattatactgatgtcttaaggaatagacagaagagaagagcctagaatctaagggacaagagtcagagaggtaaacagaatatgaggagactgtgaggtccaaaaacagtgggaaaaggagaggagggagcgtagaagtgtagaataaagatgtccaatattctagagatgtcctgttctagagatgtccgataagttgaagactaaaaaatgtcctttgactttgacaattaggaagttactaaaattctcattaaagaaaaggacagacaaagggaatgtaagagttccaatctctttcctgagaattgcatttgacttcagttagtcaccccttgaacaagttttagaggaagtatctgaaattagaccaaagtctcagaaaaaaaaagtgtggttggttattgttggaagtgaatagagctatattctggaaagaataggggaaaggataaacaaatcctgtccctacagagcaggttgaggcaaatgaggaaatgaggaggccaccacacttatgcataagaaaagatggtcgaggctgaggtaccaggatgtgcttgagtaagatgacttagagggaggaagaatgaatgtactggatgccgggatgtgtcatctggatcccccttccaggaacgaggcactcattcttccagctgccaggaaggttggatactggttgctaaaggctgagtccctcccagaaattgtccctgtcaagggtttttctccctacccattggcaacctgtatttaatgactggttgatgcaaaggtatcaggacccagtctccttgcctctgttcaagacatctccaaagggccatttcagcttcagaattcccatgagactggctgaaacttcagtgccactgcatctcactttaagcattctctcagcaaaatccagtttccttcttactcctttgtatggattattcccaagaacagtcttcaacaaaactcctgcatcaaatcttgattgcaaagtctgtttctggggaacttaacctgagggagtatgcatattataatcacctttatgcctctcatatttggatctagctacaggaacagtcttgatttcatcatttagaggacttatcaaaagactccaaatgagaagttaatatgacataattttaaggcagtagttctcaactagaagcaggagttggagataaggaaagtatattctatagctgtacctacttgtatccacctttgatacttttcttccccaaattctgacacctcacgtaaccccaccacctccttgagaaacactattctaaatactattgaactctctgcctattggcgtggacctgttttgaggggtcactgtagatagaatggcatattactgacactaggtagttgctagaggtgagaggaaaggcactgaagagctaagctttatgggtttttttttgaggaaacacttcagtatatttatattctgaatggaaaatatcagtggagagaaagaggagttatgaattctagagaaagaagaaatagttaatagaagaaataagataataataaaataagaataattaataattaatttacagggcttggttggtatagggtcttgtcatattccaactaagccctataaattagtctccaatagacttacctccacaatcattgagctggactcatattaagcatctttagaattagagttcccatacctaaaccctctaacctctaagaccaaagtttgatgatatttgacagaggtttccaatgctcttctgacgcacttctaaatgtcttggttgccctggatcttaactgctgtggatgatcaggagggcaagtttcaacctatttggggaatccttatagctctgtatacctcttgcctatagctttcctgatggtttgggtagttttatagttgctatcattctttttaaatagaaatccaaagattaatatgtgctttcatatctaacagataaatatgagctataattatgatgaaacaaaactggaagtcaagataaatgttctcatcagtgaaggaagaaaatgctcaggaatggtcatgcagtaaagtttcactgcaattagaaatcactcctggatgttgacacttacttctgatttccaatgggagaataaattgactaaaaggaagggacagaatatgaaagaggaggggaaaaagaaaaacaggggtgttacaggctgcagtttgaaggttaattttttttttttttttgataatgctttgagggaggaaagcaaatggccctgttaagaaatgattgctttactgcttgggggctattaacaagatatgatctgagatgcaatgctcctcgtgggtcataaagatgactatatacaagagctgatcattagaaaaatgattaaggctattattaacgcattactcaattacttattaattactttaaaatgtggctagaaatgaggcaattaggagttcacagtcctaattggtatttgacatcacagagtgtgaattgatgagcaccagctgctctgacattttgcctggtgatcagctactgaggaagcaggctgtaaagcgatactctatcatctctcttttcacagcatggccaagctcagggaggacagatgtttcccgtggacgaataaaaaagcactcacacttccatctgactagagagctgtgaagtcagtagaaagtaagagggaagctgtatgttggtctttcccatggtggacactggaactaaagctgcaaccaaaaacatggggtgatttcaggtatggctgcattcaaaattaaactttttaaattttaggtagtgggttattagccaaccaggcacagaacaaatactgatactacagccttccagttcctcttgcctgtagagcaaggcactcaagacaccctccattcaggtctgcagacggcattttggggtcttttgattgtgtgtctgtcagctttgttaaaaagtaaagatgttcaaggaagtgacctcttcccatgcatttctccgggcttttcacttccaaatagatacctttatatttgtgtgaatatattctaacctattagatgtcttctcacattgctatgtatgtctttttatctttcctccttggtgccttcaatcatagcctttgaaacaggaggaacaactctcatcacattacagacatagagagtcttctcatgttcagtagtcggcaaaaataatgactatctttcccagaacatctagagttggctgttttatcaaaaatgactttggatcttacaggaaaatagagaagatgaaaagaagtgtgtctaaaaggagaggaagtaagcatgggaggtagaggggaatgaaaaaaggaatcgagaaaagaggcaaacgaagcagaggggagtgcagggagagcaaagcagtataaagcttatgaggtgtgtgagctgtaaattttaggcatgtaagaaaaagcagggctgtctccttgtccccatcccaaggcattttcctctctaaacatttgagggaaggagaaatttgccttgtatccacttctgggccagttcatgctgaagccttctctgttatcatctaatttctcatacctactttcacgtatgccttaagatgtctttgctctgagacgatcacctggagctttggagctgccatctccatcactttggcgttgctgccaccatgctgacctccatggaagaatgattcagagaatgaatgcccttttccttcgaagttccaccttaattcaccagagaatcactaatgggaggaagttcaagtaactgaagtttaggaataactagagggaattttttgtggatgtgtagtaccagttagttttgttgcccagcatctcttcctcttgtctggtaatggcatctctcttccacttgggaaaatgccccgcccccattccacttggtctggtagaatatcatcacagcgccttctcctcctggcaacacaccccatgtgtttcaagtagacacgtgacccaaacaaggaactcagaatcctttcttgagattgatatatgggaaaaagcatctatccttttcctgaagttactaagctcagatagtataaacgtggagcttctggcaaccattttccctaactgcctaaaaaaagtccatctacacttggataaaatgagaccaagtagcagactaaaaagttgggaggaggaggaagaagaggaagataagaagggagtgggggagaaagggggaaagagagggagagagagaatctaataaagaaagagaggcagagacagagacagagagagggaatctaataaaaagagaaagagagaaagaatctagtaaagagagaggaggacagagacaaggagacagacagagagagagagagagagagaaagagagagagagagagagagaatctaataaaattacttaagccccaagggtccagcccggggaagccccaggaagccagtaacccatggactttcctttgtttttgtgttttcttttccccaagacaaaagttctaatatgatcagagtctgaagggtacaagcaggtcacattaactcacaagaaataggtgcaggaattttcaaagacaaacttggggctttacaaacaaacaggatgacttcagtgcatatgatggcattaaaaacaggggacaagttgaaatggacattttgtccctaatgattttcttttttcctctagatttctatttgtaagcttcacatactcttcccttctcagactattctacctaaagtatgactacctactacagatgcaactgtagtgatatgaatgtcagttggctgacttaactgtacaagaaatatgttcattttttgataactcaatctaatttctgagccttcattccttcagtgtagcagaaatttatctctgtcattttggagaattcccccacccttcccagtgttgcacctaatttctggaggatgttcccagcaacaagagatggggcacaggagtatagggtttgagtctggtctctggtcatcatttttccatgcatgtctagggcatccagtgtgacggccaacactgggaacacacaagaaaaccccacccctctagatcccccggggcccaccctctcaatatccatctcctggatgcacctcaaaaatcatttctcttcctggctattcttgctctttctctttgttctaagaatccacagacctgtccaaaatttgagtaatctctccttcccatctgacacttgaatgggtgagggagaaggggaggtaacccacgttttattcactgtaaagtatttcattacacaactataaacatcaagttttatttacctattctctttgtagtagacatttctgttgctgtcagctttatattatcttatttatattaaacaatatatttaattattgtttattatattttaataattatattatttatattaaacaataggttaattactttcattaaccatgttttgtggtacatacacgtgagaatttttttagtttgcacatctagaagtggactgttagctcataaagtttgcatagtcataattttgctaacaactatcaatttatctctgaaattgttatgataatttatgctcctaccagtaatgtgtgagaattctgttttccccaaatccttgcaaataattgatatcattagaagtctcaatatttgtctacttgatgagaggaaaaatggcattgtgttgttgctttagtttgcgtttcacaaaatccaaatgagattgaacatctttttgcagtttgttgctcctttgaatttctttttctatgaaccttataacctgtagctattttttaaatgtttattcttagtgacttatgggagttctttacatactctgtgtgtgaatcctttggcaaggttgtggttgtagcatttagactttgactcaatctgcctatgtttatttttattttaaaaaattatttttaattgacataataattgtacatatttataggagagagtatgatattttgatacatatatacaatgtgtaatgatcaaatcggtataattagcatatccattacctcaaacatttatcatttctttgtgttggaaatattcaaaattctctcttctaggtatttgaaaatatacaataaattattgtttattatggtcatcctgaagtgctatagaacactagaaattattctggtttattagtaaatagcatgtttctaaccttttcctataaaaaggatttagataagtgcgtggtaacttctttgtttgagacggagtctcgctctgtcgcccaggctggagttcagtggcgcgatctcggctcactgcaagctccgcctcccgggttcacgccattctcctgcctcagcctcctgagtagctgggactacaggcgcccgccaccacgcccggctaattttttctattttttagtagagatggggtttcaccgtgttagccaggatggtctcgatctcctgacctcgtgatccgcccacttcggcctcccaaagtgctgggatggcaggcgtgagtcaccgtgtccggccggtaacttcttagaatgtagggagagtagagggaaatacaatgagaaaaacataaagaactcacattcttcccaactctttcacagaagcagaaacaagacaaccatcattaggtcaacaaattaccctggtatacactttatggtgttcttgcagggttccttaacttttcacatgctccttcttgtccgttctcattttgcgtgccattcaaacttctacacatctttgcaaatttagcacaaaaaacatattttaaaagaatttattaagtaaactctcctttgcctcctaaagcttctgaaacatggtccttagctcacagtattgtaatattctctgcatctctgctcaaccctctaagggcattgagggtaaagactatgcctcattcatctcaatattcccagtggctaggatcattagaagggattctcactacatgttgaatgactggctgacagaagctgtttcgactgcaggaaaaataatgttttaaaattcttgcccagagaatcagtaattaaaagggcaatggggaaggttaattttggaatcatttggtaaacatatctttcataaattgtaaagtttcatttgggaaatctagtacacatatataatatgtatatagcacctgtgcactaatgcatcacacgcagacacacactatattgtagaaataacaacaaaatcttggagtggggggaagtagcttactatagctcttcctagaatccatcttagagcttatttaaaagaaacaattccggagcctgcagtaagccgagatcgcgccactgcactccagcctgggcgacagcgagactccgtctaaaaaaaaaaaaaagaaaaagaaaaaaagaaacaattcattcttttccaggcctcagcacagatttctgctaacttgagctcctgggctgctaacacatcagagagaaaggaaggtgtcatttagtaatgtggctgctactgatgacacaatcatctttcatgaaaaaagttagctccaggggagggctgcctattatagcaaaaagatgggaagttaagagaattggttgctaggttttctttgtggggaagcaagctaaatttttttgctgagtatgacaaaaatgcaagctatttattctgattgagataatattagaaaagaagaggttgaaaaccagaaatacaaatcttgagaggtacaaggactgtaaagtcacaagggaaaggcacctgattgttttgctgaccctttatatactggggacctaacacaacgcctggtactggtagatgcttgttatatttgttggatgactacataaacaaatatctcctgtattctactagtatccccttagctttcttcaacaattctgtaattattataaaaatacaatattattttcaatttattattttcaaattatttcaatagtattttcaaaattgcaaaaaagagaataaatgaaaagccatccataattcattcattaagataaaattaggttttaagtattttcctctagttatttttctgtatacacatgcattggtatttgtaggtgtgtgtgcatagatacacagaaatatgattatgtaacataaataatttttcatttacattttgaatatttttgaggttattaaataatttatttgagaatatgatttataattgtggtaaaaatacaatattatttatctgcatttaatctatcaacatttaactttattattattaatctatcaacatttaactattcttccctattgttagacaatgaaacttttcaaatagctgctattttatttgattttttaattctagagacaaagtcttgctctgtcgcccaggctggagtgcagtggcacgtctgtagctcactgcagacttgaatgcctggcatcaagtgatcctcctgcctcagcctcctgagtagctgggactacaggcgcaagccacaatagctgctattttaagaacataagaattatttaagtcaaaggatattaatatataactacttcctttggcatatatttccaaaattattttccagacaagattgtatctagtactagtataatcctcactgagtattatagcttttcttttttttatatttaaattcaggaaacattttaattgttattctaacccacatgtttcatgactaaaaaggtcaaacttttttttctgtattttttggaaaagcttcttatgcttcctctttggtgaattatccatccatgtcctttattcactattttctactgagatagtactgtgtctctttataatttgaaagcaatttttaaaaatatttaaagaagattagccctttgtctacaaataattccccagtttgtcaaatatttagaatttattttcataataactcttgagaaacaggttttagatttttaagaagttaaagctactggttttgttttgtttattatttttgctttgtgatttcttccatatattcatccttagaaacaatttctccttcctggagcctaaaaaatgcccatttatagtttattctagtttcattactagaatagtgtactttgatttagtttgattttgtcttaattttaagcatagcactgagtcattttgatttctctttgtttttccccaagtacataatcaattgttccagcattatttattgaatactcttctttttacatactgatttatgatggaaatttaactgtatattaaattcttgcatgtatgaaagtcagtttctaaatgtttatattgatcaattcttgcccaagatacataccatcttgatagctgaaagtttattgtatgttttgctatcttgtaagacaaatctctctttactgccctttccaacttactttatattatctttttgaaactttttcactattcaaaactatatattttttaaaatgagctatgttttcactttgtcaagtaagaataatcttaataaaatctttgagtcacattaaacctttaaattatttcagaggaattaaataatttcttttataatatttagcattcccattcataaacatggtatatctctacatttatgatgctattatatctccccatatgttttctaattattttcatatagatgacacacagttctctaagttgtttttcacagagttatttataaatttgcctaattatttatgatggcattaataaaataatttcaccatcataattttgactgaattattgatttcaccaacaactattaatattttatatttgttcttgcatctgaacattttcctatcttcttttattagctctaataattttttaaaaaaatatcttgggacttctagatcagtaaattaatgatttgtaaaatatttttctgcttactttaatagctttagctcttttattgcattgcacatttacaaggtaatgttgaataatgaagacattaaggataatttttttgtctctgaattttaagtgaagtttttctgatatttcaattttcagaatgttgcctctacattttgatattcatcctaatgttaaggaaatttcctttcttgcttattttttcagacttttcccaggaatggatattaaattttatgagatgattttagagcatctgccggatgattatgttgtttttttctttgacctattactgatggacaatattaataaatgtgctactaataagtgaatattatattccaagaataaaatctgcacaatatagtctaaacattatcttgtaatatactactgtatgattttcattggtttagtaaagacttttatatctatctctaaaatgtcattctgggaattataacttggacatcaagttccttacactctggttgccctttattggttatccttcttttttctttttaatgggccaatcaagcacactatgtaactaagatgaaagctctttaagagcacaggtctttgttttatttgctgatttatttactaagatcctagaagtatgcctgatacattattcgtattcaataaatactttttgattggttaatgaattctctcttatattgatatttatgttctttaataattttatactctgaattatatattttttattctttgtgtctttatctggttagctgaaataagacataggagtgcatatacaaaaattttcttccatctgaatatgagggtggtataccggctgaaccattgaatatctgagaatttatttccgttgccatcaggtgtggaaaaacagctgaagacaaaattcttcccataagcttttcccatcaaaactgtgatatattgttccattattttctagtacttggcattgctgaagagtattttgaagctggcctttgtttctttgttcatgatctttctttttctttaatgccaggatgctttattcttaaattttgacgacaatgacaaaaaataatacattttattgtttaaaatatacagatatgtgtactatataaagcagaaatctgtctcactacatagttcttctatgaccccgcctatagggcttcttctaaataaactcacttctcagatggaattactctaacagttggttgtgtctcgcttctaagtttgtttccttatatttctataaatagtggagtttcttctttctaaataagatcatactcttataactgagtgcctgaaaaaagagagccttaaaaatgtttagaaagagaagcttccaaatgtgcctttgtctagatggacaaagaaattcacattgaagcacattctcttaaccaacacttgaatggtcctacttgattatgtaaatattaggtgagtaggcacccatcactctgaagaaaaggcatggcagggactgtgtgtctttgccaaggttgccttttctcattgtccctaagtatgtaggcatatctggtctttgagtagaaagtggaaaaggtttacactgaagccatgctcagaaaacagacggatggtcccaggcagtgagaaatttctaattgtggggaaggacaagtacatttcaaggaatagtgatatcttctattaaatttgagggtgtttcctttattgactataattacttcctatcatctccaagccttcgggggaaatctgttaactaaaatgacctagtgttatttgtgaaagtcccacaaaggaagaggaaaagagtccacagcaagaggtaacatagaaccagaagcaaagaaaacctatcaggagcaggttacaggggtgaagcaggattcaggagaaactcataggaacgtaagccctccctggaaatctaaagtactacaccagtggtagaggtaggtgtgctccacacagtgtgcggtgtggctgcttgaaccatcttatttgcatattatgcaaaggataagacttgaaagagggggagtttggggagtactagattataaatgcttgaatatcaataatccccacagttgggatgactgttctaactggatgtggtgggcagcctctaagatggcacccaaagagccccacttccagatatccatgccttcgtgtaaacacttccccttggttatgggctagatttaatgattcaattttagcaaatagaatacagcagaggtgatgggatgtcacttccaagattagattacaaaaatactatggatgccatctctcttgacatctggggcattctcttacttgctcggacataggaaagccaggtgccatgttgcgagcttcccagtgtagaggcccacttgacttggaactggaaaaggtctccaatggcctgctagagaaggtctccatccaatagcctgctagagaagctctccagccaatggcccaattcaacagcctgtgaggaatggaaacatccaagcaatcacataaatgagcttggaagggaaattctcccctagacaagccttcagatgagaccacagccctggcttatagctcatctacaacttcctaagaaactttgaaccaaaagtacccagctaagccacacttggattcctgatctacagacactgtgagaaaataaatatttgttattttaagttgataagttttgggataatttcttatgcaacagtagataattgattcaatgggaaaaataatcaagtatatgttgcagataattgacaactttgggcaaagactatgtttgggattctaaatggaataaaacatttaatagagtcagagtgtaagaaatacaatgatatatgttcaaggatgcatcacagtataaagcaacatgccacaggatactatagcaaaacattcattttcatgatttcacttatttcttaaggtacatatgcaatatgtcttagaagagacaacacagaagctcagcagagcctcactagaaaactctgacttgccttccctcacttcccaatgacctaacatgaaaacgcaaaaagttacataggaatattggttaaaaagtctggtagatttcttttttttttttttttttttttaactcatttttatcaaaatttgtgcagttgtaaaaatttttttttttttattatactctaagttttagggtacatgtgcacattgtgcaggttagttacatatgtatacatgtgccatgctggtgcgctgcacccactaacgtgtcatctaacattaggtatatctcccaatgctatccctcccccgaccccaccacagtccccagagtgtgatattccccttcctgtgtccatgtgatctcattgttcaattcccacctatgcgtgagaatatgcggtgtttggttttttgttcttgcgatagtttactgagagtgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttctttgtcaccaccaggcctgccctaaaagagctcctgaaggtagatttcaagtaaaatcactaacaaaggatgctacgcggtccagggctttcacctaccagaggatacagaggagtcactctcccctccaaccacacaaaacagactacagaggtctttttatgtatgcttttaaggaattccattcctgggattcaacatagctgaggcatatatggacagatggtggagcattgtatccagagatatcaagatgagaggataaaagaagagaaatcgttgaagtttccttgctcttattagtacatttaaaaaaatcatagtccatgggctgttacaacaagttctcaatgttttccatttttatatttgccttgttataatccttaaaattaattaatcttaaaatacataattgccaaagttttgttctatttaaaactgtgattttatttaatattgacattacaagtccatttctggaatctgcctgccacagaggtttggtccatcagatagtgtggtttcacagttaatagagtctctaggcagactgcctgggtttgaaacctggctctcctaattattggctgtttcaccttgggtaagtgcttccatgcttcagtttccttactggtaagatggatgtagtaatagcacctaccttatagaattattttgaggaatcaatgagttattatttgtaaagtgcttagaacagcaacagctccacaaatggtctccttcccactaattctgtaataaaacagcaagtgctgggggaaggtgggggtgatggggggcaagaaaaggaacctgaagcttctccagtgcatagaagtttcttttgcctcaggagtcatcctgacccagaaacggtgttagtggtgtaacattgggctactttgtgttcgctggaaatcccagactaatattaatattcatgggatagtctctggaagcctagacttggacccacttataccttagtgcttaaattgtacagacactcagacaggtatgaattaaacttgggtggggggcagcttattcggccatcaatttttattttatagttctatgtgtgtgtgtgttttgaaaaacaaatggttcattttcttgctcctgtgggagcaaagcaagtcataaacttaaagcaagtgtctgcaaaaaactttccaggcaccagtctttctgacagacagaacatcatctattcagtagaaaaagtcaaacttgcttgctatcttttaatactcaaaaacaaaaacaaaaacaaaacccaacaacactgagactggtagcttttccatggttatctccatctaaaccttcatgaatagattccttcctccaggaataaggaatgaagacctaggactgacaagcaagaaacatgagctccatccatgtttgttctctggcgtaaactctgtaacttggaggaaggcttttggtttctgaggttgggctgggaattctgcagggcatagacaacttgctctcaatggagaaaacacacaagcacacactcagagagactcagacaacttgcatgcatacacacacaaaattctcacatgtagacacaccttcaagatacacatttacattaatgttcacaggtctaaggtgttaagactcagggaggatcatggaggggtgaggggcttagatcagttcagaagaggaaacttttcagatagatttctgtcaaagtaaaattgaggtgcagagccctcttcgagcccttcatcaagattcacaaaaataaggcattaggctagaaatagctctctgcaggcatttatatatacctttaaactccattgtttgaagcctatcaatttggagtgctgaattctactagattctaagatattagagtaagatagaaagatgaattttagtcaaccaatcaatgtgcactcaatggatgcctactacagtcacaggcagtgccctctgggccctgggatagagagatgattgagatattatccctacccgatgatagtctagtagggaagatgagactaatacatatgaaaccagctaatctaacttcaacgttagactattagagcccaaaaagtgtcctgccttgtcaaacatgctattttgccattgaaatactgctatccagacatagtaagtaaatttcttatggccacatgatcaaataatagaccagttcttctagagagaattactctctccatccctttgcattgttttataattttataaaaaacttttacatggctctgtgctttaactaggcatctgcctgtctgtccttccttcagggatgtgatgccccacaggtaagaacctgaccttatacatttaaggagcgcacagtgactgataaggccatatttagccaggaggtgctcaactcatcagccttaagtgatcggaaaggatcaaagacaacagtccagggaattcctcttggccaaggtcgccattcattacaccagatagcacaggtagtaaagacctaaatcttggatacaaattcgaggtaagatattttaaacttggcgtaaaattatagacctgtttctaagcccttctgtcttcttctccattttaaactcagttgctttataattttacataaaagggtaatgcattttcatttcagccagcaggaaaaggttaggctcctcaggtgcttttgaatcttcatgtttgcagacaaaatcattgaaaggttttgatatatttctcctaagggtttttcttgaaattacaccaggtcactcaatcatcagacaagcatttttaaaaacaaaacaaaacaaaactgctctttgtcaaatactgggcaagttgttgtctacaaacttgcttggctgaattactgagcaactactttatgcccagagaaaagaaaagagcagcatggttcttacatgtttgctaagctcttgacccatgctctcatgagtaccctatcccatctggatctgagtgttgcccttcactatccaccttctttcatttaacagttattcactggacacctcctatgtgtcaggcactgtcttagatgctggattcttggtgatgaacatggcagacaaggtccctagcctcagggagtgaacatactagttgtcagagggaatgggggatgggagtaagcaaaaacaaaaacaaaaacaaataaacaaaaaaaaccaataagcaaacagatactcagaaccctgaactgtttctgacatatagcaggtgttcaataaatatttgtgatttaatggaatgagcaagatagtttctgatagtgataagggatatgaaggatattgatgtgaaatagagcatttagacagggtcaacatggaaggctctgtgaaaaggtgatgtataggccaatatgcaaaggaaaggaaggagcctgcagaaaaggtgtccctaaagttgaggaagaagcaagtgaaacatcagggagttagtaacaaactgattgcatttgaggacagagagagaacaatgtgactgagacaaactgagcaagagggagagtagcacaaactgatgtcagaaaggtagagggagctcagctatgctggcactatggatcaaacaaaggagtttgggcttaatttccagtgttattggaagcatttggggttgaagcagtaagtcaatgtgattaaactcatgaattgaaagatcgccatggctgctctgaggggaaagaattggtaggaggcaatattggaagaaggaagtgcgtcagttaggatgttttagcacatcaacaggttataggtgtgaaagatattgttcccctctgcccttggtgtaaccaggagagaatgagtttggccaaagctgtggggcggttctggccataggaggattcatcctttaaccagagaatgctgaaaaattagcaccatcttccgtgtctgtcacaatgtaaaaaatattggaaagccctgcttcaatacatatttttcatgctttctggccatcgggcttctttaatacactctttctatgtttggagaaatttcccacttgaaaaccagcctccaagataactgctagtgatccccacgtcctagcatttgctcccttgagtggttccctcccacacagcaccagggttagtgtgtgtaaccaatagaacacagcagaagtgatggcatatcacttctaagattaggttataaaagacagtggcttatgtcttgagcttcctctcttgcttttttctttttttctctctctcatcactcactctggaatagtcagctatttcttaagaataccccagtatccttgtggagagggctgcatgatgagaaactgagacttccagccagtagccaagcagtaggcattattgaaagcagccccagtcaagacttcagatgatgcagctctggccagcaagttgactagaatctcatggcagaccctgaaccagaaccacccacctaaactgcttctggatttctgacacttagatattgtgaaatgataaatgtgtgctgttttaagttgttcattgtgggggtaatttgttacataataatagatgatgagtgcatcccctttgtgaaccctgctaccacactcagcctctcttgcagtcctgagctttgtcaacatgatcctcctgcctgagacttcaatttgggaaagaatgatatgaagaagccagtaatgcagagaacaaatgctggcgaaggtggtggagggagatttagctttcaaaggaggcagaggtaaagttgctagtggggaatcttgtgcccatctctgtccctgtggatggctgtgcctgcacccagaagtggtgggagtggtagagtcagcattggagctgtctgctgacagaacatggatattgtttctggctacctgacacccaagcctgatttactccaggatattctttcatacattttgtttaaactatctagtgagctctcttattggcaactaggaacccagactgacataaaaacctttgaaggcaagtaacagaaaacactgcctcaaagtagcttaaataatatggaatgaagtagctcccctaacaggaagtgcagaagaaggggactgcaggggtgaaccgccaagattctggctccactgttctagagcactcaagcctgggtctttccctgggtgtttcatcatcctttctggctggtggcagtttgactacagcagtctttttgtaacagtgaggcaccttattcagtagccctctatagactttccttcatgtctcattagccctaattatgtcagatgctccatcccaaacctaacactggaaagaagaatggttttaccacaactgccttggactaattagttttgacctccaggatccgggaaaaaagtcatactccctcaaagcacctggaagaaggtggctacattaaaaaatatagggcttttctgtagactaatagatactgagtaagcaaccaatacagtctgctttagacagttattacagggtccaggcagagggtgatggtggttcgtattagggtaatggagtaggggcggagagaaggacacacctaaaagcaacaagatttgctggtggattggattaggagggagaagggaaaaaacaagacagaaggaatgatgcattagtttagacctgagcaattaaatcaataatttacttagataagaaatgttgggtagaaacaggttgagatgaaggtgaagttacacatttgaatagttgcacatagacagattaatacatgaatttgaagctaagagggagatcatggctgattatatgaactggagagtcatcagcatatagaaggaatttaaaaccacggaactgagtgaaatccttacggacaagggtagcaagggaggaatgcaggtctgagaacaaagctctgtggcatgccgacagttagaggtcaggtagaagaggggaagccagtgaaagacaaagaaagagagtagtccgtgagaaaagaagaaaaccaaggcacatctcagaggtccaagtggtgagctgttgtccagcctcccgagtcccaattcctccctaccctcatctcaccccattccattcctggctgtctatatttgaaggtaatgaccagattccacattttaacttgcgtctgtgtttgaagtttcatatagcagattaagtgagtttcactgtcaattgagcctaaccaccgctagatactgaagaaaaatagggacagaattgaaacaaaaacaaaaacaaaaaactccaatcctttataaaacctgtctactgtttttttcttgaataatatatgcaagacattttcctcataaatgtcatagtaaatggctgaaaaccagcctccacaaacaagctttgaatacgtcttctagcattcctaaaattttaaaacatgaagtgaataccgtctcttactatttgattcaagtagtatccttaaagaaattcacaaataacattatattgctttaaacgaactactacttcaaataggacaaatgatatataatgagcttttttatatcttaaaaattaagatgtacttttgttttaatcaatggaggttaaagttatagtttaaaaggtatacctcttctaattaagatatacctcttcttctaattaaaccctccaagtcaggcagccatctacagtgcattaaagttcagattttgcataaaaactcattatctaaacttgatgggttttccttcctttcaatacaccacaccctcagaaggggtctaaaccaacaagaccctttaagaaatgcaaaataagacctcaccttggctcactgctgttcactgacaaacctgaggaattctaattctacttggaaagaaatagtcttctatggggaataaaacattttaaaagaaaaaaactatattttttgttatatccacatgcatcttgagacactgttttatattgcaacagatagagtccattacttcctctactggccaagcctagaaaaagagttactctattcccaacaagaaggaagaggtgttatttaaaacacacacacacacacacacacacacacacgcacacactcaccccccccacacacagcacatatcttagagatctatatgaaaaggagtgaaaaatgataacagagaaacttactgaggtactacccagatggaaggagagaaaaaatatttgtgtggtaataaacagcaattattttgcagttattgaatagaaagaaaatgtatgttcagttattagaaaatttccatgcaaaatatgaactttggtgagttgcagatagagaaattgaagtctctgtgttgaaggaaggtaactctaatgcacatggatatgagaagctgaagtgcagaagagaagtagctaaggaccaggaaaaagccagttggaaggattcagaccacagtggaattgccgattgattaattaggatcatggattgattgattagtcaagtgggactggattagaagaataacaacagcacagagtgttttgcttatagtctgtagtaaatcacctgggctttaatcaattctttagtaagctgtgtataattcatttcgatgtgtggatttggttttcctgcatttgtccagggggatcgtaagagtctgaaagactgtatatcaaatttgaaaaatcctgccagataattctaataggagactgatgaggagacatattgtatggtggttacatttcagtctctggagtctcccaaacatgggttcccatttctattccattggctactagctatgtgactttgggcaggtgaattagacttcagagtttcaatgtttccttctataaagtccagatgctaattacaataactatttcaaatgcttatggaaatgattaaattaaaaacacataaagcacagcacacagtatgtgatgcagagcaactgcttaataaatgtctgctgtaaatggatgcataggccagtctggaaagaccacatggggctctaatgtgcgttggtcagaccctgcccatcctcagaagtagaaaacaaaatgaaggcatagatctgactgcagagttggtgaaggcataaggccagtgctgcccttattggctatttgggactattcagcttcatgatgtgagctctgtgcttttccctggacccatctggggtggttaagagcagggctcaggagtcatactgcccatctctccagctgatcagctgtgtgaatttgggcaggatacctagtttctgtgcttacatttcttcagtagaaaagtggtgataattaagaacaccaccctctgcatagggttgttatagagattatatgagctaatatatttagggcatttttgttgtgtctggcacatagcatgagttcaaaaaacagtaaaaataattttaatataacactgataattttaactttgaaatagacctctaggattctaaattccactttgtttcccaataagagctttgcagaatgaatttatggagagaatgagaaagaataaagttaggagtaggtagattagaggtgggaaaaaaaggtcaagaaaatttgtaatggagataattgaaagtataaccaggctgggtgaggtggcttacacctgtaatcccagcactttggaggctaaggcgtgagaatcacctgaggtcaggagttcaagagcaccctgaccaacatggtgaaaccctgtctctgctaataatacaaaaattagctaggcatgatggtgggtgcctgtaatcccagctcctcggcaggctgaggcgggagaattgcttgaacccgggaggcggaggttgcagtgagctgagattgtaccattgcactccaacctgggtgatgagagtgaaattctgtctcaataaataaataaataaataaatataaagtattaccaatatgaacaggataacatttctgaaagaacatttctgaaaagtagagaacataaaatatatatagagaaaaaatatttgtgtgacaagacagcaataattttgcagttacaattaatgaatgaatgatataagcagagaaggaaagcttaaatatggaaattaagaaccaacatgaaagttgtatcaaatatctttgcatttattgttcactaaataaacttttaattaattgattggtttttgattaatgtgattaagcactaaactcggcagataacctgaagcctggttctttgcacagagtagggctgagacaaacgtatggtttttctatggtctctgaataaggccagaggcaatatagtggatctctccctctttctcccccttctgcctcctcctccccttcttacttccttcctctctttctgtgtacacagagatttttgtcaaagctttgttactaagtaaaggatcaagaaagggattactaaaactcttctttaagtgctcactacccatattctcacccataaaagtgcacatttacttccttttttcctaagcaggcagctgagtgtcagtcgacctgctccagattcattttcatcactggggatgggggaggtttgctgtgggcaatgaggaaaggggttggttcattggaattcttttttctggcatctttttggctagttggatagtctacaaccacttgtgacactctctaaccaattttggatttcatcatcctcttctctctttggagcatccagagtgactgcagcagttgcccagacctgcccaggatgagagtcgtcagccactttgaaagacagctctagggatgcagaaagcatttttttttttttaaattcatctgttggtggagggtactgaggtccaggtttttctcagtctcagttaagcagaaatctgacctctgctctcccttctggccttgttctgaaacgatgaacaaatgtaaaaccacgagaatctactaagagacggcagaggagtgccaggccctccgacctggaacatggccctctgttcctttcagtatatttcgtatatggtgtatctttttaaattctaaagccaacaaatctctattttctttaaagtgaaagaaatggacttacaactttataattgtccatcataaaactggaaagaaatccacacagtccaggagagaggaatacagattttgaacataccagaacaactgctactggaataatggtgcaacgataacacacacatgggcaaaatagagctgctcaattccaaatttgcttttatttcatctctcaagaaaattcactcgaaacaggaaagaataaagctcacagattaaaggctattgatgcccaagatgacagtgatagtcacagaacatgaactctaagtcagtgctagtctcttggtccagataaattatgtatacttcagggtctaaagcaaatgttagaatgaataccttttttggataattaggaagtttttgagcatttgatgggagtgctaatcactaggaggtagcatgggttcactgagaaccagtcatgctaatcaaatcttattttcttttgttaaaggcaactatctggcaagtaactgaataaaacaaaatgacaattaatagaaagttttgctgttaagaatcccacaccatttcccaaagtacggaatctagctcacaggaacaggggtaaggatgtggtctaagagcagcatgaaagatttatgggatttcatccatggcatgttgagatgctgtaacccaagcagcaactcagaagcctgaggcacagagagagcaggaagttgatgctaaagggtgaaggagtgctgggctcagctcaggaactctatttcagaaaggattttgaccaattgcagcacacgtagaagacagataagatgatgagagaacctgagcaatgtcacacaaaaagtggataaagataccggatatttgtgttctggacgtgacttggagcagcagtgtggcatggaaaacacaggctctggagccagacaaatttgaatttgaatgctggctgtctccaataagctggagaagttccatggagaagttactaaacttctctgttcttgtttcctcatctgtaaatgtaaaatggaaacataatgtgtgccttgctgggtggccaggattaaatgcaacaacatatatcaagtgcatgatggtatataacaaatgcttaataatgattagttataatcattaatgtatatcattcagggacattgtaggtgacttcaaagatctttttccaaaggcctttttcttttcttttctctcttttttttttgtttttgtttttgttttttgagtcagggttctattccgtcacccaccaaaggcttttttcgtcagcatataaactggaggttctcaaatttcattgttcagaagcattacccagtgtcttattctgtttgtactgctgtaacaggatacctgagattaggtaatttaaaaagaaaaaacatttattgtcttataattctggagtctgggaagtctaagatcaaggcactggcatctggcaagggccttcttactgtatcatcacatcgtagatggtggaagggcaaagagacaaaagggggccaaactcacccttttataacagcataattctacccatgcaagtggagccctcatggcctaatcatctcatcaacattctaccttttaatactgttaaaatggcaattaaatttcaacatgtatttttgtccaaccatagcatctgggatgctctttacgaaataattgtgtaggtctgagtgaatccgaggaaccagcattttcataagaaatccaggcaatttcagaaaagaaggcaagtgaaccttactttgggaaacattgataaaaacattctgaagtcgctcctatcttcaaacagcttttcttctatgcacttttttttttcagttaccatcttctctttgtccttctctcaaaagatttacttttacttctacttggtaggtctaaacagcaaaacttcctaaccagggcaccagggaagcttgatgtgccacagaatgggtaatacctgggctgagactttgattccttctgccacagtccctgctggccaccagtggcctagtcccttacccccatgtgctgtaaaaagttcactttctatctatgccacgacaagtacaagactgagaagcactgccttagagagcaaggatcattgtttatttctctatatattacccaggacctggaaggcttcctgagtcacaggggacttcctctgtcatgctttctgaatcatagaagaatacatatttgttcaatgaatgaaagaacaaatagttggggaaaggtaacatatttcagctaactctacttcttcaatttccatgtactttttaatcctgtgttcagctggttccaccctcaccactctactataattgcagaagaacagaggctttggagccacaaagatgtggattccagtcctgtttctatcatttaccagttttttgcctatttcagatgtctactgctgcattaaaaggttgctcccaaactctatgacttaaaacaaccaccattttattgctcatgattttgtgggtgagaaatttggtaaatggggatggttcacctctgcttcacttattgtctgctgtgctcatttgtgggctggaaggtccaagttcgagaggtccatggcctcactcacatgtgtgaggtcttgggctggctgttgactgaggcatctattttagtcttccagggctactgtaacaaaatagcatatactgggtggcttaaacaatagaaatttattttctcacagtcagaagtctgggaagtccaagctcaaggttgcagccaattccatttctagtgagggctttcttcctggcttgcagagagctgccttctcactgtgtcctcacatggcagagagaaagcaaactctttgatgactctttttaaaaattattttttatttctataggttattggggaacaggtggtgtttggttacatgattaaattctttagagatgatttgtgagatattggtgcatccatcacccaagcactatacgctgcaccctatttgaagtcttttatctcctgcccccttcccaccctttcccctgagtccccaaagtccattgtgtcattcttatgtctttgcatcctcacagcttagctctgcttgtgagtgagaacataagatgtttggttttccattcctgagttactccacttagaataatagcctccagtctcatccaggtcactatgaatgccgttaattcattcctttttatggctgagtagtattccatcatatatatatacatatatatatacacacacatatatatacacatatatacatatatacacacatatatacatatatatacacgtatacatgtatatacacatatatacacatatacatatatatgtgtatatatacgtatatatacatatatacgtgtatatatacgtgtatatatacgtgatatatatatatacatatgtatatatacgtatatatgtgtgtatatatatatatatatcacagtttctttatccactcattgattgatggacatttgggtcggttctgtgtttttgcaattgtgaattgtgctgctatatacatacatgtgcaagtatctttttcgtataatgacctcttttgctctgggtagatacccagtagtgggacagctgcatcaaatggtagttctacttttagttctttaaggcatctccacactgttttccatagtggttgtaccagtttacattcccatcagcaatgtagaattgttccttgttcactgcatccacaccaacatctactgttttttgattttttgattatggtcattcttgcaggagtaaggtggtatcgcattgtgcttttgatttcaatttccctgttcattagtatgttgaccattttttcatgtttgttggccatttgtatatcttcttttgagaattgtctatccatgtccttatcccactttttgatgggattgtttgtttttttcgtgttgatttgtttgagttcgttgtagattctggatattagtcctttgtcagatgtatagattgtgaagatttttctcccactctgtgagttgtctgtttactctgctgttttttttttcctgtgcaaaagctctttagtttaattaagtcccagaaatgtatctatctttgtttttattgcatttgtttttgggttcttggtcacgaaatccttgcctaagccaatgtctagaagagtttttacaatgttatcttccagaatttttatagtttcagctcttagatttaagtccttaatccatcttgagttgatttttgtataaggtgagagatgaggatccagtttcattctcctacatgtggctagccaattattgcagcaccatttgttgaaaagggtgtcctttccaaataaaatacttaggaatatacctaaacaaggaggtgaaagacctctacaaggaagactgcaaaacactgctgaaagagatcagagatgacacaaacaaatggaaacatgtcccatgctcacagatggatagaattaatattgtgaaaatgactatactgccaaaagcaatctacaaattcaacacaattcccatcaaaataccaccatcattcttcataaaattacaaaaaacaattctaaaattcatatggaaccaaaaaagagcccacatagccaaagcaagactaagcaaaaagagcaaatctggaggcatcacattacctgatttcaaactatactataagaccatagtcaccaaaacagcatggtagttgtataaaaataggtatacagaccaatggaacagaatagagaacccagaaataaacccaaatacttacagccagctggtttgatgattcttataaggaaactaatcctattggatcagggctctacctttatgacctcatttactcttaattaagtcctatctccaaatacagtgacatcgggaattagggcttcaacataagaatttacagttcactctatagcagtatctcacttcccttctgtatgatattctttctccacattgtttctcattcttctggacccctctccagcaagatatcctgtaaaagttgcaagatcttttcaagtctagactcagctcagaatttcacttctacacattctgttgaataaagtgagtcacaaggcaggcccaaattcaagcagaggggaacagacttgacttcttgatgggaagagtggtaaaatcacactccaaaaggacacatggaattggagggatagctatggctgtctttggaaacagtctaccaatttgtccttgaacaaattgtttaaccacctgattttactttctttgcctgtaaaataggaaatatagcatcaaccactttgggatgttgtaagtaatagattaagaaagtgtgtttagcacctcgtacattgtagtagaaacataacagaaacagcaaaaacacatattggttgagcccatactatgtggcagcactattacaagcacttaaatatattgctttatgtaatctttgtaacagcccaaagatacacgttatctttgagataagatgagaaaccctaggcacaaaaatgttaacttgcacaaggttggttgcatagtaactagtctgtctaaatcttgaatgtcttactgtctactttatccaaaggacactttttagttttttctctttaaactatatttgaaagtttacagttgatgttgctcgctcctctaccaaacactcctcctcccgtgatccctatgactcccctctgtacaatctttcctcctgttctcattgctaccttccaatctcctctttcatttcttcaactcttctttcttgaaggaaccatcccatgtggcaactcagtttctacctttccaatgatgattgccagtcttcactctctcctaaactctaggcttgcatttctaagtgttattagggtgtgagcacatatgacccaggtaacgttttgaaacgtttgtgcctttcacttctttcttattccattggttgcaatcttgtcacttaatacttgaaatgtttttcaaatttggatgtttctagcaatcagctaatgcctttggcctggtttaggccttcatcatctcttgcctggtttatcaaagtcattttttaactgaacttgttgctttcagttcctctctgacatgatggcattagggtaatatttccatgtgcttcaacacacataccttctcaccattactatatgtcccccccgccacccccccccagcatcacactatctctggtgtcaccttctctgttcatggcctttttcttcttctctaggggttcccccctttgaagaaacagcatctgctcaacctcccctacaggctcccttaaagctggtttctcctccctctgtttgtctctttgcaactctctggaggcatctttacctttacaactttgcattttctctgctattcccatgtaagttccctgaaaccctagtaccattcacagcaggatttcaaaggttgcctgttgcgtgagcattctataggatcccaaattatctttctgtgcaaatatgaattgttgtgatatgtccgtagagacggcacaacctcatggctaagaatgatagttaccagttctagagatcctactctaattgctctagagtgggggcctgaacaccagtattacaaaaaagacaaaagaaaaagaaggaaaaaagaaaaaagaaagagagaaaatcaaagctaccttcatcatgtatgaatttgagcaagtaacacctttgtgagtccccaggccccagtttctcattggtaaaatgaggataacaattacacagaccttgttgggctatgtacagaattaaatgagattatgtacctaaaaggcttgtggcacagtgacacacacacacacacacacacacacacacacacccagagtacttcgtggttatttctaggctttactgcttgaaaggctgaaaagatgggtggatgagaggtgccctgaggttccttccaactctccaagattctgtgatactcctccttgggtgctgaagacactttggcaatgtttggatttccaaacggttgcttagaaaactaagggacccacgaagcccaggtaagcctcagggtctttcccaggaatcgtttatttatttgatcttagttctgacctagagcctccaccttctccatccaaatcaccacagtggtcgaaaagggcctgtgcttgggaaatccttcctttgttggcgaatcttggacccaaaccctgcatttgggcatctgacacccataggcccatggttcaaacccaggcggctctttccaagttcgaagcagggactcggttctgcgcatctggcgggtgtgcccagattgtaaccttcgcactaggcatccaagaacgtgctttggacacactcggcggtgggagcgggtgcttggtttgcatcagggatgaggggtggagtagcgaaagcgcccggagcgcgcactcactcacactccccaagccagggcgcggccgctctgggcgcgaggtcccaagccaagtctcgcgctcggccaggagccggggagtaccccaggtccccggtctggggccgccgctatcctaccctgcggcgcgcactcctgacctggccccgccccccggcggccgcgagtagcgggcggagcgcaagcagagaggcgctctgggctgtgcggcaccgcctctcctcggtgtctggggagggacggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccaggtgagtgccgccaccgccgcctggagggacctaagggccctgggctgggacttggggccgcaccggggcctgaggcagaacagcgacgcggactgggagagggcggggggcggccaccgagccaggagagtgatcaagaaccagcgcactgtggcctgatgctgtaaccaggcggggacccgggcggtggctactgcacggaggccgactccgggtcggctagggcagggttggagggaccacgcccgccacctgcgctcccatcgccaaggctcctgggggcggctccctagctccgagctacgctctccacttcccgggctatctgcactcagagcgaggggaggccgcggcggcctcggagccgtgggaagggggacgaggccgaaggaaactctgggaagttgggagttggggacggccccgggttggggccgaatcccaccgggtgctgctcatcctttctcccaagcgtctagttcctttccttggtatggggtgagaagggcgggacgcgatccggcgttgggccggggacagggtgcttctggccttgggcagacgggcctgaacccgttcccggcgggtcgcacggcatggaggtggcctgggcctgggcgctaggctcgaccagcgactaccgccggccacgatggggttcgtagactcgtcggtcctggcttgtgcacctgtagttactcctagtgaaagttgcaaagctcttaactttggaaagttcatttattttggcatttgaccaattaaggttggaggagggagttttagtggagccatttgcttttcctgaggtccctgggtctcccaggtcgtctcatccgttactggctactggaaaatgcattccttccaatgtttgcttgagatgtttctcacctggagaaatagttttctcgaatattctcccaacctaagtacttaccaaaacagcatattgtggttggattgttaaaaatgggatgagaaaatggcctttctcttgatattgctatgtataaatattggaaatgagctattgccttgcaaattatgatgtacgaattgaaaacaatttattatataaaaatccatttatccaaaagataaattaaagaattatttgatttataaagagtgtcacactgagccagacttaaatagcatatccttgatatattcaagatggtcgtgtggggtgaagtcatctgctaaaattttaaagtttatatcagattttccctaccagaggcttttttttcctattgaaaaagaaaaaaatattgttttccattgccggtggttatattaactaagtttattgaatgatcattgatatattacttcaaagtggataattgggtagagaaatactgatcccagtggtttccagggaggtttaatgtccagcctatgtgcatctcattgctggatgtgatgtgctgaataaaccacagtcccttatctcacaagctggagtcccaggaagatgtcttaagtcggggaagttcgtccttaagcagcagaagcaagacaattattttgcatgctttgcccaaagcaagtattagtattgaaacatctcacttccttgcctgtgaccagaccacgagttctccttgttatcccacataagcagttgtctttggctttacaagagaagatggatgaggcctatctctgaatcacatctttttggccagttttctgcttctactccttttaatccgggagctggatcctgtgttctcagattctcttcagcccctacaccaggcaacccctgagaaagagtcactaagtaggcttcttacaagaggaaatctgattccttggcggaggaatagctagagataggagtcgaccttgctgctctgagttcctgatagcagtgctctgctttcttaaactaggacacaagggttttgaagtagccccatgcccctgtggctctttggtttttgttggaaagtagccagctcatgaggacaggggtgggggttttcgagtgcaaggtgagaggaaatgaggccaaagattacatccaaagtgcaccctctccttcaggacacttctcccttcatttccaaatctcccttcatttccctccttccttgccttgccgacattaattcttacatcagatgcatttgtcttcatccctctgaagcaagagtgtctttaatctcggaaccctaaaagctgagtagtagaaaagctgcaccacacaacgccgtgtgaataatgtccctgctgttgatagtgtgaaccagaacaaccatgcacagcagccctgagacatgggttcctagagagagtcatctcggtaaatggatgacttctttttctggaaaggaatccacctgaatgccatgtcccagctttctctgttattgtccattcacggccaccctgtgatagctaggttttctcaagctgaactaaggactttggttataaaaggagaaaaaagatataatttcctgtggacagcaaagtgaccctgcatctaggaaatttactcattttttcagaggtgtggaaagactagggcacagaccagcgggcctgagccatcagaaaggttcttttttgtccaggtagttatagtgccctgttgggggagtaccgcacccagatttccctgacttggtgttcacagaggacttgatgcaattgtggtttaaaaaaataagcctaagtcacagttggaactgaagtgcctcacccagtctgtcatctgtaccaacttgtggaaaggaaagtgctgagtgtgagcacttttgtccatagaaagcaattagaatgctctgttggttgcctttatggtgttttatatgttaatgatgtgggacataaacttgcaggcctcagagactagcctttaaggcagagggaacagcaagcgcaaaggccctgaagtggtagcattattgatatgattctagaaatggtgacttcagaggtggctggagaggtgtgaaacagatggagagtgataagacgtgtatggtcaagagttagagagggtggatcatgcagagtcttgtaaaccattataaagactttggtttttactctgaatgagataggaagccattagaaggtgctgagcagagaagtgacaacactttgactgctatgttgaagagcaaaggtgaagtcagagaaaccacttaggaagctatttcagaaatccagacagaggtgatagtgacttcaacagggatagtggtaatggaggtgatgagaagtaattggattatgaatgcaatttgcaggtacagccgcaagtatttattgaaggaagagatgtgaaaggtgagagaagggcaattaaggatgcttcaaaggctttttgacctaaaaaattccatgtacaagtagaagtcttcaggaagaaggtaggggtgaggagggaaatcatgaggtttattttttattttattttaactttttgtaacacattaagtgtgtgatgcctctttagatagccaagctgttttacagttgaacagtgacctgaggtatgactatcctctttaatgtcaattgctctatgctcgtattttttaactggagacttcgctgtcaagaagattaattggttatagaacagtatgtattgttagaaggttttccttgtagggaattaaaaggtctcttaaatttctacccatggatcttgattatactttttttggtcaaaaagcattagtcttatctctcttctccatcatacacctttggctattaggaggtaaactagcctaacttatctagatccactctttccaaggaacagaaaggaggattggatcatgtaatgactaggtcttaaacatgtttttatcattttctttttaagtcttttcttctgtagggtgccaaccatgtctgtgccaagcactttatgtaggtcatttcactagtcctcacaagtcttttaagcacttatctgtgttccagcagcagcagcagctgctgggagcttgttagaattggagatctcagttatgtcccagacccactgaatatgaatctgtatattaacaggatcctcaggtgagagttgtaggcacattaaagttcaagaaccatggctaaaagtgattgatatatatgagtaaactgaagtccagagaagtaaactagcccagggccatggagtccatttaaaagaagaattgggtctaagtgaaagtagcttcttaggtagtcacatcacatgtactgaaaactgaggagttattgtcaatgaaaattttctaggtgtttttcataagagccacccttagacctactttctctcttctgtacttgtatgatggatttaatccctaagtgtaggtcacattctatgtagttgtaaagattcagcttagtatttttgattatgaattctgttatccaggatactggttttccattcatgttccaactccatattctggagatttttctgcatgttctctgtgtctgtacccaatgtttagaaaaggttcagcaggtcagagtatgaagcagagccttaagactcatgattagtgattcttctctccatgtaaatattactctattcaagaaaagctttttctaggtcatggttttcaactttggctgcacattaggaatacttagggagctggaacaaacaaacaaagaaaaaacaaacaacagcaacaacaaaaactaccaatgactgggctgcaccctagaccagttttaaatcacagtctctgggaaatgggcctggtatcagtatttttaaagttcatctattgattctaatgtgcagccaagtagagaacaacctttgagaccattgggcaaagaatgcatccgcctaacccttctcagctcagctcacatttgtttcttgcaaaattaggaaagatagtatcaaaaactaggaaccttgactgttaccctgtacagctagtgcccatatcaactgattcttaactttcttttcccaacgttatcctacatttttcttttaagggctcattgaacatatcataaggctctattatgtccaccaatctgagaggggaaaaaacaaacaaatcaagaaaaatcttgtctaaatagtgtgtcattaaaaggtcagaatatagaaccttcacaaatgtcaccctatgttaaattataatgaagtcacttattagaaaatgtacatgtaaaataataattaaatatagtttctatgaaaaaaatctccaaaataatcatcaagattaaatattagccttgattcaaatttttctaaggtagtcaaaagagaatcagtcttgaaacactggatgtttatgaatagaccttggtgtgattatgcacaatgggattaatttttttaaattaatgttaattgcaatcaggaaaaagagtcttctaaggaatgagtggcatattggatgcacaatatgtgaagatctaatttgcatttacttcggtgacatttcagggctccttcataaatattttatttaaacaagtgtgttttcatctctgcgggactcctctacatggaccagtgagtggtttagtcatgaggtaattatcaagaggggaaaacaaaagcaaattgtagtaaaggcatcacaggcagccctatggccagctgcctctttcaaaataaacaatcaaaagcacaaactttttgatgtgggataaactctcaaggaaaaattaaactgacacctaaaggaaatcatcctcaaattttctattatgtatagagcatagatgttgctttcactgaagtagcattgaggcacttttatgtttgtgctgcaagtgcaatttcccatatggttggcttaaaaacattcataatctcttcctaacaggttgacttgagggaactaacaagttcacactccaaagtgtatagagaaagtggaggagcttagtgagaggcataaatgggggagcaatctcacttttaaaaggacaagtatggagtatgtatttctattttctgaatgaagtttgaataaaatcaccatttgtggagaagttttcagttttcactgcaatcttggagcaataaatgtgcatcacgacttccttttctttcaaatgtttatttggtgggctctaggaagggctttagaccacatcaaatcctgaggaccaggctttgcagatctctttgaaatcttcatatggccttgcacatgtattttatcacacaaaaactttaaatcaacattgatagaactgcacttgaaagaaaaaaaaatcttctaggacatcaagatgacaaagtggaataagcaaggactttggagttagaatctgactgcacttactaccttagtgaccttgagtaaaatatttaactcttcattttattcatctataaaatgggagtggaagattgctgtaacattgtgcccagagtaaatgctcaaataaatgatcaataaattgatgttgttggtagtatcacctgcccatgtttcctttcagccgtggtccacaaacatgtatatgttttaccatttgtaattatttgtaggctaaatttactttctacttttttgtaaacttagcattttattacctcttattagctgtgtgttcctggacaagttatttaacctctgtgtcctcattttctcatcagtaaaatgtattactagtatctgggttactagttacccagataaaatacaggctgccagttcaatttgaatttcagataaacgacagggaatattgcatggcacataattatacaaaacaatcatctgttgtttatctgaaattgaagtagaactgggcatcctatatttttatttgtgatgctgacaaccctatactagtacctatctcgcaatgcatgcgaaataccatagtacctggtatatgctcatagtaattacacgtagtaaatgctcaataaatactagccattatttctattattataattttcccattgttaacacttattagtacgtaattattattgttgtgatgactatgtatattccaagaatgggtataccttttttatttaaccattcttttgaggctattctagcttgtaatttttttttagtgtgaataatgtcttgtatttatagtcccctgtttccttttgggaaaattttttcatgataaattataaacagtgagccctaattgctttctggtagatctatgttagttagtcctgctacatgtcaacagtaaatccgctagcattaggtgtataatgtgaacaaaaggttgctaatttaacatggtttaaacagctgcttagttgtttcaatttgtgttttttttgttggtaagactgaatattttttgttttgaaccttcttatatttactcttaagtgaattttttgtgttctctaccacattctctatcatgtaccagtttattttttgagaatcttaatgtttttttctaccaatttccattaattagaatgtaaatattctgtcaaattagctcacagaaggaatattgtatagtgaatgagctcaggttgtctgactataatcaacccattatattaaagtgtcttttgaaatttcaggggtggttcaataaatagggattcgttgtaacactcttttccaatgcaaaatgctgcatttatttatatgaaatatgaaaaagttgttataatttgaatctctttttctttatgttttctttcccactccaacctaccccaccctacccttgtgcagctgttacttaaccacgttgaattgatcaatcttttctagttataattaagttaaattccaaaaacatttattgagggccccttaagtgctatgtacaaggttgggcatctgtcattcaaagatacattagacatgcttactgcctctatggaattgacataaaacaataatggcaattaataaaatcaagaagggagatatctactggatacagtacagaaaaaagaggagagaagtaattagctgacttgagtggatctgcagaggcttcctacagaagtctattcttgggcagaagagtttgtctggaactagttggtgggaagagcattctaggaatttacaaaggtcctaacacagaagaggatggatcctgggtaacagtaagttgagtgtgtgttggcaatgttgagagatggatctgctctagtaaacaatggtcaaatcagatcacgaaagcccctgtatgccattgccaaaaacccactgaggactaactggagcactctgacacagaaatcttgaaagaagtacaatttatatcataagcccaaagcaaagcacaccaggagatttcagttccatgaatgcagcttctgaagtcttcctggttccttatggaaaatatactcaggttactggcaaatatgttctttctgtccaaggtaaggtcctaacagattggaatcaatgaatggaagtttacccattttagatccccaacatatcaccctgaaacccaactgtaattaccttgaatagttgtaaatactgcctttagcaagtttagtcatctggttcaaacatctggattccagatataattcctgactatgccaacagtgacatcttgcttccttgcctggttatttagtaatgaaaaagcagtgtgttcagctgcattgtaactatccagtctgtggatgtgcacagtctgttttctctgaagttatagggcccaagagggaatacgcatggcaggcctgcctagtgcccaccaagccacgctgtagagatagttctttattgtgtgtacagggtctgccaattaacaggcataattttaaaaaataattgaattgaatgcccttaagtgggtcacaggctgtccatttctaatatctgcctcctcgtccccaccacatacatgtacactttgcttatcacatttttgggacatgcctgcctattgaagacatcttagtttgtatcagctgtagcactgcagaaccattaaaagagtttacgctgaaaattcaggtgagttttatcccttaattaggtattctggagacaggataaacattgattggagaggttatagtaggggatgccagttatttgctcaccatatatttattgagcatctactaagtaccaggctctatcctaggtatgtacaaatgtagatacctagacacagtattgtacatacagtagggaatgaaacagaaaattaaaagtttgccctcatgaaacttacattttgggaaaatgataataggtacataaattatattgtatgttagatagtagtaagtgctaagggaaaaaacaaggcatggaaagagatcaagacataaagactaaactggcaccactgagaagttgacaaatgagtaaaggtcagaaggaaatgtgggagcaagatacacacgtagcagggggaagagcgttccaggcaggagagcggcgggtacaaaggtctcaaggcaggagcatgcttgacgtgttcagatattagccaagggttagtatgactgtagtgaggttggcaaaaagagagtagtagtagatgaggtcagagaggtgatggcagactgattgtaggcctctataagccattttaaaaaagtgacttttacttgcagtaagataggaagccattagcaagttttaacagaagagagataacatctgacttaggaagagaaaggatcactctgaccagcacatagaaaacagactataggaggggaaggttgaagttagggagaggagttataaagctgttgtaatcatgtaggtgaaagatggtggtggcttggaccagagtgatagcagtggagatagtaggaggtggtcagattctgggtagctggaaggtggagatgacaacatttactaatagatggatattgagtgtgaaagacagagaggagtcaagactaagactgtggcctgagcagctaggagaatagagttgtaggagaagtaattttgaggggaatgaccagcagctcagttcttgatgtgggatattggaaatgcttattagtgagcccagtggggatacagactagccgtctggatatatgagcctggagtttgggaaagatggctaggctgaaggtataaacatgggagtcatcagcatgtatgtgatatgggtctggctgaaattatctaggaaggcacagtgaatgggagagtgaaggggacccgcactaagttctggaactgtccaacggtaagaggctagagagaacttgaggaactacaaaggaagattaatgaagagagactagaaatgaaagagaaaatccaagcaagagtgttgacctggaacccaggatgaagaagaaggtgatcaaataagaaggaataagcagctgtgtcaagtgctactgttaggtcaagcagaatgaagactgggcactcaccattgcaggtagtgatgcaggggtcattggaagtaatgttgacaagcatttttgatagagaggtgggaacaagagcctgattggcatggctgtaaaagagattgaagggagaggaattggggcagtaaagacagaatagtcttttaagtttttctgctgacaagagcaaataaatggcatagtagttgctagtgagggaagtgagatcaagggttgtatttatttatttattcgtaagttaggagacttaacagcaccaaggtgaagggaatgactagtacagaacaaaaaatcatgatataggataaagaggggaggattgctagaatgatatccttggttgagaagttgggtacatttcccgaaagttcagtgtaggcatttaggcaccaaaggcacatagatgatatttaaaaccaaaaaatctagatgagcttactgtcttagtccatttgcactgccctagcaaaactaccataagctgggtagcttatgaacaacagacatttatttctcacagttctggaggctagaaagtccaagagcaaggagctggcagatgctgtgtcaggtgagggcgtgttcctcatagacagcaccttctctctgtgtcctcacatggtggaaggggtttctttcataagggcattaatcccattcatgggggctctgctctcatagtctagtcacttccccaaaggccccaactcttagcattatcatactagggattaggtttcaacatacaaatttggggaggacacaaacattcagatcttcacacttaccaaggggtgaataaaaatagaaaagaagtcaaacaactggttagaagtcagagaaatgtgcaggaaccaataaggagactgagagggaccagaaagtaacgtggagaaaaatcaagaacatgatggcttggaaattaagaaagtattcctaggtggaaggaaggatcccctgagttaaatgcccctgataggtcaagtaagatgacaaccaagaactgaccattgcatttaataacatgaaggctaattggtgaccttgaactgaatgattttgggagtggtgcctcagtggaactggtgaaagtctaactagagtctttctaaaagagaatgagaggagagaaattgagagaaaagagtataagccattttttggaattattttgtgaagggagaggagaggagaaactgattcaaaggatggcttttaaaggaaagacaaaataactgtatgtttgtatgctggagagagggaaaaatgatgtagaggattaaactgctggagtgatgtgctgagtaggttgagtaggtgggtttttcaacaacagtttgtttattgtcatgaagtcagggcagaatatatgggcacaggtgggcagatgtggtttgggaatcttgcagaagtttgccttctgattgctcttgtattcttggtgaaataggaagcagcaaggttataagctgagagtgaggatggttaggaagtaatggcaatttgaaaataagagagttataaatgtttaggagagtggaagagcaaatggattagggaaggaagtgtaattgccaggcaatactaagcacctgcttgaagttggcgatcatgaatttaaagtaatttccatcagcataggtgtgtgtgtttcttccatgttcagctcttttttttgcaggcatggaagagagggaagtttgtgtttaagccggggttgtgtgtatgagaacaaggaaagagtagcaaaagagttgagggtatgtagaatagattggaatgattgattctgaaatttcattggagtaaggagagaaaagcggatatgtaaaaggattagggatagtgaagacgtggtaggattaatggattgtaggtcctggaggggtggaatgcttgttgagaatgcagtgaggagaagggggccagagaatgagatgtttgaaatcaagattctggaggagctgcaactgttgacatgaccacgtccaggacatgatcatgagaggcatgatggggagagggggacaaatgattgaagacaggagctcaaagaactacaggcccagggttttggaagtgttatcgacatggatattggctttgctgagaattatgacaaaagtagttttggagagagtgacagtaagcgagcaactgggctctcccaggaatgtgggggaagcgacctgaggaatgatagatgtctgcaacaaggatgggcagttgtggtgtagtggtgtgttcagacaatatgagatttaaagctgggtgttttttaaagaaaacagcagcaggcagtaaactattaatttttacttaagcagaagtgttgaaggaatattttaagtcagtagagatgccttaagagatatttaagagataaaataattagtacaatgatatgaaatagagagagatcctgattcccaattttttttgcatatgtgcctggaaagatgtgcttataacttattaggtttaccacaggaagtcaagcacattttgtgggaaaataatgagattgattttaaacacattaagtttgggatgtgtatgacatctcatgcagatgtccagggcagttgactggtggaaaactgggaagaagttactggaaataaggagggtgaaaagcgattgaatgtcaaggccccttgcaactcaaagatttttgtaaagtggttcccagttccaggtatgcatcaaaatcagttaaggaacttttgaagacacaactgccctgtcccaagattgactaagtcagccttcaggggtgacacctaaaatacctctacacagctagggttgcaaatgacatgcacttacggccttcgtggtttacaattactttttacagccccttggtcaaaataaatgctcaaactgtctatgtaaaacttttataaaatattaggcaaggaaacccaaactcgaaaatgtgtttactatctatcatggattctttttttttttttttgtagccacagtgaattatctcaaattatttgtaagtacagctactattggcacaattactaataaattctgtagaaaatttagctgtaggatgtaactgtagtgtcctagccctaagtaaaatcatggtcttctttatcgctaggcaagtaatatgattatcatttgttcttattttaggataaccatacggtacataaaccctgtgaaaactctaactaggccatgaggttagagaataacatggttgcttgattcctgtaggctataaatcatcctagccaatatgctcacttcttgtcagaaaaacctgtgaaacagagaaagaagctggacaagaatgaggaggccacattagaatcacttttaacttgggattcagaggatcccaagttaaacatatttccattcttatttttttagataatatggatgtcaattgttggcatagctgagctagctctgaaggcttcccaaattatttcagagggaatgagaaaacagtgctgcttgctcttctttaatctgttccaccgtgactgctactttagatttaatataactgtaatatcccgaatttataggtcatccttcttctggggcttttaaagtactttgtgtgtattactttaattttgagggaactcagattcatcatcttatggaatctatttcagagggaatctacaaagagaactagaaagtcccccaaagtgtttcttttttttcttccagatgcctttggtaggaacattcattgattctaactccacactgctttagaggccatttatgtgtggattactgtaggctgctctgggggaaaatctaatccccacaggttcagttagagaggatccactctgcacgctgataaagattaaaactgcagctcttttcgattgcattgtcttctttttttatcttttaatttttgtattatcttatgcttcagtaattcaatcacatctgccttcccagtgcctcagtatgtggaaactgggaagttaaattgggcagagtaacaaaacaggagctctacttcatatgcctttgttgtaaaatgtgatgtcttagggtttgcagtggtgtcccatagtgctacagacaatcatcagatttgacccagggaaactcctggagaaaagtgagtagtaaatagtggccttaatgatgcaatcagaacatgggggattgtcagaagaggatcagagttagctttgtagtacttgattccttaaatgtttaggaagtagtttcattaaatatagtaaaacatttgtctactgatttatatagtttttaatcttctctttttccaaaacctcatgctaattaaattaacattcctataaaaaacatactgaatacaatatatatcattaagtgagacttattttaggttcataaatagtacaataaactgtaaagacttagaagtcataaacttttacttttcattaatgaagcaatatgtgaatatataaaaccaagtttgttataactttataaattagaaaaattagaattatgttggagactacaatacttcactgatagaatacatcaactagactaaatacatagaggatagaagttatagagttaaaataataaagaaaaatcatgttcacgaaacatttaaaaaattaatcagcacatgattaattttttagacatgacaataaaaaggaaaagttaaatccaacaggtaaaaatcgcatgggccacatttactgaccataaaataatcagtgagagattaagaagtaacaataacaatgccaaaactctaaacacttaaaaattgaactctttcagagatctcttgagttaaaaaaaatcagaaatggacactgaaattatagacattgagaatacaatggagtataaccaaagctatatctagatgacaatttctaattctcagttgttaatagcaaataaatacagcaatagaaaaaaaaatgcattgaagttaagagcctaaaaatagaaaggtaaagcaaatcaaaagagaaaaaaaaataagagcaaagcatcaataaaaccaaaagaagaaattactgaattagaaagtgaaaaatcccaaagaagcagtgttaataaataaaacccaggtgtgtctttctgaaataaaaaataaataaatattgtgctattctgatcaaggaaaaaatgagaaaacacaaatataaagcaaaaagaataagaaagaggatttaataacagatacagaagacaatagaaagcacaagaaaatggcatacatgccaatgatgtagaaatacaaattgagtggaagtcataaacatctcagagtgagtataaaaatatttagaagaaattgaaaggtagtcaaagaactttctgtgtaaaaaggtataggcctaaatatttttataggttaagtttaacaaaatattaagtactacatcagccctcttatttgtcggaaccacaaatagtcattacaaatttgttttaagttgtcattgcaacaaaagttttcagtgagcacaagaattaaaggtcatcagcacttccattaacaattactgttaatacttttaccagaagtggaattgctaggcttatgcacgttaaatattttgatataaaattatcaaattgtcctctagaaaggtttaacaattcatatactgtaaaaactatactgtggcatagaaaaaatatggaaggcatcctaatttactttgtgaggctagtatcacactaatatcaaatctgacaaagacaatagtaaaaaaatcttgataccaatctcagttaagcatataaatatattgtaaataatagaaaacaaatacagctttgtattaaaaatactgatgtactgtaacctggtaggggtttaagactacaggaatggtaaagcactaggaagcctagtattacagtaataggttttttggttgttgttttatatatataattattttaacttttgacgatgtatgcaacataagtcacaaacttgacacatttttctctatctccagtcattctctggttttaaaaatataactttatcgagacgtgttttacatattgtagagttcactctgaaagtgtacaatggaattattttttagtaaatgtatgaagttgtgcaagcatcactataaatcagttttagaaccttttcaacattccaggaagtttcctcatatccattctctgttaatccctgcctcaggagactactaatctactttctgtctctattaatgtgtctgttctagacatttcatataaatggaatcatacaatatgtgatgtcttctgtgactgggttccttcacttagcataatgtttttgaggcctggctatatcatagcacgtgtcattagttctttcctttttattactgattagtattccattagatggatgtatttcattttatttattcatttaccagctgatggacatttggcttttttccaattttgtgctattgtgacatggcaatatagtatctggtaaagacagcatttcaaatcagttgggggggtgggaaatgggctattcagcaaatggggttgagataattgagtaactatttgggaaaaaacattatatgcctgctcctgaaatttttcatgtggtttaaattttacaaatataactgctaaaattccaaaggaaattatgtgataatcattttatcatcagaatactgtatagatgacagcaaaacaataacagcaggttagacacagaggtaaatttttaaaattctttcatgtaaagagacctaggagtagtctgcccaggtctgagagtctctaggtagtcttaagattcaggttctttctgtctttctatgtttgccttctttagtgcattacttcaaattcaaagtcacatcatgggctaatatggctgctggaattccagcacttacatttacatccctgagagagacaaaaacctcactttcgacctgagtctactcttctagagtaacctttctcgaagtcccactctatacttgtgctttcatctcattgatcagaatttagtcatattgccatccctagctacaagaaggttgagaaatgtagtcttttagcttgataaattgtcacttcaaatgcaatttaagttgttattttggaaaaggggaaaaacagatatggggtggcaactaccagtgtctgtgatctttgtagtaggtgaagccttccttagcgtgaccctaaagccaaaaaccataaaagacaaggttgacagattctgagaagcacaacagcaggaacatttttattttgcaaagttcattatcagcaagacaaaccaaaaatgggacaaaataataacaatgaatgatagagaattaacattcttaaagtgtactgctgaaatacattaattagtaagacatttgactgtctgtgccttttggagagagtgtatcaattctttggtaactccttaaatgtacaataataccatattgacaatgtttattcttattatataaatatatattttaaaccatgttgaccttttagcaagaaggtacatttttttgtatggggcattattattttaattctctcccctcaagggcacattttaggctcatctgttaaatgcagctcataaacgctgttataggctgtttgatttaggacagattcagctagattacctgaatactcaattaactgccacagtgagaatcgtttgctttcagatcgataagaagatcaaatcagtagccattctcagttcagtgcttcatcaggaagtgaattaaagcaaacccattagtggtcatttttctaaatgctaatcagtgaatttcaaattctagaaaaaaaattgcatgtttttagtggttattatagatgagtatcttgaactgagttcaggacttcaggacattgaaagggggcctggtttctagccatattacttagacaacaataattcttcacagctttctgttaatatcttctgatttaacaggcaagttggagccaagtggcctttggctatttggtatccttggtaaccactgttagatgatgaattgaattagttaaaattaatttcttgtgaaaagctgcttccatgagaggatactgactttgatgtttagatgcacaagacacagacacacacacacacacacacacacacacacacacacacacataatgtggagagagtgtcatcaggtgtggagagtttttgcaggtaactgcaaagcctaataaatgtaaaagtgagaaagacgaaggaagactgcaaagggctctgcctctaagaactgtgcttctgcttggagagggaagacttatataaataaaggaatctgaagcataatagtcactattatttggctggtgaagtagcctttcttttctcacatctgcgaatgttaactgtcatgacaaagctattttattgttatagaagtttgggaaaagatggagaacacattttttcaatataaaataatataatatatattttggctccaagcccacttttgatgtcaatttaggtagcatttttctttcatcctgataggtgcctaacctgaggaccatatctgctacaaactctgcactcccagaagttaacatttttagggttattgctagaacatgcacagcccagtgctggactgtgtacaatggattgctatttgcttcaaaagcaacactcctatatcctgttgggtctgtagcaagagcaatccattgtaccaagatgtgtcccaggtccctggcccaggcccgccagtcatgcatttccctggaggggcaagggagaaatggatgcccctgatttcagtcctacatagaattttaactactgctgacttcagaatattctgcttgtttttttgttttgttttgttttgttttttgagatggagtcttgctctgtcacccaggttggagtgcagtggcactatctccgctcactgcaagctccacctcctgggttcatgccattctcctgcctcagcctcccaagtagctgggactacaggcacgtgccaccatacctgactaattttttgtatttttagtagaggtggggtttcgccgtgttagccaggagggtctcaatctcctgacctcatgatctgcccgcctcggcctcccaaagtgctgggattataggcatgagccaccgcacctggcctgtgcttggtcttggatgaactataaggtatagatatttagagaaaaaatgcagaagctgagctgtaagaaggtaaatcagagcttcatgtataaattggactcttagagtcttttaccattgaatctgcttttgttctacatttaaatacttcctaaataaacaagagcagcacatatcctgggcagtccatgtaaactgaattcaaagactgcctcaccacttaatagttgtataatctggggagaattacctaacttcttggtgtcttaattttcttatctgcaaaatgaggataataatgcttataggggaactgagggcgtgagtaaggtcatgactttgggacacagcatgccgtttagagatcaattagtgttagttctattattaatcccctcagtggaagcctttttaatgtttcacaaaaatcggcataactgacttctgtcccattctttatttttgctttcttttacttcctccattaatctcttttcttttcctccacccaccttctagtgcccttatccattattgttttctctcctcttttttcatcttatcccctcttacttcattttatcctccagactttttattggtgtttttttttccttctgcataccttaagtgacaatgtaatgcaatctagctattcactcatcacgtttaacaggaacttaccatggactggtcactgtccttggtgctggggttgtgaaaaagaaagacatgatccttgtcctcaaggagattaccttttcgtggaggatacagacaagtaaacaggcaattgaaactcagtgcaataagggaaagtgtggtttgatctgggagcacataggaggggcacctatcccaaacttggaggaagtggtgtcaagaaaggcttctccagagaagaaataaataagctctgaagtgtcatgggaatgagtgttccagtaaagcatttggaggaagagtttctagtaaacaacatgtgcaaaggtttaaatgcttgaagtggcatgtgaccttagggaccctcaatgagttaggattggtggagttgaatttggaagttagagtggggggttgttgatgtaatgacagttaaagtcagagaggtaaataagggtcttgtgggtcatgttaagaatttacattttatcctaatcttaatagttatctatcttatgatagaatctatagaacatgaaatgcagtaggagagtggtataaaggaaatctaaggtttctgatttaggcagctgggtcatataaaatgcagaagtaagagcaggtagagggaatgagaaagagagactgaattgggttttagaaatgtgtatttaaggtatgtagtacctgtagttgtaaatatgggcctgaaatgaaaaaaagagtttcaaatcttattttgaaatttgatagtgattgcattcattattctatactgaggtttttttcttttgttagtgtttttgttttttgtttgtttgttttttgactggttcttctgaatgtccttacattttgatgggcatagttaaggaattatggcccaactatatgtagccaagagagcaaagtttaagaagaacatagttaaagtgcgagagagaacccagtatttatttcttctgaaggcaattaggaaaaaatcaggagtgtttaccctctgatatcacaagagttgcttaaaagaacttgaagattgctgctaagtgagtcccatggccaggacatggcctaatggtagtctgagggaagtgtatgaatgaggttttggggtgagtgataagtaagagcttgtcctacataaactcaatctccagtattagagaggtctccaaagcacctaatttcattgaataaaataaaattattactggatttattttaaaatctttggagtttacagcaaactaacacaggaacagaaaaccaaacactgcatgttctcactcataagtgggagttgaacaatgagaacacatggacacagggaggggagcatcacacaccagggcctgtcagggggtgggggacaaggggagggagagcattaggacaaatacctaatgtatgtagggcttaaaacctagatgacaggttgataggtgcagcaaaccaccatggcacatgtatacctatgtaacaaatctgcacgttctgcacatgtatcccagaacttaaagtaaaacaaacaaaaaatgtttagagtttatatttatttctggcttgtatgctgtttgagataaagtcttgtgacaagtttattacctgctgtgctatgtagaactgcctttgattagtcagagcctgacttttcttttccttccagtggagccccctcattaaggcatttcaagcttagttgactaaattcatgtttctgtaatacacatcagtcatgattctacactctttccttatatctgtgtgaagttcatcttttttttttttttttttttgacagagtcttactctgttgcctaggctgcagtgcagtggcacgatcttggctcactgcaacctctgcctccgggttcaagcgattctcctgcctcagcctcccgagtagctgggattacaggtgtgcaccaccatgcccagctaattttttgtattttcagtagagatggggtttcgccatgttggccaggctggtctcaaactcctgacctcacgtgatccacccacctcagcctcaggaagtgttgggattataggcatgagccactgtgcctggccaagttcatgttttaatgatgttagtttatttagttagtttcttcctatacagctgggcccttctcttcatcactatgcaggtcttccttttcttcacttctcacccaacctgatgcatagaaatggacctcagcttgaacttttggaactgatgctgtatagtatagatggaagaatgaggagttttcccttacaggatgcagcagccacacataaggccatctgctcagaaaacctagcagtgggtccccaacctcttcctcatggccacgttcctcagtcaacaagcattatttgaagttttggttacaatgttttccatcacacctgattcttcacacagattttgggagagcttcctggaagccacaacccactggagtgaggaatgctaggtgatctagtatctccatcctggccttgtaaagtttgggttgttggttggaattagttcttgcacaccaagactgcacagagccagctagcagagtgtgcagggcctctgagccagttctgggtgtgctccttgtccaccagccctgctccagcagattctccctgactagccagctatgaactttgccagtgtagttattctctctactacctctcccctctccaaatggtgtcttcctcttcacagccacactgctcataaaatagatttcctcccccaccttctccaaaccaccttagtccaattcccacacccaccacttctctgaggctgctgtaactacagccatcaatgacctgctaattgctaatcccagtggacacatttcagtggttggaatcctgctgtgtttgaaacagtgattactgcttcctgttctcttgaatttgcaacaccaaatcccattctattttctttcatgggtttcttttcttctacttgccccttaaatgttggcattttttatattactgtgacccatttcttctgtcacttatgcatttttcccaagttgtcctctccaatcctagaacataccagccttcaatatactgataattcaagattcatattccagcccagactgctgaagttcagacctgtatatctagccacctcctggacatctccatttgcatagatgaaggagcctctaaatcaatgtgtccacaacccaagttcattctggcctttccacttgctgctgttcctccacctgaaatgtttttctcacaggccccgcgtggctcactgctcacttcatttatcctctctgttcagtcagcaccttccccaaaagtccccatatgtgccttttccttccctggctttatttctcttcagatcatatgtgtctgaatctatataatatttgttacttgtttattgtttgcgcctcacccccaactagaatgtaagctctatttatctgtcttgttcactattatgtttgagccaatttctggtgtccaaatattaagtgagtgaatacaccatcccccacccccagactgatttctgtatgttttatcttcatgggtgacaccagtcccaccctcagtcactcaggttggaaatttggagttatactagaaacttcttttaccatcaccacatcctcactttcccatatccaacagtcaccagttcccgccagttttatctcgtaataatttctcagatctgtcttctatctctgtccctatgatcaccttatttccagccatcagacctctcttctgtcttattgcacctcttaatgtgcttcctgcctcagtttttaaccacccaaatccagcctcaatggaagccagagtggtctttctaaaaagcagatgtgaccctgctgttttcctatgtgaaactcttcagtgggcccattcaactatgggatcaagtctaagctctttagcatgacacgtgagaatatggtggaataaggtggaatgaatctggtggaataaggtgcaccccttgcgttagactaactgcagggtgtgccccacagtttcctgcctccattcttaagctgtcccctcagcctaaaatgattgtctttcccctctgccttccccctcctggtggattctccctcatcattcttttaagcatcagttttggggtcacctaaactccctgtgctcttttgcattttccttagcactgtacctatacttaaaacattatctgccagccaggcacagtggcacatgcctataatcccagcaatttgggaagccaaggcgggtggatcacgaggtcaggtgttcgagaccagcctggccaacatagcgaaacctcatctctactaaaaatacgaaaaaaaaaaaaatagctgggtgtggtggcaggcgcctgtaatcccagctactcgggaggctgaggaaggagaattgcttgaacctgggaagtggaggttgcagtgagccgagatcgcgccactgcactccagcccaggtgacagtacgagactctatctcaaaaaacaaaaaacaaacaaacaaacaaacaaacattatctgccatgtgtctgcctccttcattagatcagattggaactcactgagggaaaggactgtgtattatttatctttttattctcttcatctaactccatgactgaaacatagtgaggatttgataaacgtttgaataaatgaaagaataatgaatgacccatcgagatagatttctggctgaattctggtcattgtcatcaagttatggcataaaattacatttccaaaatctgaaaaatattagtgtaatctgcaaaatgtgaattcattatgtgctgtgtgttactgaacattgcattgttgcttttcagcaagtgctcatgtcttactttccctgttgtcctattaagttcaaaagtcgacttaacaaaatctaaacagaaaaaagagaatgggggaataggaacaagagaagattacatccatttttttttgtcttatgaatttgaagcattttctcaaatgtgaagaaaagggcactttttcagcagtaaagtaattgtgtttttattataaagtgtattatgttaggcatgtgggcaatatgactcaatgaatagttcttcaggattagtgtatgcctagttgaaacttaatgctctttccctcagcatgcatgtaggatctgaattttcactgtgaaagcaaatgctcctgttggagacctttatcatcaacttgttggaattcatgcctagaatattttaagttgaacaattctatcacagtggcatgcatagattgctgagaaaggcacagtgctaatgatgctgtagacatcttaaaagctaggaatgctccatgtaatgtagatggcagagaaaatgaagtgtgccagtctgttttctgttgcttataacaaaatatctgaaactgagtaatttctaaagaaaaggaatttattttttacagttatagaggctggaaagtccaaggttgagaggtcacatatgatgagaatcttcttgccagtgggaactttctgaagagtcccaaggtggtgtaaggacccagaaatttctgatcttcttctacatctaattgccctgggtcgaggcagggtatcacagggcaagggggctgagcatgctaatgtgttagctcaggcctctcttcttcttataaagcaatcacttcccctcccatgataacctattaatccattagcccattaatccataaataacaaattcattcatgaagacagagcccatatcatccaatcacctcttttaaaggcccccacctctcaatactaccagattggtgattaagtttcaacatgagttttggaggagacattcaaaccatagcaaccaatcccaaactgaggtaagtgaagctgcacagtggttttaaaactgttttactgagccctaagattctgcaacattgtcttggggccacctacaggtggacttaagaagtgaaactgaagctgcccctcattcccactgcaaagagcagtaactctggtacctggtttaaagagggtggttctttattacattttacttgatatttgacttgatttagttgaatataactgttgttgtgttctataatacggagaaaattttgaatgaataaaactaggtatagttttaagtagcaagattccgagtagcttaagaggattaaaaaacaaggaagatattttagattctcacattctaattcttacaagtggagaagaaggggagactgcgttaacttggaaactaatactgatgagcacaaatgtaaagggttatgagcacacaaatgaagggtccatgcactacacctaggaactttaaggaggcatattctgtgaagatattttcaggagtgctgatacccagaaagaattggtgttttggaaacatctagagaatagtcaaaaatgtatgttaatttatgtttgaatcaggaaggaagatatctctctgcctagggagagggagtaatgataacagatgccagaaaacatccaacagaggcaggagcaatgccagcagataaagttggggagctggcccagttctcaacagtggagggtatgtggaccctagaaactcaaggcttgtgagcttggtgtccatctctggcaaagtcctaagccaatttagcagatggtttgagagcactaaggaaagatgctggagagttagcttagtaaaacaaagtcttggtaaacttccatgcttctcttattgatagagtctgtcttgacttcagcaatatttttattgggcagtttatgataaccaatatgtctttttttccgttgagaacaaaaaaactgactcaaggaaagaataggaggggtgaagctcatgccagagaagcaggaagatacttccttatgggcagcttgatggagccacatagaatctgcttaaggcagcgggaagcttagataatctaccagctctaggtgcagagtgtcccctaatactgcatttccccaactgagaaccatgaccacctcccgccttcagagatactttggggtatttatttaaaatgccccatccagaatcatgatctctggaggcatagcccaggaatctatacttttaacaagcttcccaaatacttaccaagcacatataaattttagaaccgttgcttcaaagataagattatttgctgtgaggaaagctacccagttagagaaacagagaaagtctttagttgtttcataagcaggttcattttttatatatgattgtgacccagaaatttctgatcttcctctacatctaattgccctgggtcaagcccaacccaaatgccatctggtgacagccacttatgctgcaaaagcagagctgatgaggcaaatcttttgagcagtaaaatgggattttgcatcaggtaaagaccttaggtgaagagcaatgaggcatactgaaagaaacttagttctacacaattccttgagaaactcagtctccatgctgcctggattgggggcagggatgtatcagtacatctgtaaacaactaattctccagaatagaaaaggtatgcataaatatacacgcatacgtttattttaagtgttactcatataaatgctgtgcggtgcacaattcataataaaatacacattgcattttattgattacattacaattgattctcacagaatgcttttcttgatttttgtcaaactcctgtatccatagcaaccttaggttgcagctgacaaatgagtgtaggcccaacaagcctgttggttgatagcttcatttatatgaacaagtaagaggaaagtaaaacaatgacacatgtcagaacttcacttattcatcaataatctgagcaacttcttgaatcagataatagttttttaatattggaagaatatgtcctcaatattttgtgctgtttacaaagtaatgtctacagacaagacacacttttcatctgttatttacattttctccagcactatcgtaagactttcataaaacgtcactttcagaagaccttaacaaaataataaataaaaccttggtttgtggtgtttgcaagttttgtggtataagtgctcccagcctggctgttttcaagctaccaataagatattgctgaccgtggagctgggaagagatgtgcagtagtgcatcaatatctggtatttccaggtggagaagaagggatactatagatgtaagtactatagatgtaagtaagatactatagacgtaagtggagaagaagaagatactagagatgtaagtaacactgagagcatagacaataaattgtagttaaatgagtaggaaatgataacttttgagaatcatctttgaatatcacctttgacttttgaatattacctttgttttcagcatagtttattgaattttacatttatataatttagtttttcatggtggctgtgtttaataatcagctctcaaaattcctgaaaatttaagttgattcttatgagcttctgtgagctgagtctaattcactactgaatgggcagattttctgaactcacagatatgtgacggggttatatccctgcttttatgcaggagcatatgtatgatactcaggcacatttctatatttgcatacaaatgcagctcctctaaaccagagcataacagtatcatgtctgacaaatgtgtcctgcccctgggcatcacaatgagaggaattcctaaacagatgagatcagatccaatagaacaggtttcctctgtcatgtctgggaaactatttatgactcatactctttgccagctctgtgttttgcatcagtagatattctgacatgtaaaggtacccctctcatgttgcatcctactgatttcagcaaaactgtttttgataccttgacactttctacaagcccttcagaatacagtgatgttatgatattactgctttttacatttccacttcctttcttctacacctgttctgtaaaagggtattcagtttgcaattaaaattcgatggcagcctagctgtggccatgagagtagatttttggagccatttacacaaagccagatatagaatttatttgatgtgtaaaaatttttggagctgaaagtttgagactatctgccacatagaaagatatgaggatttgagccaccacttttgtgtaaattcttattaaaaacagacagtgctgtgcaaggttgtttcttggatagaatttttggatggtaatagaataagctatatacttctagtgcacaattattttctctcttcctgttttctcgctgttatgcttgtaagcaaattgttaaataagttcattctgctccccaagagcatttccagaagtgtcttggaacttcccactgtaggtacctgggctctatcagtattttctgtactgacctttgtaattatgacacaggggatacttaaacaggactttgcttgccaaacaaatataaacacaaaattgctttaagttgctaactgttcttcctgctgtggacattggccatgacccagcaacttggctgctatttcagccataagagattttctgtaggtcctcaaatactatctcaagtaaaaattcttatggagtccactcattccaggttagggtaagaaaacttttctcctaataatgtaataaaattttactttataaaatgaaaataagcaacattctttcatattataaagaacataacataaaaccaaataatcttttggctgagaggaaatgccaaacccatttcagaacatttatgttatttttccatgctctcttcaagccaagttgattgcatacaaatctcctaaggggatgtgcaactgattccatggtcctggctcagggcaaaaaaaatggaaccatgactgaggggttttataaaatatcctttgcccaggtaaatatggaggtgtgagttcacagagacagtcaggtagacagatgtcaggttaggaactccaggctccaaggtgctgatgaccagcagtacctaattacagctcctctagtgtgcacctctctgagtactgtgtgcacgcttgccagcctagaggtgtcttcagtggccatcggggtcctccaacctggagtagcctgtaggcagcatggtgggaagtccctgagaggagaaacattcttaggtgctgtcctgtgctttctggcagttgtttcccttgagacacagccccttttgatccctttatggatccctgtgagtcagaatttggaatgtttcagcctcctaatttaaagcatgttttctttaaattacatttaacttctctacattttataatttttaataataattatccaagtaatatatgcaccgtgttaaaacacacacacacacacgcacacacacacacacacattaccaaaggagagagagaaacagagattgagagagagagagagaaagctttaatttagaatggacctgtgggtccactcccagaggcaaccatttttatttacccttttctagttttaggtttctgataattcccactattctgtaaataatgtactttaatttttggtttaccaactttagattatatatgtatgtgtgtgtatatatatatatatatacacacacacacacacacagcctaacatatatatttatatatatgttatatatgttaagctgaatacttactaagaagcagctatttttgctcccaaactgaatcaaatgctttgtaagactcagtgaagttatttttaaaaatgctggtaaattaggatggagaaaaactgtgaaagattgaagacagtggtaaaaacctagaaggattttcttctcagattgctccacaaatatttttaatttcttattctactttaaggaaatgcaagttgaacacacagacaaaactgcattatgggtatttttttatgtaaaaagccaacacaaaaatataatcagaggacccatattcaaagaaaagaacattaccctttgtcaaaagctcagttaatgttttcagtaaaaataaaatatttacattaaaataaaataaggtttaagcggaggcagtttttggtttaactgactttttcaattaactgatcccaatcgcattagccaagaagactttttaatattagagtacagtggttaagagtagccttcagcaaattatttcacctttctgtgcctagattctttatctgttaatttgtagtaatcatgggttttcatgataatcaatgaattgccttatcacatcattgacacttgttaggaactcgaatgtggagctattgttattgctattacaatattgtaattttgtaaaaaaattagtaactacccagccttgaagtgtgattggaccctccaaaaaggcaacacagttttatgctaatctcttgccacttgaagatttctgttccttgcatctaaagtcttcacttatctccatcaattattcaaaatcttgtcatgttctaattgacttggtatttggctattaactttcctttatggtattatgtgtttcttaggctattttataagattttgtatcataaaatacttaggatatttcataaacaaggaaagcatcttttaaataaaagcgtatttcttcactatattgttaagtatatccagcctcttgatcatacattttgcattgagaagccaactttcttatttttgacagtattcttctagaaagatactctttaaacctgcacagagctgagcctcaagttactgccacttgaaggttaggtacattagtttccctactttctctttcttgaattcctttttccttaattagttggagtacattctcaagtaaatttttcaaaagagaaacatggtatgtaaatgttgagccctttacatttctaaaaatgctcttattttgtcctgatattaaatagtgatttggctaagcatacattctacaatgaaaatcatgttctcttagtatattaaagggattgtttcataggcttctagcattctagattccttaagagaagtctgaaggcagtctgcttctagatctctttatagtcttctctctcaccttgaagttctgatatttcatagcagtgtgtctgggtgtgctctctttttcattcatctttctcagcatttcctaggacagttaataaaaacaagatgtctttcattctgggaaatgttattttttttgccaatttcttcccctccattgtctgttttctcttcagggagccttctaggttagtcttctatgtttacttgctcctttattgctttatctctctttgcttcatattcttagtgtcttcaaagacaaaagtttacctcagagtactttagtatgggtgaaccttttgctccctcccctacttctccataattttttctctttacaagacacattcaccattatttttcacccactctatcacctaactatggagtttgggcattgagaaacaaacaaacaaaaactcagcatgagtttacctggaccattgggctttatttccacctccctaagacaccgagctatccctagtacctatttcataggaatttgggagctaaagatgaggcaggattctttctcctttccatgactgtattagtctgttctcatgctgctgtgaagaaatacccaagactgggttatttataaggggaagaagtttaattgactcacagttccacagggctggggaggcctcaggaaacttacaatcatggcagaaagggaagcaaacgtgtccttcttcacatggaagcagcaagaagaagtgcagagtaaagcaagagaaaagtcctttataaaaccatcagatcttctgagaacccactatcatgagaacagcatggaggtaactgccccataattcaattacctcccaccagtccctcccatgacacatggggattatgggaactatgattcaagatgagatttgggtggggacacagagccaaaccatatcattccaaccctggcccctcccaaatctcatggcctcatatttcaaaacacaatcatgcccttccaacagttccctaaaatcttaactcattccagcattaacccaaaagtccaagtccaaatctcatctgagacaaagcaagtcccttctgcctttgagcctgtaaaatctaaagcaagttagtgacttgctagatacaatggggtccaggcattgggaaaatacacccatttcaaatgggagaaattggccaaaacaaaggggctacaggccctatgcaagtctgaaatccaacagggctgtcattaaaccttaaagttccaaaatgatcttatttaactccatatttcacaggtcatgctgatgcaagaggtggattcccacagccttgggagctccacccctgtggctttgcaggggacagcccccttcctagctgctttcacgggcaggtgtttagtgcctgtggcttttccaggcacatggtgcaagccatcagaggagctatccttctggggtctggaggatggtggccctcttctcacagatccactaggcagtgtcccagtggggactctgtgtgagggctttaaccccacatttcccttctgtacttccctagcagaggttctccatgagggctccacccctgaagcaaacttctgcctggacatgcagacatttccatatatcctctgaaatcccatgtcttctgcacacccataggaccaacaccacatggaagctgccaaggcttggggctggcaccctctgaagcaatgtcctgagctataccttggcctcttttagccatggctggagcagctgagatgcagggcaccaagtcctgaggctgcacacagcagggggggcccaggacctggcccaggaaaccatttttccctcccaggcctcaaggcctgtgatggaagggactgccataaaggtctctgacatgccttggagacattttcctcattgtgttcatgattaacatttggcttcttgttacttacgcaaatttctgcagccagcttgaatttctccccagaaaatggctttttcttttctatcatattgtcaggctgcaaattttccaaacttttatgctctgcttcctcttgaacacttcgccacttagatgtttattccaccagataccctaaattatctctttctagttcaaagttccagagctttctggggcaggggcaaaatgctgccagtctctttgcatagcaagagtgatctttactccagtttccaacaagttccccgtctctatctaagaccacctcagcctggacttcattgtccacatcactatcagcattttggtcaaaaccattcaacaagtctccaggaagttccaaactttcccacatcttcctgtcttcttctgagccctccaaactcttccaactgctgcctgttacccagttccaaagtcgcttttatattttcacatatctttatagcagcacctcactctctgcggtaccaatttaccgtgatagtccattctcatgctgccatgaagaaatacccaagactgggtaatttataaaggaaagaggtttaattgacccacagttctgcagggctggggaggcctcagcaaacttacaatcatggcagaaggggaagcaaccacgcctttcttcacatggcagcagcaagaagtgcagagtgaaggggggaaaagccccttataaaaccatcggatctcttgagaactcactctctatcacaagaacagcatggaggtaaccacccccatgattcaattacttcccactgggtcactcccatgatatgtggggattatgggaactacaattcaacataagatttgggtggggacacagagccaaaccatatcaatgcccatattaaattagtggctatttttataagtccttgagtgaaaagttcagaaccctgaccaacatcagtctcagcaatgtctacttcttctcaagacaacattaagtaataattggatattatcacccacactggtttctcagctcactagtggttgtggtctctatccttagttattcaaaggccacagtaaaaattgagttactcactatcttagaaggcgagaaggcattctctcatgctgaagtttcttactcataacctggctattgcgtcttcctcttgagataatcttcatcccttttttatgacatgataaataatgatgacttttaactgcaactttttctttcttattttgggacaatgagataatggctctcttctagcttgtaacaaattatgcagcagcaaacatctaggaattcccaagacaatatggaatttatgaaaagacaaccaaacaccttatgtttttattgtttccttattatatatttataagtttgctgaaggaagtggcattatttaagccctgtgcaccatgttttccaagtgataaatagcaagctatgtgttcccagtagagagaagcatcataacgtcatggcagatggcagagatgctccctacacttagctttataggattatccaagggtcttctgacacagactcctagaggcacaatagtgggaaataagtatgtaactgtcaggggcctgggaaaccctgggagggaccccagactcttgaggtggaggggcagtactccatagaagtactttgacagaagggtttgaaagggactatgtacctggctattgttggtatttggtaaaactatggcattatatgtatttgtaaaaaaaaaaaaactcttcatctaccttccccttccttagttgattttcttctcttatatttttatgataatgtctcatcctttctaatacctcttatttctgttccatttattattatctaacccaaatatctttcagaacatcacccaaatgtcttccagaacttcatgcccttttgggcctgatacattagcactggatatctaggcctactggatcattaccccttatctgtccacagataggaaggacctctgtcctactacttcttttgttttcctgtgagtcccccattggggatatggtggagaataacatcttacataaaatgagccattttttttggctttgctgtctttcatctgagcctactgcatttgtcctccttctcatttatacttgttcttactatttctgtctcctgatgctgctcctgttttctttgccttgttgtctgctaacctctgttctgtccatagaccactgtctgatctcccactagtgatgcagcctcaatttcttccactctttcaggtgtgagaaccctgctctctctatggctgctctttggagtcttcattattcctgtctccagtgctcacatttctggtatttagggaggcacttctatctcaagcccagctttttatagagagtgtctcatggcaatgctgcttggacccctggtgatacaggatgctgatggatgcccagaaaagtgtgaaaagttctgtgcatcctcaggagagcaaatttccatctagggccagaggatctggaaaatgttagtaaaacacctatttgtagccctctttcctgcctcagtctccagagcatcatttgagatgtgctgcagactcccctctttcctcagtatttgttcaggagctgcctgagcgctctggctcctgttcttccatatgtacctttgcaaggcaaagatcctatctagggaccagatttcagtaaaatgagacaacttggtttatcatagaaacagaaaatagaccagtggttaccagggtctggaggagggagttagtatttaataggtacagagtttcagcatgggatggtgaaaatgttctggagatggatagtggatcaccactaccacagcacaacaggataaatgtagttaattaccactgaactatactttaaaatggttaaaatggtaaatttgatgttatgtatattttgctacaatttttaaaaacatgaataaaaaactctacttggtttaaagagaagtgaagattacagaaatgtcttaggaaaaacaacactgcctgctcatagctatagctcggtccactgcctgttatgcagaatttctgtaactcagagagggcaggcctgaggagaacatttttgaaaagaattggtattctttgtatcttctagtttgatttaagagtaaactgtgttgtaatcttaagtattatttttctttattgatcaatgatttttagaacaattactacatttcttggtcatatggcattgttaataatcactctaatgagtaaatgccaattgctatgcatgactactgataaaaattaacaatttagaagaagccatcttattttagtagcatgaattatttgctaaaaggaaattgacttcaaatcatattatttgtagaaagctgacagttgaatacaaagacacaatagcttatgcttttaaccaaatactaatagtcgaaacctgaccatgctttcagcacagacagatccgtgatctggggtgtagaggtgggtttcaggtataacagtacaagtagtaaggagttttacattggaacaaagtctgtgcttttaaccacagacaagggttcaagacagacaaatgaggaaaaaaatagggaaaattttgaaccaggagtccactctctattctgacactaggcaaccttgtagcttggaagtatttctcaggagagactcttttaaagttaatattgaccatagaagcaagactatttggaactatcatcaggcactaagaacttctgaagattcatttccctgaaacagtctggatgggccactccagccccagttatataatacctcgatgagcagcagctcaatacaacatgttgtgaggttaatttaatacatgatgcttgtcccagaaccaatgctccttctactatactgctctgcctgcgtggagtcttaaatgtttagagaagcatgaaacactgtatcattttcaatcatgatgaaaatgtaatcttaatgcctattgtatatgtatatatacttaaacacacagcttctttgccaattctttttcctaaatcacatttttagtggagtaaggaatagttataaaatagaaatgttatgtagcttagaattttgtaactcattaaatttgagttcctctggtgtggcaggtatcttgctaagttgtaggagacactttagagatagattttctcacacaatttgagaatatgagatctggaagccccttaatatataaaagctcatctcattttgtatgttaggaaacaactcagtctacagtgaatcattctgagtcccagtggaaacgggtgatagtcaaactaggtaatttgaggagagtttagtacaggaacatataacaaagatatggtcaggattcaaggaaaggatcaaaggatagtgcaatactccagggctagtaatagtagggagccattgctatccacaggcctgaaagaacccaaaaaaaagagctgtggcttttagtagagggacacatgcaatggggtgacttagcgggaagaaagttggaggaataaatgctataacttcactcatctgccaccctccaatatccctctagggcctccttttggttgaactcaacagaatccaaatgcaaaggaatcccttattatagtccatgtaggtcagcctcacagagcccaaagctgggaagagagtggaggagagtagatttgcaatggtaaatggaacttccatagttccctactgaaagacttaaaatgcaaatgttaggacatggtttcagtattcatcagatgttggaagagagtctttgactctaaagggcagcacatataaatgctgtgttatttgagtacaggatattttaagtttctaatttgaaagagaaaatattgttttacaatcatagaattataaactgaaatgccgagaacctgagcagcctgcagatactcacacacaaaatacattggcccattgctcccaacagctcaccaggactcaccaggggctctgctccttctttcaagaactatgagaaggctctagggagtgtctcacatgtgtttaaaaacaagtctgcacccaatctccaagtcattttctcatatatcctgtgtcttgctcaactgctgtgctctggggaaaaaaaaaaaaatctcctcgtgtaactctcttcatgccaacagaagcctggaagtcttctgcccataccaacataagtacagctagcagacagcatgtatgcagttctgctctctaaacacatgcatggccatgtgtttaaggatcaaggccttgtcctgaaggtgtccagctatacctgaggaaggccaggaagggaagtgtgcctaatcctggggtttggagcaaggacaaacatcccaatattgcaccatgccttgtgtaggaaggtgaaggtcaaatagaagggagaggcaagactgagtgtggctttccaatcaatcaaaaaactcacttcttggaatggagaagtgaggggtgagagaagtgagcaggagcatttagggaaaagtcacttctcatggaaggcaaaaatgggaagaaactttcccacattatatattgctttatgagatttttctaaatgctcattcacaaaggtgattataagcagccttttggtcttgttccacagggtagatgagaggttaaaacatgaatttgatcaaagcaagacaagatctggccaaggaaatgacatccactgaagaagtgtggaaaagggtcctgtgggaagtgtaaagatttgagccaatacagtagtgccaagcttaaaaagaatttcagccaacactatgaaagcactgtgacaggttttatacagatgcaagtgcatagccaggctaggaggaatctcttcccccattgtaaaggtgagaaatggcccaggagagggtgcaggcggcccaaagtctcacagcaggccacaaagctggtctccatttcctgaatcccattcccctccaactccacacagccctacagggcaggttgggatcccacttcctgtggacacaccagagggttgttgacctctttggcctgtccccagtccctacatgtttttgagtttcgtttcacagttcttttcagcaaaaagtctcaatggtctaaaactctgcacatcagattttctgtaatttcacaagaatcctagcacatctgagtgtttccatttacactgcacaggccagaatccaatggtgtagaaaacattgtagattttgcaagcacttccaattatgtgggtgtaaaatatttttaagtagattttcccccaattaaataatttctggagcaatcgagtaaaaagaaagcagaaacccagtagcaaacctaataatgattcctgaaccttcctgttaggcagcaagtggggactcaggtgcaacagggttatggacacaagaacttaaatctggctcttagggtatatggctccaggctgtcagtgtctagcttcagcacccctgccccatccgggcaatgcaggggtggtgatgccagtgtgaagaggaactggtcacgctgatgagacagcactttgcaaatagaaggtataacagaaagtgttctctcaatgctaattttaggccagctccttagttaacataggcagaatcatctgggcagccttctgaggaaggaatcagagagccagaaacagtcatatttcagatgttcttccctctgtgtcagtcacaaaaaaaaattgcatttaatgccatttgccaatttccatgttccaattcattttactagccctcaaacttcttatatttaaggcagcagagtgctctgtttacctggctcagtgtcttaaaaatggtatggccctgcagacccaagttaatgctccttaatccttgcaattttcaccatgaatcagagctaagagagccacatacatgtctgctgcaagaatgaaaagcaggaatggccctaagttttagccttcagttaattagtactcactgacttatggtcactaatgagaagtattatagtggttttcgtcttagatacagacattgttgtgtactgcaagtcatatggcagtttcagaagaaccacataatatgagagctatgcccaaacctgttgtgatagaggaagatcactgaggggcagtgacccaaggtcacaaaatataaatgatggcaaagctggtcttaggtcacttggaatatacaagctgtttcccagggacaccatgtaaagctcagcaagttgtgccctgtgcaacttgcatggccatagaaagaagccctcactttctctttctcctgctgaagtcttttggccccatgacagatgacctgggttttatatttgtataagagaagtagtaataagtaggatttggctcactcctcatctatggtgtctaagtctatttgggctactataacagaatgcaatggactagatggcttataaacagtagaaaattatttctcacagttctggagactggaaaattcaaaaccaaggcaccagcatattttctgtgtcctcatatggtggaaggagtgagggaactctcttaagtctcttttataaggatgcttatcccattcatgagggcttcaccttcattacttaatcatctcccaaaggctccacctcctaataccattatattggatgttgggatctcaacatatgaatttgggggggacacaagcattaaatctatatcattccactgctagccacccaaaatctatgtccttcttaactgcaaactacattcattacatccctaaagccccaaaagttttacctcattccagcattaactctaaagtctaaaatccagtctcatctaaatattatctaaattaaatatggatgagacttaaaatatgatttatcctgaggcaaattgctcttccagctgtgaacctgtgaaaccaaacaagttatgtgcttccaaatacaatggtgaaaaggcataggatggacatttccattccaaaatggagaaacagaaaagaagaaagaggtaacaggtcctgggtaagtccaaagtataaggcaaactccatgaggtcctaaggctcaaaaataatcctctttggcttaatattctgccccccaggctcactgggactgagggcctgcctggggctgtggctctgccccagctgctttgccacatggcccacacacccacacatctgggcagccctttccccatggttctcagttcagtggggccatttggcctattgaaaggaagacaattgccatcccttttgaaaccaaggaggcagccctgatgatctgtgagtcttcttcaggattcttgataaatagtgaatgttctcagctgaatagcattgtggtcccatcctgtaaaatccaaatctgacagccttccttcgttccttctcttttccttcccctttggttcaaattggcagtttctctgctggggtggatgattaagtttgtggttcatacctatactaatctcttaaatagtcagttggccacactgttagtgttctcttccaaacgtgggttctcattttttgcaatgtggatagactgagaattttctaaatctacaagttctcattctgttttgcttaacaattctgtctttaagtcattctgtctttcattttactataagcagctaggaggagccaagctgcaccttcaaaactttggttagaaatagcttcagctaaatatcccgtttcattgctcccaactaaatatcctgtttcattgctcccaagttctaccttacacaaaacagcagaacataaacacaattcagcaaagttatttgcctttttataacaaggatcacctttcttccagtttctaataatatgttcttcattcctctctgagactttatcagaatggtctttactgttcatatactaccaacattctggtcatgggcacataagtattctgcaagaagcttgaggctttctctacagctctcctcttttctttctgagcctgcaccagaattgctcttaatggtccattcatggcagtgtaagctttttcaagcatgcacctcaaaattcttccagtttctacccattacataatttcaaaactgctttcatattttaggtatttatttgtttcaacagcacccccatttcttggtatcaatttctgtgtcttatgaaaaggcctctctgaactccatgtattggtttatgtatgcctgacttctaggctatagtagtactctataaattgcaactagcactcttgaaattttcttgattagtagttccttgagggcaaggattcgttttatttattttatatccctaattcaatacttagcaaatatcaggtactcaataggagctccttctcttgtcctcagtaattcagttcaataagcaccttttgagcacctgacattggtttgatgccaggccattttttaaagctgcaggaagcctcagtatttagtaaccaaggtgattatttatttgcaataagtctgatatggagcagccaaatcctgagatacctcatgaaaaaaacagaaacaataacttacattcagtgagcacttctaccttcctaaatattcactaaacccctaagagataggtactattattatcccaatgttactttgacaagacaagatacagaaaatttatctatggttacacaatgttaaaatgcatatcttgactgtataattctataacctgtgtttacagctactgtgctatggtgcctgaagtataattaaataacaatgttttggcaatattgcatttcccagacaacttaagttcaatcatttaaacaaaaagtatctgatttaaactagaatctattacatgcttcttattcaagatgttgcaggatcaccactcaggatgccctctggcctgttgaggtgtgtatggatctaagttctccttcactggataattccagaatgttatgatgcttgaactcaacaatttctcctccttcctctcctcttcttcctccttcttcttcctgtgtctctttctttttatttaaatatactttaatttttagagaagttttagtttcacaggaatattatctttttaaattgcaaaagagagacacattcattttataaagtttaaaaatacagaaaataagatattaaataaaggctttgtatttacgtgaaagggatattgatgaggtaattgtggcatgaattgttctggattatcagtaagatttcattgtgttcattcttaatacaatgtttcctcattggttcagcaaaatctgaaacacttaacatcagagctgtctggtcccacctgtttccactctctaattacattaccaccttccctacaaagcaccattgatatcctcaagttctccatgggctgattttctaactaaatttcccagtattatatttattagccctccccctgacacacacacaatcatctgaggatcaggaaaatgtcttgtattctgaaccacggtgtgtgtgtgtgtgtgtgtgtgtgtgagagagagagagagacagagagagagagagagagagagagatcagatttattcagagttgagatgcttgctaaaaatggagactctggacctcacccaagacatattaaataagaatatctaagattgaagtcagagattctgcctaccaaaatatgttttatttttactttccatcaggaaattgacaagcatatttaaaagtagagaggttaatataataaactccatgtactcaaaactcagtttcaacaattatcaattcatagtcaatgttattttacctataatgtgaagcaaattgtgacatatcatttgactatttctgtatgtatttagaacacataaccacaatacaattatcatacctaaaataattaacaataatctctaatattattacatttttagttcaaaacatttcttgttttgtcaatgtgtcttagttgtatggtgttttaaacccaatcacgtagctggtccaggccggactggcccctctctaggcctgttgctcagctcgcatgctgggacttccttccaccagtcttccaacttcagtacagtttctcatgtacactgtgttttctgcctcattttaatctcctacattcatcctcaagtaacttgctatgataaatacattgaaaataatttttctgacttgttttgaaagatgactttttcagccctcatgctttattgatatcatgtttgggtatagaattctagtttgaatgtaattttttctcagaagtttgcaggcattattcaattatctatggtttctggtgaaaattctgatgccactatggttctaatttctttgttattttttcaaattcattttgtctcttaagttttgtgactttctctaatcttcatgttttgaaatttcacaataatgcaattaaggtagtgatattttattatagatgctcagcggacccctatcaagttgtccttcggttctaggggactttgtttttttctttgatgactctcaccttcattctctcattctctctgtcctcacttctggaaaatttaaatattagacctcctggataaatactctacatatcatatctttcatttaaatttcccaagtctctgttttgtttggttttgtttttctcggtctacgttcaggtacctgttccttgactttgctttctatttaatttttcttttatttcaccaatcacattattttacttctagatcagattggatctcaagggtgtctttttctggttactgctgcagtcacaattctcacccttggttgctgttttataaatctcggtacatgaattaatttgcctcttgcattactgtaattcctttcatgtcaggggccatttattctgatggctcagcttggttacctcttttgaggtgttgatttgcccatttcttccatggtttttctttttttgtctgtttatgtgttcttcctggcccttcacagtttaggaagacaaccaatttttctcatccatgtgagtatgtgggcttaaattttttacttgttggccagtaatcaccgtcactctaatacaggtccactttttttttaatgcttgcaggaatcctctagtattacaggtgtccagctggaatgtctgctgggtctaaggtgtcatgggtgtcttctatctggtgtgctagggatgttgctacaatgcatcacgtcttatggctagagctaatagccagtagaagaggtttctgacaaacaggcgtgattacagggcatctatgccacatcttccctgggaagaatacactccatgcagctctgggtatagttttatgcacggtcacccccaaaacagcaatacttctagggatttggatcagaactggtttgccatttgcctcttttcttccttgagggactatctggctattacctcaactcttggataaaagcactaattatgctattcctgttctttagaaaaattatgtcacgactatttttaatgtcatatatttttcaatttttaaaatgagatataccataaatgacaataatatatctcatgaacacatgtaaaaattaataataaaacaaatggtcatgtttctaccacctaacttaagaaataacatcttgtgattctaagctgatgctccctctccatttttggaggtcatgggtctgaggtgggaagtatggccttagtgattccaaagtagctttctagcacctctttctgaaaaaaacaagagaaaggtagaaatgtactatctagaaggcatactcagctatttctaaacagaagtctagacaattatgcttggtgtctggtgtggctgtgtaggtcactattggtgtttcctataggcatttctctctggaccactgctaactcacacagcacctttgtgtaaatcagaaaaaaagccactcctgccatttgctacaatttaaaaaataacaatatgcacaacaatctgtaatgactatgactgtaactggtgccccctagagtttacaggccacaacccgcacaaccataattcaaggtagacgtagcagatagtacaggcctcctcagatgggcttcatcacttactgaatgcctattgtgtgccaggaactcttttagattcttggcagtcagtgttgagatggacaagatctctgctcttctggatcccccacgactggacttctgagcaggctgttttgtgagtgcatgagctgtagtcaactaacaggctggagttgttcttaaactgggtcaggggtcctatggttactagttaaagtgaggcagaacttcaatttacttagcatgctatctatgccaagtgaatcctgagaggtcacgttgtactaagctgatgagttcagaggtcacatggggttcttaagtttatgatgaccctacatcctaattttccctggacaatcctaggttaagtatcttatccccatgtaattattaatataaccccttttctctcctaaaagtgtcctagctttggacagtaaattatatgatcacacaaattacctttttttttttttctgtgccaacatcccttcaaaatcctagtgacttaatacactaaatatttagtttttgctaatggatctgtggatcagctgtagctttgccccaggttgtcagtcaagtttaagtttactccttattttggactttgggctaatgccacaagtcttctcattatggcagtcaggctggaagatcagctcttatctgagagctcttttctcatgcagaatgtgggagcacaagggacctttgcttcaaggtggcatgggccatattcactcgtatttcattggccagagcaagtcatatgcccaagaccaacactggggattgggatttatgcttctcccttggagaggagccctgtgatagggcagagtgactaataacacagttatctcatcacattcctaaatcctacggcctcccagtgtgccccttctccagcctttgctggtggtggtctcctagcagtgtctgtgtcaggacagagctgaagtgattaacagaatgtagagaagaagttttgtctccatttagactacagaatgtattaagagatttcactgctatgtggagcctattttgtgttggagagggcggggattgatgtttgcagcctgattacctgggacagggtttcctccttcgtggtcccccagcactatcacccatcacagaagtctgcaccagcatattgtctactctcctgtgtgagcggtcagaaccaggtggactccggggtcaatccatgccctccccacctcatgttgggctctttgaggtatagttcctagccccttttactttgaccccactgactccactccctatcccccatccctgcctgttgctctgcacctgggatttttaatttttattttctctcagtctcccttcatttgcctgtgttaaatgttcaacagtaattggcttttcttttaaaacaattccagatattcctcaaagttcctggttaactgatgaattgatgatgccctttcttattttccattgcttatcccatttctgcgggatttgaggagacaaaagtgaaaaagatttgcagagttacccatattgaaacttcaaccccagtattttcaaacagagatataatattgtttcagtagaaggtgaagattgattgggcggcaaagaggaagtatgttaaatccatcaacagtcctggcagctggctttcttttaagagcaatttttgataaacagttttatcaattcacaagaatgaccaagtaccttcagagtcatattaaaaagcaggtgggtggtagttgttcagcttgactcagtaggtaagtgacttgcaggaggggttcccatgcatgcttcagcagaaatacagctttgtcacagatcatagtatgttggcagtgctgtgcatagttgaaattgtgagtactatttagaactcacaattagtcatttactaatttctaattttctccttcgttagaatatgaatctgtgaagacatggcgtgcgcctatcatgttcctcattatatctctagagcttagcgtagcacttggcatgtagtaggcattcagaaaactttggttgaagcaatgcaaatattaatgatgggcagtagaggcaaaccctggggagaatccttggggctccagagtgtaatgaagcactgtaatgacaggcagggttgtcctttaaaataaggattttacagccaccataatgccagaaatgcattcagattgatgctcagcctccttggttctactgtagcctggggcagaagcctggagggggtgaaatgttttgaaccttaggggcatagtcactggatactgaactgccaagacttgctgatgccatggggctgtggtccatgatccatgtagcagatgctgtcattacctgccatgtccccttaccacttcattgtgtgcctgttgacctccagtgcagcctctgcattgatttcagtgtgggattttcctggccactgaagcttactttgttcatctgggctgcaggtttcaaatgatgggaatttaatgccctttgagaaatgccctctaattaataactaaagagagctaatgtgtaataccttggatcccttgccacttaggtggggtatatctgaggtgtattaagcctccatagcaggtttaacctttactccctcactgtaggaactggcttgataatgtaccttttattggcttccttttctggatcacttctcctgtgtttccttctccttctaaataatgcttttccctttaatacttgttttagggtatgctactggggaaacccaaactacaatattctatcctgcgtcctgaggacttatcactgagtgggggttgttcttgaagctgcaaaattcacagaagatttgagcttcattttgcttagaaccttaaaagttaataggaaaaatagaaccaaaaaagcactctagtttctcgtattttaaaaagttatgacttacacaattccccaattatattatacagctctctgagatgacagaataattgttaaggacatttgaaactgccctgctcaaaaaacattaatgattggtgctgcctgtaggatagagtctcatttaacttgaagggcattctagtccccatgaatatatccattttcttgccatagcaggctgtttattgtttctaaacatggcttgcatgctatggtacctcctctgtgtttctgctcactggtcctctggtttgtgtatgaattctcattgtcaccgtcccagaattaagtaacccagccatgcgccccagcatggccttccgcagtcggctcccaagggatgagtggatgagagggtcattctgcccacgctgtgcaatgggtgggcttgaggggaatgaccacactgacctttgatctttgcttctttgcagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggtcagtaatgccttctcctttctgaatgcaaggaaggaccaccccattcccctctctggcaacaatagcactgataggtcaaggagcctgtaaccttttagatttctgttctgtatcagagacatgaatatgggaaaactccatgcttcctacgccctccttggtctctacttagttcataaaaataatagttaacatcattaagacagcatgtgtgaagtactctataagaactttatattcatattttattatagctcacaacttagcatgaaatgtatactattatcattcttattttacagcagaagaaacttaagtcaaggcgattaaattttttaaaaagctgtatatgtaaatacccaggtcaggatttgaaccctggctcaaccaacacaagaatctgagctcttaaccacccttccctgctgccctcctactgctttagaatttattccctgtgcatctgacctatcctaacagtcacacacaggctctcttcagactccgccgtgtggctggaggtctttgtccgtctccagcctttggaaggcttacagagtaccgatacctaggtcactctcttttcattgtctggatgctttatgctcttcagcagtagagaaataatataatgcagtgaaaaaagatgcggtctctcaagtcaaatgaattggctttacttacatgtgtgacattgaacaaattacttaaactccgtatctgtccatttcctcttcttcaaaagaggagtagatagtactgatttgtaggtggttttaagaatgaaatgatgacatgtgcttgcacaggtctggcacctggtaaatgttccaaaatgtgagctgccattttgctgttagtattgctattatggcctctcccaaggctcagatgttgcacaaaagtgtgtttgaggctaagcagccagttctaaatcactggatataaaaactcatttttgataagatatttcaggaaaagagactcaggaagcagctttctttagaatgaaaatattggcctgagtgatggccagagaaatagcatgtgctgttatttggaaggtataaacacaatttggaggtattttttaaaaatatttgctgtttgttctccagaaacagaaataagactttaccctttttatgttaatcgagtttatcctagaggctccactcattctcattaagtgggatggaatatgccagtttctaatttgattgtttcagaaacttattttagcatcattttcaattctgaatcaaagagccaaatctaaaatatgcctctgtgaggagatgggtagttgtctgccgtttgatttagaagaaatcctcagattttatcactaggatttatcttcagatttaaaacttaaatataactagagctctatttgatgctgtcatagagttcatgcaatgtgcagacttataataaaatcctttcagtatttcaatagctaaagccttttagatagagtctccattgaaatttccattgaaattgccccctatttggttctactctgcatgtaacttttctggtctgagttcctccaatatatggtggtagtactgtgatcttgctagatttgatctggggactctgccataattctaacaaactgatagcaatgatgccactataattatcacaatatttatactgggaaagtatataaatatactgcatagcaataaggatttgcttaaaaaataactgttatcactactgatttgtagaaattgggtagaaggaaaaaaattaaaagggagagtgaaggaattatccctgtaaaatgcactttgtgttcagatttattttagttttgaaggcatgcaattacattatcttttctgatggcaaaaatcaagtttagcaatatctgaactactataagaaaactactcttttctagctgcatttgacctaatactgacaatttgcatttttatgcatttaaaacattcatacctaagttactactgacctagttttatggggtctgtctggaaatatatatccttgtctcaggatctcaccacaataagagcagtacatggtcttctaattctttgaggattgtgttgcatcatgagaaaatgcacacacacatacacactttttgctaacaaaaaggaaaaagagaatgaaatttcctttatgcctcaaagcatttttaacattcttctttaacattttcgatacccatatttggggaggggaaaggtaagctttgctgagaaagctctaaacagtctgcttttccagttactgtttcttctcttttctttctcattatgttctttactttctccctgccgacaccgtcttactgcttccatcctgcagccattatcaccgtctcaggacagccatgatcacagtctcagggttcccagtgcacgaaagacacagcctccatttaaaggtgtcttcaggatccttgtgattggcacagtttctgtcacaccattgacatcaaaaatctcaacctcacctggcctcttcggcttggatgtgttcttggatatgtttggctgacacagtgcctttttgaaatgtcctaaagatgggctttgttttatcttctaagaatgtttctggtcagaatgactttctgttgttctttcaagatcaagcatgttcggtgtctagtttcttcagtgactattagtaccatccaaaattcctgtcaattctttttgatttgaatgaagtcccttttgtacagtgactcaatatgctggaaatgtggatgtttcaattttctcagaattttttaattccagagctttataaagttctctactccaaatgtatgaaaatccctggatccccaaaatagaaggaaccttgaaaggccatctaatccatttcctgattcatgtcctaagatgaaagttcatcctatttttctcaagccttctcaaatgtcttatgtaacacttcagtttttcaaaaatttcaattaccacaccacaaaccccttatcaggtctattaaggccctgcattttaatactgccacagtctgcttccaacagcctcaccttatggccaaggccaccatgttgcagaaccctaggggactattttaacatgaactcaataggagactgcctggaagaagcttgttgtactgcagctgcactagcctctctcttagttccttcagcatcccaagccccttcctgccttgaggtcttcacacgttgttccctcagccaggaatgcttttcctttttttgtccttcttgggacctttacttcccttacaccctagctgaaacatcaccttctcagaaagttctccccggccactccatctgaagtctgtgttctgtcccccactccttcccactttaattctccctcgcattgccttgttttcatgccttcacaggattaaattattttaagtgattctttattgcttgtactcccctctagactgagttctgtgagctcagagaccacatctgttttgtttcttcctgtctatccagcccctagcaccacctggcacatggaggacttttttccatgaatgactgacagaatacattggtcaatatcaggccacttttctcatgctcttctgacaagaatgacaaagggccagaagtataaactgagcagagcctgtaataatggtgtgaggctggcggaaggccatttgtcccaggtctcacattcattaagagccccacattaggtttttgaccttacctctgaattaagcaatccgtagagttacagaaatatgctgacagaattgaaagaggaagataaccatcacactctaaatttaggtcccatgactggccacaactcaagtaaatagtacacaaaaattgaatgtaattatactatgagtagcacatttctattaagttatatttttgtgtggtgagaacattggttcaatgtaaacatctaaaacataatttttgaattatagttatttcttcagatttaaattaactgcttcaaaagtggaagttgcctagacctatctcaacttccacgagaccccgaaatgatatgtaaatgagtgttttctctactgggattaaattatcagaaactattatatccatagcatttctatatttactctagacacagatatcaagcatttgctatggcaaaattcaatattaggtggtggcaataaagagagaaaaaatatataaccatgcccacaaaagacccacagcaagagcaccaattatacacactgaagtgctcaatttgttctttagaagattaatctggaaagaatgcataagatgcatgggacagtggtgaagattggatgtatacaggggcctgtctgagggcctgaactcagctaggatcaatgggaatgaaaagagacataagacgtgagctactgtagagaaagttttggtgaacaaaggctcatcttagttatggaggataaagtattcaaggtttcaaatccgtttaactttggagggagtgggaggaagcaggtcttgcctcagtgtatccacctacccttgacaacacacctccactggccccaaggcctgatgcctgtctcgtcattatctcacttatgctggaaacccttgaatcttcagcccaagaaagcctcagattttcacttcctcctgcccttgtagtctactaactgtgtctgtccctatccaggatttccccttcttctgtgtctgcctgtggttcaggaaaacctaactctctcttcttcatcaccaggggagttttgaagaaaaacatcctgtctccaccatttccataattccctgccttgacttgaacataggaaagaaaccagtaacatttctgaaaccacaatttgcttctctcttttttctccttggatcctgaagccttgtagacactggtgcccgagaaccagggaaaggacaggtcaggtttcacctctgaggtgggccactgcagtgaaggaacatatattagggtgcacttgttcatggcttcacatgaaagcccgcgatggaaggggtgttggggatatgagtgctggcttgtacagagcctggactcagagatgcagtgggtgtatatgagggactctagaaaaagctgctggggcagaagagctgaaagtcccattctgctagagaggtaggaccaagatgcaaatggatttaatgtccttattgacgtctacagcatccgcttgaggtggctaagaatgaggccaagttaagtaggcaagcccagctcaagtatcatctccttcataaaagtttcctcagccagaggcctttctccctctcatcttctggtgggggaaccatctcatcacccgcctggacagccattttcttcaagatggtgactacattttgcctctctgcaccttccaccccatttgacactgctttgcaaattcgaatttgttgaattgccattacgtcctgtctcttaagatctgatcgacatagttggcttttcgggtgatagtttagggactaacctagagctgggactagttaattcacatctgaggaaaggaaaggaggagaaaaccttgtacctctgggattctggcctttcctgaactatggctgcaactcagcacaagactcaggtttctccaggcgtgaaagtatgtttttgagtttgttttgggaaatctactttgcacattttgttaattatctttgaactcaagctttccacaggttcaactgctattcttcccacttaggtctggggtagccaagtctaatctttattttctctttgttgtttcttccatgagaggaaaacagcttttgcccacccagagagagaatgggaggtggatgaagctgagagttccaaccccagcagccagcttctctacgacagcattagggtgtggcttattagtagaggagatcatctctcaactttccttctgacccactgtcgttggggtccactttttttcattcactgtgcacattaagtcctgagaacaccaaaatacgggactccccagacctactcagaggactgtctgcttcagtcacagatctctctttgccaaattcctacactccctcaatgtcattgtccttgtcagtcagtggctttgaaattctagacccttgccctgggagcctcgcatttactgcactcaaaaccacctccattaaccatttagagccacctcacctggggtgggggaggctcaggtaatggctctatattccgtatctttcctacctcttgctttgggcttgcgttttcttcccacctctgtttgagtagcctatgagaactatagaatattgattttccatttcctccaccccctcttctcctttacgcccctggggcagtctccctgctccacttccttattttcagcccccagacctccagaggttatacagggaggttatgagttaccctggttctctggctcttctaagcttctctcttcttccgtgcctctccccgaactccagtaaactctaactctcttctgaatggaaattgaaagagattgaaagggagccccaggagtgagaacctgtcatgcccagttacagtcttcgctgtctgctttaagccactaccttacagttagattcaactgatttcccaagagtaagtgtgattctgaatggaggggaaagtgttgggaatgaaattatcatgtaaaatgtttcagtagataatagtattcatatctgtgactggttttttgtttgcttgtttggtttttggtttttgagtttttttgagatggagtctttctctgttgcccagactggagtgtagtggcgtgatctccactcactgcaacctctgccacctgggtttaagcgattctcctgcctcagcctcccaagtagctgggactacaggtgtgtgccactatgcctggctaatttttgtatctctagtagagacagggttttactatgttggccaggctggtctcgaactcctgacctcaagtgatccacccaccttggcctcccaaaatgctgagattacaggtgtgagccattgtgcctagcccataactgtgattttttttttttttttttttgagacggagtctcaccctgtcgcccaggctggagtacagtggcacaatctctactcactgcaagctccggctcccaggttcacgctgttctcctgcctcagcctcccaagtagctgggactacaggtgcctgccaccacgcctggctacttttttgtatttttagcagagatggggtttcactgtgttagccaggatggtgtcgatctcctgacctcgtgatccgcccaccttggcttcccaaagtgctgggattacaggcatgagccactgcacccggcttgtgattggtttttaagaggtcagctgtattgggaatttttggagggattcctgtgcaattgggttctcagggaatgggatctttcttcagtctttgaactacatcaacaacccccgcctccctgctggcaatccactttggttaggaagagctgagcatgtgggacaatttatcttcagatttcatgtctaagaaaatgtacatgtagaacagaatatgtcacactactaagtagccaaatccatgtattttaaattaaaattaaaactatggtggccaggcacagtggctaacgcctgtaatcccagcactttgggaggctaagttgggtggatcacctgaggttgggagttcgagaccagcctgaccaacatggagaaaccctgtctctactaaaaatacaaaattagccaggtgtggtggcgcatgcctgtaatcccagctatttgggaggctgaggtaggagaattgcttcaacccgggaggtggaggttgcagggagccgagatcgcgccattgcacttcagccccagttgacaacagtgacacttcatctaaaaaactaaaaaacaaacaaacaaaaagcaaaaccactatggtagatttagtcctacagacaagggtgaagacaaaatgttgctgtgatgaatcgaatgccagtactaagaaaattcaaagggaaattgtaatgcacagtctgcccagcaaccatctgcggagcagcagagtgacagggcctagggctgacatgagattattgtctgggactggattgtgtagacacagaattgttggtccaccacagactcatctggaggaggagcatccagtggatattgaggatgcacttttatcatgtaaacagcaccacttactagacagtacccagaagggtgggaactgatgcaggacccaattatggacattttttgaagaaaaaatgtttcttttgtaaagaaaactcaatagcagagggaaatagggctggcaccagcctattctgacctctgcatatggcaggttactttctgctgcctcccagtcctttctgcccacagagtccagtaaagtgagactcaagctctattctagcactacattggttccacttctggacaagggagtgatctggctgcactagctcagaaagccagttttagatgcttaacagcaactcctgccttccctcccccgcccacccacatcataaaatacagagaaaccttaagagtgtggatttctctaaaagagattaaaatctcccttcagcaactctcagatcacaaagtttttgtgcatgtgggaatgtatgtgactgggctatgtctgcttgctatggactgtgttagatgtgacaggtaccagtgacagctctgtgacggtactcttgtcataccaggtgggtgattagtgattaggaggctattttaggataaagaggaatgctcagcataacaatatctgtggtgacaagggagaatactttcaaatgtgtctgggggtcccttaattccatttttacgtctttatttcattgtctgaagaaaggaagagaagggcaaattcaaatgtttactctgcctctccaactgtttaccaatccctaagagacatcccagctgttctctttcaccttctagtaaagaggctattttaattaaggttgttgagcgaatgcatacaatacaatataatgactctaaactctgagctaaaaacaacaaaagtaaccttaaaaacaaccttgtatgtgataactacttctctcaacttgggaagacacacacagatcagacaggctttaaagagaattttagggaaacttctaacccaaaccaatacacttacagggtgaagaagactatactacagttgcaaatatttagtttggagtatcagtatccagccatctccagttgaatccctacatgcatttatagtagctcatctttaatttttgagccattagtgtttatttcagaaataaaacctgtcctcttgatcactaatcacccatgtgtacagcaaaagcacaatcccaattatgtcacttctacctgtcagagccaccacaatccactgcatgcagacacatcccagtcatatacatttttgcatgagcaaaagctgtgttcttgtgatgaaatgatttgatttgaaccagtaagaatttatatccttataaagctataagccagtggcaagaaattctgtgtaatttagagaaagattcattcttcttaaggcaacacttggctatttcaatttcagaattatattatatataaagttgaataattttatttttaaagcagtttgtacaaatctttacattccaccagaggaataagcttctttaatggcatattagacagtttaggaactatattaaacctttaaagctctgaggtcacatgttactaggttcatttcctgataccaagcctcagttgtgagcttcaagccttacggagcagcttactcacactgatgagcattttgaatttaggccacacacacacaaaaaaggcccacagatctaagctcctgacaaaatataacagtctacctacatcccaggcaaaagtttctgagagacccatagctaataaggttataactttgttctgtgttgctcttcattcaaggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatgtgagtccagcatttcttcatttttgtggtggggggcatcttggttagcaaggaaacagattacttacacattatcttgaggacaaagtgtaaaattcctgtcaatgtacatgtagcagttatttcagaacctccttgtaccttttcagaaacagggttttaacaatattgattttgaagtttccaagcattattccatgaaaacaatattaaagaataacattctctcttttctactttcagattcttagctagcccctaagagacagcaggtgttatctgtcctccgtaccacattttctttagagctttttcaggttgtttgtgctgaatggaacctggcattctattaactgtagtctgcagctaagagaccattacctgactctgacagcagtaggtacttacctgtcttctgaggttggctcaagagcatttcccatgattggatcctcagcttcaaccctaccagtgggagtggttgagaagagttggcaacacatttttaaatgtaaaactcacaaaatccaagttacaaggagggaagtctgaaaagaaactatagataatggcaaaactaatctatcgacagtcacatccaatttagggctcaggagagaagtcaaaggtgctatgtagtggtaccatacgtctatgtctacattttaaacacaagatttcagaggtgatatttctactccatttatatccttttcattatcctgcagaggtgtgttggcattccagaaatagaaaggaaaattgaacattcttaggtaactctgatattttaaagccacttgtttctttcacctgtccaaattccctgagataactttgttagctcctcttcctggatatgagctattctgaggccagcgtagctctctttctctgccatggcatccaaatggaccaagcaccaccgtctttattcagctcagacactgattcagcttgagtctggagcctatttagtgaaagactaatctctgcctaatgaccaaatacctgcaccagtaccctcttatcctcagccacttttatgaactagggactcacccatgctctgattgccctgtgggacaccttctctccacatgccacagggttccagtgccaactttgtgctgctatccaaataaacaaaatgtagcatgggagtctgctggcctttatcataatcatgaggaaagaaagaaaggagttggagctggataaggtgcagagaatagcagttgatgaaaccaaggtgatttgggatactggggaaggaataggtctctttatcttaaaagataataatacacataaacccaacaatggatgctggggaaagcaaggcttgtctcccaaatcccaactgacaaaatcaggaagcaacatgagaaggtttaaagaaacaaaatgggaaggctgcttatacaaagatacgaatggctcaggcatcaccccccactggggtatttactaagtctccctggttatgggagctgagacactgccagctgcagtgaggtgccttgaacttaagtctcatctcaggtatggtagggaggtgttggtcacaccatctaatgagacatcaatttatactttttgacaaatggattccataaaatagctggagaggttattagaaagttcaacgaggatcttgctgagagttgcctttagagactttgtggtgagagcaacgttgactgcgcagtggctgatacaaatctggataaggctgatgatccctggtgggaacgactcctaggacaggttcctgtggaacaagaatatggagtggcaggtgatggagaccttctggccctgagatcactgccatttcagcattctcttgggagtaagagtttcttttccattgttggaaaatcctggatttccatagggttaaggagaatgtgaaattatttatcagggaggaaaaccaataaagctacaggcttcagatttctcagttgtttcctcaggcaaacaataaatcttctgagcattgatctaagcctttggatggccacgggagagggtaggtcctgtcaatggaattacaggctatttcatagtctgccatattattacattccattttaaaaaatgttatttggggttgtggggtttttttttgtatagagactgaacataaagagctgagatttgccatgattctctttttataatatagaatgtatataatatagtaaatataataaatggattaatgaaggaaaaattaaatgaacaggcctgaacccaccatttagttgaagaatagaacattacttctattgacccttgaattgtcctctattgcattccctctcagtccagtcctgccaagagaaaaccactatctttaattttacttatatcatcatataaaaaatatatatgcatatacatatgacaatatgggtttgggttttgtctattttggcattttattgctcttctttgactagctttttttctttggtcaacattgattatggcatttagtaatagaaataagcagagcagctgtggcttatgtatcttcattgctatataatattccattgtattaatattaatatatgacaaatttgcattcttgtactgatgacattcaggatgttagtttttctgtgattctgaataatatcgcagagattttgtacacatcttttggttcacatatgcaatcatttctctagagtttatccctgatagaggtaaggtatacatgtgttcagcttttctagataatgacagtctttttcagtcatttgcacgtatcacaaattgatccttccactgttgaaatgtgatgatccctagtgttccactttctctccaactcttgcagttgccacactgatcaatgtatgtgtgtgcatgtatgcaaaatgatatattattggcatttcttcagttgtccggtttgaccatctcttgatatgtttattggtcattcatgttttctttcttgtgaaaattcttgttcagcacttattcttttgttttcctttccttgttgattcacataggctttttaagcagttgggatgcaaatcccttgttggttatgtgttttacaaacatcatctctcagtttatggctgtctttgtattcactttatggtgtctttgataaatagaggttatgtttggtgtaataaaatgtatcaggattttctgttgtaaattagcgcatttgtgtcctacttaagaagtacttccttaccctatgtcaggaaagatatttctcctatgctttctattagaagtgttaaggttttgtcttcctcaattatgattttaatccatctagaatggaaatgtttacatagtgttatataggcatcatatatcagtcaacttgggctgccataacaaaataccataaactgggcaacttaaacaatagatatttatttcttagagttctggagcctgggatatccaagaccaagtttcagcagactccattcctggtgaggctctcttcctggctcaccttctcactgtgccctcatgtgacagagagagggagagagctctggttctagtctctcttcctcttcttataaggacactaatcctacaatgggggccccaccctcatgacctcatgtaaacctgattacctcccaaaagcttcatttccaaatactgtcacaatcacactggggattagggtttcaatatataaattgggagggacaaaaacattcagtccataacatatccatatttatttttctatatgggcaaaaaattttctggcatattttcccaataatatgcactgtatgctctgtcctatgtagatttctgtatatgcacaacctgtttctggattctcttttctatccactgggatgtttaactatctctatgaatagcacaatttgcaaattactattgttctatgataagccttaacatctggaagggcaaatcatccagcctacctctatcttagttcaaccttggctggtacttgacttttctcacacattttagaatcacattgccaagttaaacaccctctctggtatttggatttgtatgaagtctattgattaattcatgaaaattttatatcttttgtgatattgagtctttctacacgtgaccatagtatatctctccatttacttattcttttacttatttcttctttaaagttttttattcaaagcctataattttctacgttaagatcttgcatgtctcttgttagatttattgctaggtacattactttttgttcttttaaatgttatcttctctaaaatttcattttctaactattgctagtgtatagttaaaattctttatgttaatatatcttctatttggcagtcttgtagaactcattaatgcctttttttttttatggcattttgctcttgtcacccaggctggagtgcaatggcgcaatcaaggctcactgcaacctctgccttcagggttcaagtgattctcctgcctcggcctcctgagtagctggaattacgggcgcccactaccacgtctggctaatttttgtatttttagtggagacggggtttcaccatgttggccaggctggtctcaaactcctaacctcagtggatctgccggccttggcttcccaaagtgctgggatttcagtcatgagccaccgcgcccagccttagctatgtatattttgtggatatattcatattaagaatgttttactctattcagagttgagtaagcctttttatcacacgtaattgttttatcgtatgctataatccagtgaggttttttttactcctttaatctgctattttggtcaattacattgattgattttctaattttgagccaatcttatattcctagaatgatccacactgatcttgatatagtacattttctttacactgctgagttcagtttgataatatttcatttagcattttatttcttctgtgctcatgagtgatgcatgtaatatgctgtcttgtactgtccttgtctggcttggaatcgaggtaattcttgctttataaagttagtttggggcattattttggatgcctgctatttgttcctgctcagtgtccctgaaggctttggggtttttgtgtatctttcttcaaactggaagaatgcccctagtttctgacttctccttaggttcagacaatgagaaagggaggagagtggggtcaggatattcattcccctatttcttctttttttttttcttttcttctttttcttttttttttttttttttttttgagactgagtcttgctttgtcgcccagggctatttcttgaggtatctgtaggctggcaataactttcaactgaaagccacaactctggaatatgcctttattttgcttttattcttaaaagattgtctgggaataacaatttgggagcacaaaactgagttactttgattttgccattataaaactatcatttcattgtcttctgacctccaattgtttttgagaagttgacatttggtctaatatatattcctttgtataggaataaaaccgtaattaccacagaccccataacactagctcagtggtaatttgggtatgaatgttttaaatgcataacaatgcgaattgtcagtattaagtcaaatgcagctagaaacagtagttttcttatggtagtgcaagtttgtattaatggttagaaactggctgaggggacttttgtttcttttttacacaaagcaagtctaagacaggcatgatgttggggataatatctgtttaataagcaggggagaagttctgtgttgtttatcctttaacgatgtgactctcaggctctgcagtcctctgaatgccagaagctaagccaccagagactcacatttacctccattcaagctccagctgcagagtttacttacctctgtggattaatgctttcttgttgtttctgtccactgaaaaattctctttctggtccgtcagctctgctacacattaagaagaattttttaatctagtatttttacctgaaggagtttctgtgagtattcaaacctattgcaagaaacactgctatatggctcaaagcttatttttaaaaagccattttgcttatactaactgagtagtaatctgtgtattatatatttgtctttcaattgagtagaactttagaggtccttcaatctagcagataaagctgagatgaatggccattaggacattcagctgaggttacatagctgaataatagccaaatcaaaattaagaccaagttttttaaataatcatttcagtctgtgcaggaaaaggtggctcaaaatgatcatatacactggtttacttctccttcccctctttacctggctaactcccactaagctcttaaatcccagcttatgtgccatttcctcagagaactctttttctgagccctggactagtgtaggtttttctggcatttgtttccatgacactctgtatttctatcattactcatgcttcttttgtgtatttgttcaattttctttctataagtgcaaaacccacatttggtttgcttcctgctgggtgctcaacctctagaatggtgtctgaaagttagatatttaataagcacttgctgcataaagtgaaactccttatgagggactaatttgttgagtctctagggactgcttgagttggaggctgttatgcagaactgaactcataaactaatcttttttaaaaaattctttgtttctccaaggagagtgtgagttttataaatgttggcactcaaataaaaattaatcctcatgctttcctatgaaagaacaaaacggcaattattgagtgtaaaaatgatggtgtaattaaacctctcaactactgaagccagatcaataatagtacaatacatctttgtgaggattttatcagtcagcaagagagaagacagcatcaagggggaaggtcaaaatttcggagactatgagtccagtgttctgggttaatgttgtctgtcaggacgatcctcttggcatttttagtataccccacttactagtggctttctgaaaaagtaggcattaagcacttcaggaatctctttcttggtggttggcttagaaactggttcggagactgtctctgggagctatgatcacctcagttagactctgatttggagaagatgccacagttctcatgtaatgacagtagaagtaatgaatttccctctatgccaatacagattccagttcagaagaggcaaggacacagtttacaacagcatagactttcttttaatgttaagaacttaaaactcttatttcagcaaggtttgttattttgtagtgactgatttggagactttcctgttctgtctcccaaaggcctgaggccactcgcagacctgatggaggtggacacctggaaccacccaggcagggggaatataagtattcagggaagtccagagtgcttgctcttcatagtcgaatacaaatggggcaggcaggctctgtgattgaagatatttattaatttgaatcccttttcatttcattgtaccataagtcatatgtgattattatattgatgcaacacaagtgagccccaaaactggggcttagcccaggagagttcttggcttcacccaggaaataattcaagggcaactcagtaatgtttgacagcagtcttttattgaacagtactgctccatgcagagcaggggtaactcataggcagtgtgcccagagtcagcaatgtatgagctgttggcaactgaatatatacccagttatacccacttccaattacatacaaattaaagggcgggttaatgcaaatagaggggtgggttatttaggactttctaggaaagggtcagtaacttctgagtcattgccatggaaaggtggtaacttctgggttgttgccatggcatttgtaaactgtcatggtgctggtaggagtgtatgatgtaaatgagcaatgagggcaactagggatcactttccttgctatctgctggctcttgctggttccttcacttcatcccagtgggaaataagtcctgcttgtgtcctacctccgtatgattttaaggttgtgttacattcggtggtgtcctggtagatgcttaacaactcgttgtggggcagggatgggggaaggaaggggacctgattttagcatttggtgattcctgggttgtaaatactcccagcagggctgatttcaagttgccaatgtgacatcactgaaagcagagttggcaagagatgctcacccacaattgactccccaggctgctgccagcttataggagccagctccaggacaccactacacgtagtgctgaaaatgcaaaaaggaccggctgcttaactgatcctaagggacaagcaactcgaaaaacaccacagaaagccatggtttccagctgccaagagggaagccaggttccttctataatgtgggtgaagtctggataccactagggtctactgagctgtatctttatgagagtccactgaatctcaccctatcatttttcccacttgtgatccctcagacatgttatccccttgatgtctagattattcagagggagtgaaaagtggcagcactgtagaacagcacaactgaaggaagggattgatgaagctacaggtctctgacgaagagactttaatagcttttattctagtgagggtgccaggacaaagtgtttggtttttttaataaaatatataccatcaagatatgaaccaccaatatattagccaatatgtaaacatcagtcagtccagaatttagctgaagaaagagaacattatcagtctctttgaagcttcctatgtgccgctcctccaaatccccctaagagattatctgtatactgaattttatatgtataattccctgtttttaaaaatcattttaccacttaagaataggctattcagttttgcctattgttgaaatttatgtgaaagatactatattgtgtttgttcttctgcaaactgttatgttcaatattatgtgtattaaaataatttatgttcatgtacataactagttcttttttgttgttttgcagcatgattttagcattccatattatatggtctacaacaatttatctttcttctgtcaatggttatttgaattaattttaagtttttttctatttcagaaaatgctgctattaatctttcttgtatgtgtctcctggtaaatacatgcaggaatttctgtaaagtatatacctaggaatggagttgctaggttgaagtaaattgtatctctaagaagtttgaccacttacaatcccactagcagtatttgagaccatcttagactatgttctctctaacacttggacttgctatacactataattctaataatttgaccacagattcttttgagttttgtacattcacaataatactatgcatgaataaggacaattttgtttcttctttcttttttaattattttgcttgctctccctacctcatcttttttgcttgttttattacatttattacaatcaccaatacaaatgccagtggagtaaaccttggtttgtttctgttcttgaaaaaaatgctttgattattcatcactaagtaggacattggctatagactttttgaaaacctgaatggatattgaattttatcagttgattttctgtatctattgagagaatcatgtgttttgttccttttatcttttaaagtaataaattatattgctatattttatactttttatgaaaacttgtatttctgagataaatccaacttgttcacaatgtgttgcttttttatatacatggatatacatgaatgtgtgtgtgtatgcgtgtgtgtgttcagctatttggtttgctaatattttaaaaattttgtgactaaacttgtgagtgagatcaaactgtgatttttttttctctcttaatctgcattttattattaaaggtgtacaagccttaaaaatgagttatggcacattatctcttttcctagtctcttaaagattttgtgtcattttgtgtatgattgaaataatcttttctgtcaatgtttagtagaactttctagtataactttctgggtcagatatttactttaggggaaattaattcaatttatttgatgattataataccaaattattttttatttcattgagaattgattttggtgatttagatttttctagaaatttgcttatttcatctatgttttgaatgtattgtcttaaagttcttcataattttttcttcttatttctgccttatttctggttatgtccttattctcatttctaatatagattatttatccctgttcactttctcattgatcagtgtcactggagtttatcagtcttattggccttttcaaataaccaacttttaattctattaattctatttaatttttgttttccattatttttcctgtatgattttctttcttttttctttagtctattcagttgatatttttaataattacttatatctttaggttagtaatttgcagtcttttaaaaacttttttaaaatatgcatttaagactataaatttcccttgaagtagtgctttagctttatgtttgcaaattttgatatttagtgttttcatttttatttttatctaagcatcttctagcatcaaatatgagtttttctttggtctatatattgtttaaaggtgtgtttttaaaatttcatattgcatagtttttttaagcattatttctgtaacttaattaaaaatgtgattggataatatggagtgtattttatagattatttgatatctgttcaaatttgctttatgttctcttacacatcagtttttataaatgtgctaggtgctcttgaaaagattatgtctcactcatatctacatcttgaataatatttttcctcagtctaatatatcagttattgataaaatgtgtttttcatctcctactatgatggtggattttcaatttcatctttagttctatcaaaatttctgcttaatgtatatatgtaaaaatatgatattagtactttttatatatgtctggtcttttcaacattttgttattatttagtgtctctatatagagaaatgctttttaggccttcaagtgttctttggcatttataaagtttaaaaatttttcttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtatattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagcggtgagagagggcatctctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtccttggctctgtttatatgctggattacatttattgatttgtgtatattgaaccagccttgcatcccagggatgaagcccacttgatcatggtggataagctttttgatgtgctgctggattcattttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctttgatagaattcggctgtgaatccatctggtcctggactctttttggttggtaaactattgattattgccacaatttcagctcctgttattggtctattcagagattcaacttcttcctggtttagtcttgggagagtgtatgtgttgaggaatgtatccattttttctagattttctagtttatttgcgtagaggtgtttgtagtattctctgatggtagtttgtatttctgtgggatcggtggtgatatcccctttatcattttttattgtgcctatttgattcttctctctttttttctttattagtcttgctagcggtctatcaattttgttgatcctttgaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatacctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatccaaaagtgggtgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaataataataataataataataattttaaaaaaaatttttcttttagttttgtcttgtatatttctatttttttaacttacaaatttcctacatccttatattttaagtgtaaatgttgtaagcaaagtatagctggattttttttaaatccattctgaaaatcattgacttctaacaagtgagattagtatatttatgtcattgtgattataaatacatgtggatttatttctaccattttacatcatttaaattctaatttttaaatatttttcttcttttaaattgttttgaccccattttactttctcccttctaccaacttataagatacaacctctgtttttacttgtttagtactttcctagaaattacaatatgcgttgttaatttaataaagtaaaaagttaatcagtgtattaaacctccgtcaaaactatatttttactttgggacctttgactccagttacctccattccagatgacataactattattttctgatattttactcctatcttgccgtggttttctacactcagcaatttgacattataattaatgttttataaagccaatgattgtttaaatttaccacatatttaccacttctcttggtttactatttcttcagactttccttctagattattttttatgtttagtacatttttgagaaattccttcagttaaagatctgttgatgttagccctctcagtttttacttgtttggaaatgttaccatttcacattaataactgaaaaaaacataggtatgcaaatcttgtgtggataattttttttctcagtatctattcttttagaatcttgcctccaaactcctggttttgagaaatcaaccgctctctatgtgtaacactcttttctctgtgccatacttcgagacttctctgaaatttgattatagtatgaatggtgttgaatttttaaaaattattgtttatctttcttaggattcatagggtgtcaggaatctgatgtgtctcatcaattctgaaaattcacagccatgatctctttgcatattgtctctccctgatgctttctatcttttcctcctggaaatctctttagatattttagacctattcactctatcttccatgtttgtttgtttattctttttcctattgatagtgcagctgggtaatttctttacatctgtttttgagtacgctaattctttctttagcagtttccaattagtacttaataatttcttgaatttctcatttaaattgatgtaattttcattcctagaagctttgactcttaaaactttgttcatttgtataattatttgatccattttcatacttttgacatctttttagttctttaaacttctctgctcatatagtattttcagtcagataattataaaatatatgactcgacgtcacttctgcatttgagacaaaaggaaagtggcaaggaaagaaggcagtgataagtacctctagggactctttttcatctggaaaaagaaagcagtcctaaaagtcatcccaatgtctccgcttatttcttattggacaaagctctgtcacaaaaccatcctcacactcaagaaaagtaatgaaagcatatttttagctttttcagcctgtatgctggaaagtggccagatgaaggggttagaaatgtaatttaagttagctgtggcatttgccccagtagcacagaaggagatgctcaggaaccttttattgaatctgagtctgaaatgcaccatctcatttagtcacactgggtccacaaaagggaggacagggaagaaagctgagaaagcatgccagctctgttgggattcctgtgaacatgtgtggaggtgattccacagctcaaagaagataacaggggatagcgatatttttctctataaaaatctatccttgttttccttattttgggtggaatttgaaaaagggtaaatttataagagaaattaaaacatgcttatttaaaaaaaaactctccatgaacctatatgtgaatgttcatagcagctttactcataattgacaaaaactggaaacaacctaaatgtcctccaatgggtaaaacaataaactattacatacatacaatggaatgctactcagcaatgaaaggaatactcaatgtgtgcataatatacacacaatagcatggatggatatcaggggtataatgctaagtgaaaaaaagcaagactcaaaaatctacgtactgcatattttccttatatgaaagaggcaaaattatagggatggagaacaaatcaacatttgccagggcttggggatggggagatgcgttgatgacaaaggggcaatatgagggaattgaggggttgggaggaggtgaaactgcaaatcaaagataaataaaaatttaaaaatcactttttgaggaggaaaataaagaattaaatgagaaaaatctaatgaaaagagtgaccgtcgagtttgaagatacaggaatatataaaatatttctgtctatctaggaagatatagaatagataagaataatcaatagagcaagttctctgagaagttagccaacaggatctaaactataggtgtagaggttgactttagataaacaaggggacaatattttcttttgagatggagtttccctcttgttccccaggctggagggcagtggtgtgatcttggctcactgcaacctttgcctcccgggttcaagcgattctcctgcctcagcctcctgagtagctgggaatacaggtgcccaccactacacctggctaatttttgtatttttagtagagacagggtttcaccatgttggccaggctggtcttgaactcctgacctcaagcaatacaggtgtccaccaccatgcccagctaatttttgtatttttagtagagatggggtttcatcatgttggccaggctggtctcgaactcctgactcaagtgatccactctcctcagcctcccaaagtactgggattacaggcgtgagccacagcacccagctggggacaatattttctttgttataggaattaataggaaaaagatgagagcaaattcaggtaaatttgtagatttggagaagtgtaaagataaaacattaaaaaatgtgcaaaagggatagcagggattttttatattgaggaccaataccagtcaactggtggtagctgactaatgtattgtgttaggaaggatttacaagcaatatcaaggatcaggaaatgagaagactaggatctagtggcaatgtctgccacaagttttagacaaccaattaccttctattatttcagctaattctctctaattgtatgtattgtaagaaatcacacacacattctctacctataataaccttacttttccacttctctttgtttaactaaaggctattcacaagccgaggaatttgagactagcctgggcaacatggtgaaaccccgtttctaccaaaaaaaaatatgtaatagtacaaaaattagccagacatggtggcgggtgcctatagtcccacctacttggagggctgaggtgggagcatcacctaagcccagggaggtcaaggctgcaatgaaccatgattgtgccactgcgctccagcctgggggacagagtgacaccctgtctgaaataaaagctatttacattaggagtcctcattaagcaacccctctatatatgcacccggaatagatgagatgcttcttgtgtgctcttcaagcatcctatatgtccctcttcaccacagttaccacattagattgtaagtatctatgtatctctgcctaccacactagaatagttgatccttgaagaggaagtctgtaactatattcctattatttaacctaagaggtggatagtaaaattatttttgagtgcacaggtgaatgaaggaaactaaaatagctccaatatggcgtgtgaatcttaatttggaattcctggaagcagaagctgagagggattctcgtgcaagtgacttagtgaaggactgccctcaagtgaaacccataaagaagaaagggaggcaggtgggtgaagggagagagcgaggcaaaggtgtatcagctaaagcctttcctgagcctgatgccacaaggagctctggagcgtgaagagcaccactgaggtatcccaccctgagacgagggggccgccgttttaccctgtgctagtctttcatgggctgtaggactcctctgggaaagggtataacttgcctgtcattttcaagatggttcccatcagctgaggagaattttcccaagaaatatagagccatgaactgttcgcagccaatgctcatagccgctaaggaatggatgcactggctttgtcaaaggggatgtaggcagggaacaatagggtctattgcagtgtgacaggacaatgggaaaggggttatgggaacataggtgggaccctgactcccatgacctctgagatataggaaaaggaaggagaaagagaagagggatcctcttcccctcacctcccaccccacatactcctttcctaggtgagagttggcttgctgccttggcgttgtggctaccaaagacaggtgtctgcacagcaggctggatgctcctgagaggcaggttggctttgcagagagctgaggtggacttttgctgcatccccttcacacagttaaattattccatggctgaacacatggggagggttgagctagatgaaaaaaacaaatcttctacaaacctggaacagctgtaaaagaaatagagttgtcaaggtcagcaatttcatctctgaagaaaggtgagaccagtaagggagaacattcccctgggactacatttaatggtcttctacctatggaagtattactatccaaaatagtgatccagtttcctgacagaaagccttgtcccatggattggcatttgcttgcttggaaaatgagttttcaacctttcgagaatcgaaacagtttgtggtatttacaatacagccttactgtccagtagctaagtgtagtctaattctaacagatggctctccagggaaattttccttcagattggattatgcttccaggctgaaattcactaattaaggggagtctaaataaacatagtgggggagtgagagggaggggaaggtaggctgtttcttaggaagctgttttggaaagtggccatatttgcaatctttatctttccagctccacacactcagctatgtggagaatctaggccactgctttgctaaagacatggtagtgctggatcaagggtcagtctgccttcagcaaggagctatgacttcgttttctataaggccctggctctctaacctggttttctcctatgttacctgtcttgaaatgtagcttccagaataaatgtatctttaagatgagcatgactgactttaaaaactgaacagatctatgaatttggctctggtaaacattgctaaccttcttttataaaaagtctaatactttggttttgaagtctttaatatgtaaagatactcctctattacacatttcttaatgcttaccagtttgagacctaaatagctataggacaagtacatatggctatcagatatggaaggatgaattttgcatgagtgggctgagaaaaatccaatttgcaagtcaggaagtgagttctgggtcaggaagttagttgcagttttgtctccatcatcattcaacaaatgtttttgaatactcactgtctgccaggcaatgtattggacatcaagcacataatggcccttaccctcttggggcttttggttttgggagatggaaatgtgggaagaagggacagatagtgaaacataacattgcacagataattactcacatgtgttattggtgctgcagaggaaacgtaggcaagcgcttcctgtggcacctaacctggcctggtatattaaagaaggatgcttggaggaaataacattgaagctgagacaaaaggatagttaggcatttgcctgaagaagggcagagtcccacgcaaaaggaacaggaatgtggaaaggccccaagacaggaacagttttggcaagttcaggggacaaaaagtgcagggtggttaaagatagggaaataaaatggaagagagaccagaactcaggaaggagcaagaataattaagatttttaagacaagaataagtctttgagtctttatgagtaattttgggcagtgaattgacacatagaaatttacttttttaaaaaatcactctggctgcagtgaggaatggacaggaggggagagtgaggggatggtcaatctattatagaaggccactcgcgtgtggttaatagacatggagaaaagtagcagattccagaaattatttaagcagtttcactgaggaataattgtatgtaattaactgcatatgtttaaagcacacaatttgacagtatttgacatatatatacatttgtgaaaccatttaccatagtcaatcaaaataatgaacgtatctgtcacctcaaaaccttgcctgtacccctttgtaacctctcctgcctccactccctgccacccatccccccaatccccaggcaggtgttgatctgttttgtcacactacattagtttagattttctaggattttatagaaataagcatcatacagaaggtactccgcttttacttctttcaatcagaataattatttttgagattaattcatgttgtatgtattaataattcaatctttttattgctgagtactattccattgcatagatatgccactttttgtttatcccttgcctattaatgaacatttgggttattttcagtttgagatattacaagtaaagctgccatgaacattcatgtgctttgtatggacatatgcttttacttctctcacataatgacctaggaatagactgctggattagatggtaggtgtatgtctaccttttgatgaaattgctaaactgtttaccaaaatgattgtatcattttacatttacaccagctatgaactgtgaaagttctagttgctctacattctcaccagcacttggtagagttggtctttcattttagacattctaagaggtatgaaatagaatctcattgtgatttttacatttccctaataacaaatgaaattgagcatcatttcatgtgcttatctaccatctatttatcttttttgataaactgtacaaaatctttggtcaatttttaatagtgttctttaactttcattttaggtttagtggtacatctgtaggtttgctatataggtaaacacatgtcataggagttcgttgtacagattatttcttcacctgggtactaggcctagtacccaataattattttttctgatcctttccctcctcccaccctccacccccagaaggttccagtgtttgctgttcccctctttgtgtccatgtgttctcatcatttagctcctacttgtaagtgagaacatgtggtatttggttttctgttcctgtgttagtttgcaaaggataatgacctttagctccattcatgttcctccagagaacatgatctcattcttttttatggatgcatagtagtccatggaatattttttatggctgcatagtattctgtggtatatatgtaccacattttctttatccaatctgccgttgatgggcatttaggttgattccatgtcttgctattgtgaatagtgctgcaacgaatatacacatgcatgtgtctttatgctagaacaatttatattcctctgggtatacacccagtaatgagattgctaggtcaaatggtagttctgtttttagctcattatcgccacactgctttccacgatggttgaactaatttacactcccaccaacagcatataagcattctcttttctccataaccttgccagcgtctgttattttttgactttttagtagtagccattctgactggcatgagatggtatctcattggcgttttcatttgcatttctctaatgatcactgatactgagctctttttcatatttttgttggtcacgtatctgtcttcagaaaaatgtctattcatgtcccttgcccactttttaatagggttgtttgtttttctcttgaaaatttgtttacattccttataaatgctggatattagacctttgttagatgcatagtttgcaaggattttctcctgttctgtagtttgtttgtttactctgttgatagtttcttttgttgtgcagaagctcttaagtttatttagatcccatttgtcaattttagctttagttgcagttgcttttggcatcttcatcattaaatatttgccatttctatgtccagaatggtattgcctaggttgtattccaggatttttatagttttggggtttacatttaaatctttaatccatcttgagttaatttttgtatatggtgtaaggaaggggtctagtttcgatcatcttcatatggctagcaagttatcccagcaccatttattgaataggcagtcttttccccattgcttgttttttctcagctttgtcaaaaatcagatagttataggtatgtggccttatttctgggctctctattctattccacaggtctatgcatctgtttttgtaccagtatcatgctgtttcaattactgtagccctgtagtaacagggtaacatgttgaggttggggaatgtgatacctccagctttgttctttttgcttagaattgccctggctattcgagctctttttggttccatatgaattttaaaatagtttctgctagttatgtaaagaatgtcattggtagtttaataggaatagcattggatctttaaattgctttgggcagtgtggccattgtaatattgattcttctgatccatgagcacggaatgtttttccatttgtttgtgtcatctctgatttctttgagcagtattttgtaattctcactgtagacatctttacctccctggttagctgtatccctaggtattttattctttttgtgacaattgtgaatgggattgcattcctgatttggctctcggcttggctgttgctggtgtgtaggaatgttagtgatttttatatgttgatttttgtatcctgaaaatttgctgaagttgtttctcagcttaaggagctttggggccaaaaagatggatttttttaggtataggttcatgttgtctgcaacccgagatagtctgacttcctctcttcctatttggatgtgctttatttctttctctgcctgattgctctttctctgcttgattgctctgatcaggactaccaatgctatgttgaatagaagtggtgagaaagggtattcatgtcttgtgccagttttcaagggaatgcttccagtttttatccattcagtattatgttgcctgtgggtttgtcatagatggatcttattattttgaagtatgttccttcaaggcctagtttattaagaatttttaacataaagaggtattgaattttatcaaaagccttttctgcatctattgagataatcatgtggcttttgtctttaattctgtttatgtgattaatcacatttattgatttgtgtatgttgaaccaaccttgcatcccagggataaagcctacttgattgtggtggattaactttttgatgtgctgctggatttggtttgctagcattttgttgaggatttttgcatcagtgttcatcaaggatattggcctgaggttttcttattttgtgtgtctgccaggctttgatatcaggatgatgctggcatcacagaataagctggggaggattccctcctccacagttttttagaatagcttcagtaggaattgcaccagctcttctttgtacatctggtagaattcggctatgaatctctctgtccctgcacttgttttggttggtaggttatttattcttgtttcaatttcagagcttgttactggcctgttaagggattctgtttcttcctggttcagtcttgggaggatgtatgtgtccagggacttatctatctcttctaggtttttaaatgtgtgtgcgtagaggtgtttgtagtagtctctgatggttgtttgtatttctgtggcatctgtggttacatctcctttgtcatttctaattgatattgtctcttttcttctttattaatctaactagtgacctatctattattattagctttttcaaagaacaagctcctggattcattgatcttttgaatgatttttcatgtctcaatattcttcagttcagctctgattttcatttcttgtcttctgctagtttagagttgcttcactcttgcttctatagttcttttagttgtgatgttgggttgttaatttgatacctttctagctttttgatgtgtgtgtttagtgctgtgtatttccctcttaacactaccttaactatgtaccagaaattctgttatgttgtgtctttgttctcattagtatcaaagaacttcttgatttctgccttaatttcattatttaccccaaagtcattcaggagcaggtggtttaatttccatgtaattgcatggttttgggtgattttttgtctcgatttctatttttattgtgctatgatctgagagtgtgtttagtatgattttggttgttttgcatttgctaaggattgttttatgtctgatcgtgtgctcgatttgagtatgtgccatgtagtgatgagaagaatatatattctgtttttgagtggagagttctgtagatgtatatcaggtccatttggtccaatattgagttcaggttctgaatatctttgttaatttcctgcctcagtgatctgttgaataatggcagtggggtgtttaagtctcccactattattgtgtgagagtataagtatttttgtaggtctcttaagaatttgctttatgaatctgggtgctcctgtgttggatgcatatatatttagaataattaggtcttgttaaattgaactctttaccaatatgtaatgaccttctttgggctttttttgtttgtttgatctttgttgttttaaagtctgtttttatctgaagttaggattgcaactcctgcttttttctgatttccattttctaggtagattttcctccatccctttattttgaggctataggtctcattgcatgtggaatgggtctcttgaagacagcatgtccttgggtcatgctttttttatccagcgtgccattctgtgccttttaaatggggcacgtaatccatttacattcaaggttaatattgatatatgtgcatttgatcctgtcattgtgttgatagctggttgttacgccagcttgtttgtgtggttgcattttagtgtccctggtctgtgtacttaagtatgtttttgcactgactgctaacagcctttcctttctatatttagtgttcctttcaagatcttttgtaaggcaggtctggtgataacagactcccttagcatttgcttgtcggaaaaggatcttatttctcctttactagggaagcttagtttggttggatatgaaattcctggttgaagatttttttttccttaagaactttgaatataggccccctaatctcttctggttcgtagagtttctgctgagaagtctgttgttagtctgatggtgttccctttgtaggtgaccagtcctttctctctagctgcctttagcattctttctttcatttcaaccttggaaaatctgatgattatgcatcttggagatgatcttcttgcgtagaatcttgcagggattttctgtgttttctgaatttgactgttggcctctctaagaaggttggggaagttttcatggacaatatcctgaaatatgttttccaagttgtttgctttctcctcatacctttcaggaatgacaatgattaatagatttggcctgtttacataatcccatatttctcagaggttttgtttgttccttttcattgtttttttctttatttttgtctgactgccttatttcaaaaagccagtctaaaagttctgagattccttccttagcttggtctgttctgctgttaatacttgcaattgtattgtgaaattcttgtaatgtgttttgcagctctatcaggtcagttaggttctcttttatattggctattttttctatcagctcctgaataattatattgtgattcttagttttcttgagatgagtttgccattctcctaaattttaacaatccttgttcctatccatattctgaattctatttctgtcatttcagacaactaagctttgtaacaaacccttgttaaagaactagtgcagacatttggaggatataagacactctgactattggagttgttggagttcttgtgctggttctttctcatctctgcatgtgggtattcttttaactgctgggctgcttctgattgaagtggtcaggcaggagcagggttattgtgctagagtctgagatcaggcagccctaaccagtgaggataagtgaggaccaggacctgtatggagaacaatccagtcacttttctgtgaggtaggtgttctgtactggaggtctggacaagcccctggtgcctgcagactctctagagcctggagacagcaagggtgatggctgcaagacagcaaagatggtaatccacccttcccactgggagttctgtcccaggcaattgcagagctattactggctcagtagccccagtggggaatagtggagtcttaggccaggaggccacatccagtgaggagatacaggattagggagccacataacaaacactctggctactttttcacagggctgctgcagtgtgctgggggtctgctccagttcctactcaccttggattttctagcacctgaaagtatcaacagtgaaggttgtgaaacagcaaagatgatggtctgtccctacctctgggagctctgtctcagggaagtttgaagctgttactagctggaaaacaccagcagaggtgcttgtagaccttggctgggagattctacccagtgaagagaaatgggatccaggacctgcatgaaaatgcagtcttcctgcttcttcagagagctgctgtgctgtactggaggactgctccagtctctacacacctcggactcctttgagttggaaaacattaatcttgtgtttaggcacaggatgtaagggctactggaagatgcttctgatatgcgttggctgtgtccccacctaaatctcatcttgaaatgtagctcccacaatccccatgtgttgtgggaggaacctggtgggaggtaattgaatcataagggtggatttttcccatgctgttctcatgatagtgaataagtctcatgagatctaatggttttataaagggcagttcccctgcacacgttctcttacctgctgccatgtaagacatgcttttgctcctctttcaccttctgccatgattgtgaggcctcctcagccatatggaactgaatccattaaacctctttttctttataaattacccagtcttagatatttcttcatagcagtatgaaaatggactaagacagcggccatgagactgagttggttttatgaagcagaggagtcaagtttaaatcacatatatgattacatatgtgtaatcatactgtgtgtaatcatactgatatgactcacatctcagtcatatttgcaagaagcagtcagtctttgtattatttcattttcatgctgctgataaagacatacccaagactgggtaatttataaagaaaatggtttaatggactcatagttccacgtggttggcaagacctcacaatcatggtggaaggcaaaaggcatggctttatggcaagagggaatgagagccaagtgaaaggggaaaccccttataaaaacatcagatctcatgcaacttattcactgccatgagaacagtataaggaaaactgcccccatgattcaattatctcccaccaggtccctcccccagcatgtggaaattatgggagcgacaattcaagatgagatttgagaggggacacagagccaaatcatatcattccacccctgggcctctcccaaatctcatgtcctcacatttcaaaaccaatcatgccttccccaaagtcccccaaagtcttaaatcattttagcattaactcaaaagttcatagtccaaagactcatctgagacaaggcaagtcccttccacctatgagcctgtaaaatcaaaagcaagttagttacttcctagatacaatggaggtacaggcattggataaatacacgcattccaaatgggagaaattggccaaaacaaaggggctaaagaccccatgggagtctgaaatccagcagagcagtcaaatcttaaagctccaatatgatatcctgtctcatatccatgtctcatatccaggtcacactaatgcaagaggtaggttcccatggtcttgggcagctctgcccctgtggctttgcagggtacagcctccctcccggctgctttcgtgggctggcattaagtgtctgcagcctttccaggtgcacagtgcaagctgtaggtggatctaccattctggggtctcgaggacagtgaccctcttctcacagctccagtaggcagtgccccagtggggactctgtgtgggggcttcaacaccacatttcccttccacactgccctagcagaggttctccatgagggccctgcccctgcagcacaatctgcctggacatccaggcatttccatacaacctctgaaatctagacagaggttcccaaatctcaattctttacttctgtgcacccacaggctcaacactatgtggaagttgccaaggcttggggattgcactctttaaagccacagcccaagctgtaccttgaccccttttagccatggctagtgcatctgggatgtagggcaccaagtctttaggctgcacatggtaggggtacactggacctagcccacagacccattttttatcctaggcctctaggcctgtgatgggaggggctgctgcaagggtctctgacatgtcctggagacattttccccattcttttggtgattaacatttggctccttgtgacttatgcaaatttctacagcaggcttgaatttctccttagaaaatgggtttttcttttctattgcatggtcaggctgcaaattttccaaacttttatgctgtgtttcccttttaaaactgaatacttttagcagcacccgagtcacctcttgaatgctttgctgcttagtaattttttctgccagataccctaaatcatctcccttaagttcaaagttccataaatctctaaaatgggggaaaatgttgccagtctctttgctaaaacatagcaaaagtcacttttacttcagttcccaacaaattcctcatcttcatctgagaccacctcagcctggatttaatggtccattatcagcattttggtcaaagccattcaacaaatctctaggaagttccaactttcccacattttcctgtcttctttgagccctccaaactgttccaacctctgcccgttacccagttccaaagtcacttccacattttcatgtattattacagcagtgccccactcccagtaccaatttactgtattagttcgttttcacactgttgataaagacatatccaagactgggtaattcataaagaaaaagaggtttaatggactcacagttccacatggctggggaggcctcacaatcatggtggaaggtaaaaggcatgtcttacatggtggcaggcaagacagaatgagagccaagcgaaaggggaaacccattataaaaacgtcatatctcatgagacttattcactaccacaagaacagtatgctggaaactgccctcatgattcaattatctcccaccaggtccctctcacaacacatgggaattatgggagctacaattcaagatgagatttgggtggggcacagccaaaccacatcagtctttatggcagaagaggggaagagaagctttccattgtgaacacttccacacttgattatttccttcttctttggcacattcctcattaatttccaccaggaggaggcatgcagcccagttcccctagtctctcttcctaaatcccccatctttttttttcgtttttattattgagttgtgagagcttttaaaatattctggatgccagtcctttatcaaatatatggtatgtgaatattttctcccaagctatggctttttattctcttaacactttcttttgaaagagagacattcttaattctgctcaagtccatttactcaatttcatcttttatagggtatgttttcagtggcgtgtcaaagaagtcctggcctaatccaaatttatacagtatttttttttactgttttactctagaagttctatcattttagctcttgcatttataactacaatccattttgagttaatttttatgtatagtatgatatggtttgaagttctttcttgtgaatgcatatgtgtgtgtatactataaagttgttccagcaccatttgttgaaaagtctatattttatccacacaattgtcttttgcacctttgaagaaaataattgatcatatatatgagtctattctggactctctattcttttccatcgctctatttgtctagctttactccaatatcacagtgtcttgattgcagatttataaatcttgaaatcaaatagtgtaagtgctgcaactttaccctactttgtcaaagttgttttagttatctaggtcttttgcatttccatatgaattttataatcagctcattattttacacacacacacacacacacacacacacacacacttgaatttttattggggttgcattaaatatagaatcactttctattatttggaaataataggaatcttaaaaatagtgagtcttcccatcacaaacagtgtatctctctccatttagtacatcgtctttaccttccctcagcaatattttctaagacaggtctctcgagctctctcattgtttatcgttctcttctctggtactctaccctgcaaattctaggggggatggcctctccagactcccaagtccgtttcctcaactgagggagcccactaggctctgcctgggttttcacctgtctgtactgtgtctctgaaactttctccaggtggtgacatgggcagttttagttcttgcctcatttgtttcctgtcactcaaggatcacatatcttcattacctgatgtccaatcattgtttcatatattttgtccagatttttagttgtttaaaatgtgagagtaaattcatttcctgcctctctgtcattgtcagaagtgattgattttatgtgagaattgaagaaagagagtggtcaaagatggatgattttctggttttcagcatgagcaaactccagatgttggtatttactgagatgggaaatattaggtgaagaataggctgtattctggtataagtaagatcatgtgttccatttttaacatattcagtttgtgctacctgtgagacattcaagtataaaaaaatcaaaaaacagttgtatagactaggctggagctcagaagcagggcctgagttggaaatatgaattaacaaattgtcaacatatcctgtttatggtatttgaaaaatagatgttgacaaaggtctttactagcagaatgtagagtgataaaagaggaggacagaggtccagtttttgaagaatactaatgtttagacttcagatggaaaagaagaccttaatctgagcagagagagccaaagaggtaaaaggaaaactggttgattgtatcatggaagtcactagaagaatgtttcaaggaaccaagagtggtcagagtcactctgactgagagagtgacaaagctacattgaagttgatgaagaaaggactgaaaagaacccactggattatgtgacggcaaagtcattggtggctttagtaagggaactttccatagagcagtaaggaccaaagccagaacagagtagactggaaagcaaatgacaggaacaggaggcagcatgtttaaatagctccgtggcacatttggctgcaaaagggaagaggaggactgaaattgggaaggaatttttcaaaatgggagaaaacagattatttaaatactgacagctaagagccagtagtggggaagcctggagatgcaagaaagagaggatgagcagcagagggggttcctgtggctgagaccccatcggatggcacgaatggatgggacccagaacagagttggcggatttgcttttgataaaactcttcttcccatgttgcagtgggagggagaggccaatgcaagtgcaaatacatttatgaatccaaaggtaagaagtcaagtgtagcccttctgatgtctctgtcttctctgggagggaagaaacagggctgtgtactgagcatatggaagagcctctgccttcagggagcttgtggtcttttggcgtgtactgctctgatgatttcttttatagtaactacaaaatcagtctcacttcaacttgcgtcccttttaaattttaaaatgttttacttttcaaaaataatttgctggattttccttgattatgtaatctgtctgctcaatacagaaaacttgaatgaaaacagaagagtagataattctgatacaaagtcacctatagtccctctgccctaaagtaaccactgttaaagtttgatatatctttcctgtataatctctgtccatggttcttcacttgcaatttttatatggttgtgacactattttgcctgcttctttgctgtaatttgtttaagtaaggaaactaaacacaaagttttgtctcaaaggaccatttctgcaggtgggtggggcccctgttcctgaacagggcttcattccctttgtccatgtttgctgagatcagggcttccctgctagccaggcatccctgaacaagccaaaatgcagagcacagccttcaaaggaagcttgtctgtcttctctctttggaggctgaggggtcacagtcagcgtacccagaagagaagctgggacttatcaattaaccaatactgctttcaaaccgttttcatcaaaatattttttttttttgagatgaagtctcacgcttgtcccccaggctggagtgcgatggcacgatctcagctcactgcaacctctgcctcccaggttcaagcgactctcttgcctcagcctcccaagtagctgggattatgggcaactgccactgtacccggctaattttttttgtatttttagtggagacggggttctaccatgttggccaggctggtctcgaactcctgacctcaggcgatccacccacctcagcctcccaaagtgctgggattagagatgtgagccactgcgcccagccgaactatttccatcaaagcatggggaagtttcatatgcagcttcagggatcttggggctggcagctgtcaaataagcatgctgtgggaactggggagtcaggaagattgtggatatgtgcttctacttgtgcctagaggaaaaggtttcctcttgtttcacaacagccttggccagcagctttttgagggagtgggaagcaggacaaggaattttggtgtctgccagattgagacagggatcaagaactgagtgaggacagagcgtgaaagagtggtctcaggcctcctgaagcatttgttctttcaacagacaggctccgtgctagcactagaatgcccatggaaactgaaggaggaaaccacaggctggcagaaggctaagtctgtggcatcagagcaggaagcaattccgtgaaacagcgactctgctctagctacatttatttccctctgttcctggaggagtgaggggaagggggagacatccttttctaacaagggactttcctgaatacttggattttatattaattcatgctttcagaatttaaaggaactctttctgcacagagggagtcccccatcaggtcatgcaatgtttaacaattatggtttggccacattctcctagaaaaactacaggacctcccccttcaaagacatatacaactccaggaagccacctgaaaatcttgtgttggtccctgtaccaactctacccccctcctcagtctctattaatctgttcccaaaaagaaatgtcaccagatggccctgcaaatgtcacctggccatcagcatggcttcactcaaaacagggaggcattagagaatctaatccatcgttcatttccatcatttcgggtcagtttgcatcctttactgggcatatagtgctttcttaacacactgggttggacagtaagatctgtaatcctgctgatattaaagaatattgcttcacgtttaatggaggaaggtcccagtgactcacagatactgaacattctgtaagaactcctctcttgttagcatttaataccagattttactgccctcagcttcatgaactgagcactccctcagcattctcaatgcctcaggctatctttagcatttaatcccttccaggtatcagagccatcagacctcctttttttttttttttttttttttttttttgtattttcaaagtgcggatgggtggattttaggaattgagctgatccctttttaaaatgggtttttcttttactgtctcttagatttcatatccagtcatgggcatcagacccgtatcctgtctctgctctgtgtatttctccattctagcagttacagaaatagctgagggaggtgtgactggttctggagaaagaaaagaaagctgaactcctcacgctgaggaggttgcagggccacagctaggcgggctgggggtgggaagatggctgtactgctgggctgtcaggcagaggggccacacatccagatgtgcttttgagctccccgcagcttttagggagtggcttccaaatgagtcataaaactcagaggtaggtttggaataggagatttcaagtgggctcctgctcactgtcagagccacttactctctttactggggattaaagaactccacgagcattgccggggactggggggaggggaaattgtttaatggatacagagtgtctagttggggtgatgccagcattctggaatagacagtagagatggttgcacaacactgtgaatgtacttaatagccactgaactgtatacttacacatggttaaaatgataaattttatgatgtacattttaccacaataaaaaatatacaaacacacacacacacacacacacacaccatgaaaactctctaccagagtgcaaataagacttggagacaacagagaaaggcgcaggcccaaatgcacagagttgcccctgcctccagccagttgaggtgggctgcgggcaggggtcatgttcctacaggggccacctactcatcttagcagagactccatacagcaagggctgggtttccctcagcttcccagagcccaggcctatcaccctaccaacgtctgtcccaacaaatccatgcacattgcctatatgccagaccccagttctagtgtgttttccacttaattttcacagaagtgaaatagctattatgcccatatgacagaataggaaaatgaggtatagaagggttcattactcgcctaaggccacacaagtgataaaggtgagatagcatttaaatgtaagtctatttgaagcctgtgttccaaaactcagttttcccgattatactacacttcaaaatatccatcttggtaaaaaaataggtcctgaacaatgcttccatcaactctagaataaaaatgagtttgtatcatgatttgaatccagtacacttcagagacactggcattctgctgctttcatcacactccaccctgtgagtcactcatgccagggggggacccaccgaggatgcctcatgggtcaatatagtttttgctgaatagatgatacatcagaggctgaataaggatcaggctggccggacagatttccagagaactaatcaataaagggtactaaaacattgaggtggaggaacctattaatctgtataactttctagaagaacattacatatggttggaaataatacctgaagaagtgatgacattcccaaatagctcaagttgcagtagatgctcactaatatgtcttctgaaggtgtaggtccaggcaaatgcaggcttcaggcttgagctatttgggtggtaaaggaaagactagcactgtctccaacaaccctctttgtctacccatcagagcagccaacttctcataaacactgaacagatatttaaataacatcagtttgaagaatggccaaagtcacctcctacctgagctgcctacgtgcattgatctgtcctgcaggccacaagtttttatcccctctttcctatgtctcagcctacttctgcctcatagatacacacctcaaaatgcagccctggggcctgggctcactttccttcatcttccatatctcaaggcttatgttagagctcattctcttttctttcaggtccaatctcttctcctctcaatgcccactgccacagctccttctttggtgactggcattgctattgccaccaccaccaactttcaacctgagagcatgatttttccagaagacgtgatgtagaaagagagagaaaataaatgctacttgcattttgacactatctaaaagcaaacagataaatgtttagctttaaaaacatttctaaatgtgtaaaacaattatttatagtggattcttgaccctgatcccattgctcactctcaacctatgtgtgagggatggtcacttatggagtgagattaggcgtgaagtaagtatcagggtaacaaaaccagtgattttttaaatgatgtcatgattttgtcttaaaaaaagtcaagatcaaagcggccagctaataaagtcctggtcctacataaataactagggttttaaaaaattatctttaatgatttttttaacctccttgaaaaagatgaagtggtatatattgcctgtttcttaatggttaagtatcatgaactttggtggggaaagaaactgaaagcccagtaattccctcggtctttatataagaagagtattatctgaatgtcgtttggggcagtggttatatttttaagcatctgtcattcatgctaattgaccagggatgtggctagccagggtcaagctcccacagtcagtgcaagagggccctgaggctttgggcagcctgtccgatggcagccacctaatgtaggatgcagtggcagtgctggcccacttttgagagcagccgctgagttacggactccttgtgtgggagctgtatgtcggactggagctccagactgctcattccctgcccagagccttaccctgtcatcattgattttatggggaaagaaagcatctccttttgtaaacaccacaccagcatcttcaataagatgatgcaatgggattaatgatgcactttccagcatcctcatcgattctgaagatggaagtagaaacttgagatgagactaagccatgttttgtcaacattttgcttctctagcaagcaaaatatcctcaaattgtgagtttacttgaaagatatgctggtatttgaatccccagggctgggaagattctattttacagacatcaccaggagtgtgacactcaggcctgagagtaaggagaaaggaaggaaaaattaatgagtaaccaaccactctatttcagagtctgttgtatgggtgagctggtggtgattggcttgcaaatgtgttttccaggaaaaaaaactctacaggagtggtgggaacaggatgggagtgggagggcacagagggaccaacagaccttccttttctttgcaggtctaggtctgaggatggcccagatggtgagcaattgtgtggctatttagtcaaatcccaactagctcagcagataactgaacatccctgaggggcttgggaaatatatgtgtttgtgaagtgctgtgagaatttacccagtgtagctcaatctgcctcagactgacttctgacataaatgaattttaagaaagtaggcgttttccttcttgaagaagcataaactcatattaggttagaatctcaggagtttgtattcagttgatgtctaggcacatcagagatggagaggagataaatgtctctccagcaaagccgctgggtttgcacacctgtccccaatatctacactgggcttgacagagggtttatgtagactagtcagaaagttgtgcagcagatattcaatactgaaatcaacgaatgcactttattactcacttgcctactatccctggatgacaataagacctagatctacagtttaaagttcagaaatatatgatgcttctcgatggttatgatctgaataacagaagtgaagcgttaaggtaaatattgatgttatttaagaatactcagtgaactaacaggtctctgatgactgtgtaatttatgcctagccccgtgaagaatagtacaaaataatatgacatgtgctcccctgcacttgttatggaagatgagacacacctatgaaaagctgaagtagcaacacagagcaggatgcatacaaacatgtgaaatacacagagattactgtgagctaggaagacgagaaaggcatcaaagagtaagccatttggtactggtccctgaaggtcttgactgcgtgcagtgatcttaaaagtggggtgtgagatgacatacactagggtgcaagaataaaatagtaggacttctatttatattttctcatctttgttatttctcttttgtatgtttattacacacataatgttagaattctatacacgtataaaacttgtaagtaagtaaatatacatatatggggtatgtgccccccaattttttgatgtgcatgtgccagttacaaagttattttctttcagcttcaaattcacccttcattttctgctctggaaaagtcaagttgggacctttaaatatatttccttttaccacccagaacaatgttaagctctgtcagcagagggcacaggagaggcattgcaagaggaacggggtttttttcttcctagctctggtgtcctcccctgaggcttctgcagggaggcacacttcctccagcccccaggaaccactttcctgcaatatgggcagcagcttcagtgcaaggctccacaacacccatggcctctccggcactcagcccctgcagcatatagcaatcagcagcacccagtgggcagcagcttccccaggaacccccttggcgagacaccttcccatgaacagcttttcctagcacctagatggcagatttccggtaagttctactggtgcagtaccacattgacttctctgccattcagtgagtgatggctgtgccctctccaacaaggtctgtgtttcagccttgagggcagggaggatctcttccttgagtgctctgctcctcatatctgctaatcctatagtttttagagttcattgtacttcttgctagccaatccttcattagttcgatcctctgttatagtatttatttatattaagctttccctgtttgaattactggatggtttctctcctgaatgggtccggactgattcactgcacttctattcataaaaaattttgagcatgcactgactgccagtatatgtatattttcttgtttatcaattatattcatgtattatttgactagttttcatgaacacattaaaaacatacacaaaattttactaagataaagatgaaatattgtatatttgaaatattgtctttgaactatcttgattgtaatggctttatactacaattagcaaatatctgaagtaacaatatgaaccaaatatggtgaatcattaatagtaatgattgaaatttaaattacatttcaaataatgatttgattggaattaaaagagggtacctgtgtccatctttatgttcactttgagtagactttattttatttttaaaataacaaacttcagagcaccacattgcacacctctggggcatatgaatcctctttggacacaactgatctaagctacccccttgtctcctttctggtccatcacctatactccagccatagtgatccacataaaaatcacatcactcacttgcttagagcacttcattggctcaccatcagtcttatgataaagtatgaaacttatctatagacaattctgagtgggcttaggccatggtgaatgtgatggtccaaatcctggcagaaccaacatctgtttttttctctagtcttgtcacctaccctcgcttgcctcacaaacaggcctgaggtagggaacatacactgagggatgctgcaccagggcttttcctgttgaaacccaggccctgaggcttggacttccttcctttaatctgacatgtgacccctcctcagttctgaaaagctcctaagtagattgagtaattccaggttctactttcccatgctgtctgctgattgtgtgcttctctgttctttctacagcataatgcactgctacttcattgcaagaagcttcttatgtactgggcccaacttgatgctttacagtttgttcttaggctggaagtgtcagcttttggagtgcaggggcagttgaaatatatctgtcatctaacttggcactatcaccttcccaagcacagtgatattgcctttcacacagtgatggcattgcctctcaggaatactctcccaggctacccctccacagatgctatggtaccatttctccctatgcctcagtttctcctaaagatattaacacctgaatttacctatgaagttgttaaaaaaaatgaattatggcttggactagtacctgtaatagagaagggattttcgatacacattaattattatttcttcaaggtcgacaaccaagataaaagtacgtttccataggttttctccctgcaactcttctcacacacttctacacctgactccaccagaaatctgaaaaaggcagaatgctctttcctgctatcggactcctagatgggagtttcccagcaggcacaagtgccagctgcaggacacaggtgtgccactaatgacctacaggtatgctgagatacaaatttcccctcagctttgtgggaggccaggtgggctctctttaccccctagccttaccttctcacctggtggggttaccccagtgtgcaccagatgtggcttcctgtgtttaccacaacacaaaatattagggaaatgctgttggaattaccttaacactcttctcctagtatctcttctgttgatctttctggcctcaactcaaatctcaccttctccttaaatcctttcctgccttcctcagctagaaggaacaaaagcatgtatgtgatgcaggttaccccaccttcttccataagcttctactgcagttattgtctgatccattgagtagacagttaaacaaatactcagctactgtccttgagacatcacttatatgctattgcgaagtgaaagagaaggattggcagtgggattgatggaactcaccttagagatcatctggtcaaatgatatatagacagaaaggaagtcttatcaaggttaagtggaacttgttcaatgtcacctggagctggaattggaggtccacgattctaataactgatccacagttgtactgcttgcatttctcatgctgtgtctttgctcccaaatataccaggagctcattggtggcccagtcccttcctgattgtcttgtgtctaccacagtgagcctggcccagggccttgcacaaagttggagctcatgagatgtttcctatatgaatctaattggtcacactcaagcattttcctttgctttcatttgggaatcaatcctaaatcattccaaagggatgatagtttcttttctgctcatgatctgtttcaggtctaggatgatacaactgataatgtatttgagcctgtccaggagctgagattggtcactgtagttacagtcaaaaaacggtgatgatcccatcaaaggatggaagaagcagttccaagaagctaattggaaagactgatgagtctaccatttgtgctttcaaacttgagtcgttttactagttctcaaaatttaatttcaataccttctttgaaatgcggacattcagcatccacattgtcccttgggtgaaatgactactcctgtatttcagtgttctaaattatgagcaattaacatcaaggctgtagccttagcaacctgtgcctggcttgggggctttgccccttctgctggttctgttttcttcctcccaaccttcctttgactccctgcagtgcgagccctccagggagggaagaaggaggagaagacaccctgctgcacattacttttctgtactccactgatgctcctttccttttgtgatttaataacttaaacatctgacttgagaacattggagatagtaacaaaagccactttttgaaccttatgagtcctttggagacaactgtcacattttacagtagatgcaattaaaagtaattttgatcatcagtaatagaagcttcacttacaggttctattatttggaatatagttattttttatttcacttttttctagtcatattgtaacattaaacatgcaaatttatgcattctacaattctacactaaactgttactgtgtgccaggcactgcactgctatgttccaggttccctaccttcatggtgtttcagctaggagaatggtggaccgtaagcaaatgattacacagattgttatttaattaaaatagtgagaagtaatgcaagaaaaaatacaagatactcaaggaacctgaaccaaaggggtaaaatctggtatgaagagtcagggaaagttttcccaaagaactagcatttatggtgaggctaaggtgtgaatagaaagtaccagaagaagaggatcaaagagaagttgttcaaagagaatttcgtgatgaaaaatcaagccatgttaagtatttgagatttttttcccctaaaccaccatggaaacctaccgaaggatttttaggaggaaagtgatatgatcctatttgcatctaaaaaataaccctttacctattatgtaaaaaagacagtgtcttgggaaattgtcaaggactatgttaatatcatcttaccttgatagaatagcaaaagagagccaatatctggtgtttggaaaaatataatacaaataaagcataagacaaaaataatattaattttacactggtcttcaaaaccagtgtgggtattactaaatgtctcctcaaagatggtaatgcagatgaaccgatagtaattgggccccagcttctctgagagaatcctaaagatagcaaagcagtgtgaagtaagcttccatatatgcatttgtttttctctgggcattcttttttgttccatcagtttatattccatcaattgcatcaatataatactaattatattagtaattgttgaacctgctaccatgaatcacctctcactcaactcccagcacaaatttcctactcaactttcctctcctccctcttacatggattgattattcttagcccttcattattcccttagaattttagaatcaggttatccagctctatgaaaaccaatgtaaccatttttattttaaaaactgcattgcatttatatattaattcgactagaatttacatctttataatattgactttatctatagacataatttatttctccattgatttaagtgctcattaagtcattcaaaaatatttattgagccataatatgtgccagaaattattctagaaactgttaagcagcggagaataaaagcagaaaaaacactggcttttaggactttatactctaaaaaagtataaaagtgggagaaacaaataattacaaaaaatatacatgttaagaggtgatgagtactgcgaagacgaaaatggtatagaaagggttaaagaacgacgaatactgttttatagaggggtcataataatggtcttcttaaaatcataagtttttttagatttatttatcagtacaatatagttttagatgctagcatagacattgtcttcttttaaagttatggtttttttggctggtgaataaaaatgctattggtttttgaaaattgattttatatccaggaaatttttatatttggttattaaattagtttgcagattctcataacgattgtcattttcaacgtaacacaatttttcttcctttttaatcttccagctgattattatttttcttaagtagggcactgttaggtcctcctgtacaatattctacagaaatggggcaagcaagtattcttgtcttgttcttaaagggatggttctagtgtttcatcattaagaatgatgtctttggtgaatgtttgatggacatattttatcagattaaagattcatagcttgcaaaatatatttctcatgaatgagtgttaaattttcatgtttttagaaaacctaatgagaagataatattgttttacattttccatttccatcatgctatgtggtggaatacattattagattgtctaatgttaagtcatccttgaatgctggtaataaaccctactttgtcatgatttattatttttttccatatattgcttcattttccctgcttctaatttcttcagatttttttttattatactttgagttttagggtacatgtgcacaatgtgcaggttaattacatatgtatacatgtgctatgctggtgcgctgcacccactaacttgtcatctagcattaggtatatctcccaatgctattcctcccccctcccctcaccccacaacagtccccagagtgtgatgttccccttcctgtgtccatatgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatggtgagcattttttcatgtgttttttggctgcataaatgtcttcttttgagaagtgtctgttcacgtccttcacccacttttggatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatctgatttgtcaattttggcttttgttaccattgcttttggtgttttagacatgaagtccttgcccatgcctatgtcctgaatggtaatgcctaggttttcttctagggtttttatggttttaggtctaacatgtaagtctttaatccatcttgaattgatttttgtataaggtgtaaggaagggatccagtttcagctttttacatatggctagccagttttcccagcaccatttattaaatagggaatcctttccccattgcttgtttttgtcaggtttgtcaaagatcagatagttgtaggtatgtggcgttatttctgagggctctgttctgctccattgatctatgtctctgttttggtaccagtaccatgctgttttggttactgtagacttgtagtatagtttgaagtcaggtagtgtgatgcctccagctttgttcttttggcttaggattgacttggcattgcgggctcttttttggttccataagaactttaaagtagttttttccaattctgggaagaaagtcattggtagcttgatggggatggcattgaatgtataaattaccttgggcagtatggccattttcacgatattgattcttcctactcatgagcatggaatgttcttccatttgtttgtatcctctttaatttcattgagcagtggtttgtagttctccttgaagaggtccttcacgtcccttgtaaggtggattcctaggtattttattctctttgaagcaattgtgaatgggagttcactcatgatttggctctcatttcttcagatttttatagctttattcataaaggcaattggcctataattttcctctctcctactgttcatgttgttatgatatcaaagttacactagcttcataaaatgaattggaaaaattcctttttaaaatctttcctctggaaaatttgtataagatattgtctccttgaagattatcttagagggctttttgaggtgggttttaaataactgatttgattgatctaatagttataattttttcaagttatctattcttgattctgacgttggtaactggtttttttctagtcaattttccatttcattaagttttcaaatttcttggcataaagttggtcatagtattctctaacatttctaaaagttcctaaaatacacatagttatggcttttcatttctaacattttttatctcttttttcttgattctttttatcaaggaaataactaattttaaaatcagcttttggtattatattttttctttattttttctatttcctcccttacttctattttgttttgacttttgctttttgttgcagtttgtcttttttccaactttttgatgtggtctttcattgcatcttgtgggtcatcagttctgagtagcttctaattctcataataatcactgttttaactgttatttaaaagtgtgtttttgaacttccaaatctgtggacttgtttgacattttgtctttgacttatagtgaattttggtcgtagaacattgtctgaagaataccagttatttggattaacagagacttactttgtagccttgtatatagtcaacttttataactattccatgattccttaaaaaaattattctctcctgttgttgaattcatggttccatatgtgttccctagatcaaacccttttgttaattgtgttgttcaaataatcgatattattatatattttgtctgcttgggttatcatttacagaagtgtgttttactttccctctatgattgtgaatttgttgattgctctttctggcaaatatatgctggttcagggtcattatatcttcctggcaaattgttccttatattattatgttggctggaaatgagatcagctgcatgttgtggaaaatcaactagagtggcttagtaaaagaattacatttttctcaagaaataagaaatttagtagtagctcaggactggtcatgctcttcaagttagttttcaaagactcatatccttctaatttcctattccaccactcttgcaatttcattttcaaatttatggtcactgaaaagctcctcttcctccagtatcaacttggcattacacataagaaggtggtagaaggttgaagggcaaaagccctatgctagctaaaactatcaggaaataattacatcaggaaaataatagctttccccaaagtaccatccagtagttttcttttcttctctttttttctttttctttctttctttcttttttattttattttattttttttttatttttttttgagatggagtctccctctgtcacccaggctggagtgcggtggtgtgatctcggcttactgcaacctccacctcctgggttcaagtgattctcctgcctcagcctcctgagaagctggggctacaggcctgcaccaccatgcctggctaatttttgtatttttaggtttcacaatgttggccagactgatctcaaactcctggcctcaagtgatccttctgcattggcctcccaaagggctgggattgcaggcctgaaccaccgtgaccagccccagtagttttccacctatatatttgtgtccagaaatggtcactgatcatccttgatgcaaaagagtctagaaaaatgaatatttttaactgggcccatgggtgccccaaacccaattgaaattccattagtcaggaagaagggaaattgaagaatgttaggctgaaaaattggtagggtatgccatagttgctttaacctgaataatgtttttcaccttgaagaccatgctttccaacattatatgaacttttggttagtacttatcgcatatatatatatttcattgctttcaacattaatgtgttatatcttagaagtgtctgttgtaaataacatagaactagattttaaaatccaatcagtttcatcttttaattgaagatgtaaccatttacatatatcgccatgactgatatatatggatttatttctcccattttatgattttttgctttctagttaatatgttaaatttttgtctcttttatctttcttcttgccatttattggccttttttttttttttttttttttttttttggccatcgtgtctttctttcatcagttatgtcaggaacttgggacagctccattatacctttcttttgctcttctcaaacattccatgagtcaccagtgtctgtaaatctcattttgcacatttaccttgaatctccactagtactatctgggcccaagatactatcatttctctgctaatttttttttcataactttcttattggtgtcctggaatctactcttgctgctactacagaatgacttcactggactagctagagaagttagtgggaaaacaactagcctacattttcctcaacttacccacattgtccaattaaattgagtacttttaacaccaagacctcatgaaaggaaaatgatgtgctcagctttctgacattagcatctaggtaaatggcaatactagtaccgaaatgtagaataccagaaatgaaacatatttagagtggaacatcatgaattcagttttgtgcatagtgaatgtaaggtgtctgtacactatccaaggagtgacgctggtataggctgttagataaatgggcttgaaacttaaagataaatctttacattgaacatattgaaggcttgggaaaggatccttttagatgggtgaagagaaagcagtgcctggtcccaagccctgaaaacttcttacatttaaaggtccaatgaagtagaagcttccgcaaaggaaattgaaaagataaagtcaaaaaggagaggcaagagaatctaacatcatggaatccaggagtaatgagtgttttcacaaggagggagtgatcatttataacagataccactgagaagatgagaatggagaggtgtctgttcagcaacataggggcacattggtgacagcaatttaggtagagcccttggtgcctgtcccagatagaagtgagctgaggaacaagtcaaagatatggaattagagttatttcttttaaataggcttttagagaaatttggccagataagctaagaaaatgacaagcagtagctgggagagggccatgctttcaaggaagaggtttatttaaaaatatagagtatatgtttaaatattaatacagagaattcagtgggaaagaaaagactgaagaatgaggacagcaaagataatccactgagtttctgagaaagcttagtggggtggggtattcatcctacttgataggatgagaagcaacattgaaagaggcataaagatgcaaaaaagaatctcccaacattggaagaaggataaagatgcaaacctctttgtagtgatgttggcagcgagttaaggcagtttctgtctaatgatttttgttttctacatgaagtcagaagcaaagtcattttctgatgatgaataaaggtcagagctttaagaagaaatagtaggcctggtcaatcaatacatagctacattttgttaaatttctagtgttagggacatatttctaatgcccaccaaaaaatccaataatgtgattattttcattctatagataaagaaacaaatgttaaataacttacccaaactcatatggctggggtgtatgccatgcagatggcagagctgggactgaaccccagatttgtttgactttaaaactgacactaatttgaaaaattaaaagagtatgacaaagacaaattatctcctccagtttttcactggctagttggaaattctctgctgtctcttcattggccttattacagttcatgtggatatttaagatcgttttgtgacccagttgaaaactctaacctgcctgagcagaattagttgtcttcaatggttgcatttatttctgataaatgcaaagcatcactaggactaaaatagaatttggggtcagattccttcatggctggggagctctgcagctgtgacagatggatgagggagcaaatgctagagggaaaaaggaaagaaaaaagaatctgtcctaaactgaacctttgttcagacagttaagacttgcctcccagacaggttttatggattgctaggggtctcaatttgtgccctgatgtgtctgagtgagtgtgattttcaggcatccagacccctcctcccaggcccaccccgcacatattctgccttcacttccttgcacagtgaaacgctccattgactgcaaggcttatgaaatgaaaggctctgataatggagtgtaagcatttttgtcttcatgattgtggaaaaaaaaaagcgatgaaattactaagaaatcctcaagatggggtggggaaatgggaacaaatgattcgttgggaaaataaatgcttcagtctaaaaaaatccaagatggaataaaagatgtattcccctcccaatttatagaggagagcaattttttggtattttctcagccgaaaggaagaaaaccttaaatttcttcttttctgtctttatgagtctaaactatttttaagactttagagtacatcaggttctgatatcgtgtgcattttgtttctttaactgtagttggtattttatatggacttctgagcaaactgaattggaattctgcaaggtcaggggactgtttcgtttgtctttgctcaccacgaagcctaacacctcctgccatgcctgacattgtataggtgacaatttttaaaaaaataaatgaatgaattagcgaattaaactttcttctcagagtattttcaccaacagttttcactggcctctggttctcattactttctctttactggcattttcaggggatttcatacctgttttaattttgctttttctagttgctgtagttattgttttagttaccaaaaatgacttaaaattgtgaaatatgtgagcaggatcgggtcgtatttactgttgaaatgtatcaggcttctcccttccaatcctgctctagccacaatctgtaaggtcagtactatgccacactggtggcccttgggcctctaatttgggacactgatactgatctctgacccctgttctgctgatgtaccctatagccttgtaattgcccttgaagaaagtcctacttgctttggttacttacccttcaaggtactgaaatgtgactgtggcccagctgtcctccaggtgctcccatctgaccacatgactctccaatcctggctcccatgattcgttgctgctcagtcatgaggacatgttgacacctcatcttggtctctctatggctagcaatttctctaagctctgacatacctgggttttgggccttcttctgcaaatggatcactctctcatacagactattattctaacctcccgaattcccaggtcctggcccctttctacctatgcagtcttaatctaacaatctgctaatatgttggtgtatgtacttgaggatttttttcaatacttagacataaacataactatgcacacttattttcgataaacctgaggtcactctatgcatacttctttgtaatctgatgtttttctcttaataaaactcttaatagagttaattaatagacatccacactaattaatggacatccacatctattatagacatccatattaattaatagacatccacattaattaatagacatccacatcttcattttaactcataatcctcctggttattattattccatttcatgtttattactattacatattttaaccaatcctctggtgattaataattgagttgctacagtttttggctttatgctgtgatataaatccacatatatatattttttacattgtccaattatttcctcaagtcctagaaatagaaatttggggccaaatgttatatatattttatagcttctgatcatatattgatacaactggtctaggtttactattgtatagttccacaaattgtgttcaagtgccagattcaattctccctcataaacatttattattattattgaattagctttaatatattataaatttttgtgaataaatatacacatagtaaacttatgacttatagatattatacctgattctcgtggatattccatgctctggtgtatacgaaggtataaagaagacagcaaatgccctcttatcattacccttctttccaggagaccatcttttttttttttttttttttttttttcgagacggagcctcgctctgtcacccaggctggagtgcagtggcgcaatctcggctcactgcaagctccgcctcccgggttcacgccattctcctgcctcagcctcccgagtagctggaactacaggcgcccgccactacgcccggctaatttttttttttttttttggtatttttagtagagacggggtttcaccgtggtctcgatctcctgacctcgtgatccgccctcctcggcctcccagagtgctgggattagaggcgtgagccaccgcgcccggccttccaggagaccatctttatagctgctttcatttttgctttagttgttatagttatcctgttatttagtgtagacctccaaggtttttttctgttatcataatttcattgcttgctaatgtaatagacgaaatatggcatggtgattttgacatgatttgtgtttattataacattaatgcagttaaacatctttttgtaagtttatttaagccatttccttttcttcttttgtgacttgcctgcttcttttttactcatttttgtattggggtttatgttttttcttagtaatttttaagatctctttgaaattaaaggtgtcaggttttgtttgctttttgatattgctgtgtttattcagatacaaaatgtttttccactggaatttctgcatttggatttaggcttagaatgctcctccaacccacaccctcattcctgagtttataaaaactgcctatattaacaataacaacaacattaagaactaacatttcctaagttaacactaaccatttgccaggcccttctaagagccttgtatatgatctcctttattcatcacaaaaaccccatgaggcacatactgttataactcattttacaaaagaagaaactgaaacacaaatgtttaagtgacttagtcacatagagagtggcagaccctgcaatctaacctaggtagtctgactccagaggccacactctaaattgtgatatctgctttaaaacttgaatccatttggaattaatttggtaaaagtataagctaatgattttaactaatttttcccaaatactaagttatctcaatccatctgaataaagtaacatttcctaaactaccaatattagtgtattacccatactcatatttttagttttttgtcagtctgcacatttaagctttatatatcactaaactgctttttaatagccagatctgacatttggataatggggttttgttgttgttgttgttttactttaagttctgggatacatgtgcagaatgtgcaggtctgttacttaggtatacatgtgctgtggtggtttgctgcatctgtcaacccatcatctaggttttaagccccacatgcattaggtatttgtcctaatgctctccctccccttgcccccatcccctgacaggccctggtgtgtgatattcccctccctgtgtccatgtgttctcattgttcaactcccaattatgagtgagaacatgcagtgtttggttttctgttcctgtgttagttttctgagaatgatggcttccagcttcacccatgtccctgcaaaggacacgaactcatcttttttatggctgtgtagtattccatggtgtatatgtgccacattttctttattcagtctatcattgatgggcatttgggttggttccaagtctttgctattgtgaatattgctgcaatgaacatacgtgtgcatgtgtctatatataaagaaatgtgccacatttttttatccagtctgtcattgatgggcatttgggtggttctaagtctttgccatggtgaatagtgctgcaacaaacatatgtgtgcatgtgtctttctagtagagtgatttataatcctttgggtatatatccagtaatgggattgcaagatcaaatggtatttgtggttctaaaaccttgaggaattgccaccctgtcttccacaatggttgaactaatttacactcccatcaacagtgtaaaagcattcctatttctccacatcctctccagcatctgttgtttcctgactttttaataaccaacattctaactggcgtgagatggtatctcactgtggttttaatttgcatttctctaatgatgatgagctttttttccacatttattggcagcataaatgtcttcttttgagaagtgtctgttcgtattatttgcccactttttgatggtgttgtttgttttttttttcttgtaaatttgtttaagttccttgtagattctagatattagacctttgtcagataggtagattgcaaaaaatttctcccattctgtaggttgcctattcactctgatgatagtttctttggctgtgtaaaagctctttagtttaattatattccatttgtcagttttggcttttgttacaattgcttttggtgttttagtcatgaagtctttgcccatgcctatgtcccgaatggtattgtctacgttttcttctggggtttttatggttttgggttttacatttgtctttaatccatctaagttaatttttgtgtaaggtgtaaggaagtgatccagtttctgttttctgcatatggctagccagttctccggataatgggtttttttttaaggatatataggcttgttaacttgttaactttatttctacatacacaccacacacacacacacaaacacacacacacacacacacacacacacaaagacatcacataaattcaacacataaattttaaaaatttgcagttctttttttctctttttattctcaaattttctttattttatttttccataagtttttggggtacaggtgatatctggttacatgagtaagttgtttaacggtgatttgtgagattttggtgcactcatcacacatgcagtatacacggcaccatatttttagtcttctatcgctcaccccactcccactcttccccccaagtccccaaagtccgttgtatcattcttatgcctttacgtcctcatagcttagctcccacatatcagtgagaacatctgatgcttggctttccattcctgagttactttacttagaatgatagtctccagtctcatccaggtctctgcaaatgttaagtgatgcatctgctgataaagctcttgaaaagtatttcatagtggcattgctgaaacaagtcacttctagcagtattttcgtcttcatctgatttgtgtcatttataagatttttttaaagactgtttccttttgcccctattttgaagccagatacaacagagtatgcaatgtatagggatttaaagtagattagtggttaggactagggatgggaatagagagtgactgtaaatgggcatgaagttcctttctaaggtgatggtaatgtttcaaaattagactgtgatgatggttggaaaattcggtgagcatactaaaatttatgatattttacacctaaaataggtagattttatgggatataaattatgtctcaacaaaccaatgttttataaaagcaaccctatgctcactcaaaagaaaacacatgcacaaggaaggtgggatattgaaaagtgctgatattaaccatgaagaataagcctcaaaaatgttgtcaagttgggataaatatggagataattagaatttgagagctattcactgttgtcctcaaacagacattatcttacaataagcatgttgactatgggatctattgtgaatgaaaggaaatgttgggaatgtattgttaaaaaatatgttactaaagtcatatgtgattggggtttgaatagaatttttagttgttagagaatagaaatccctttgtaacatctaagtatgtttccagtttctgtgcatttgtattccatatttttgagatacttatgtaccaacatagtagattttactgtatactttgatagacttttgtactttgtgtttttccattgatcttcacttttctgatagcagtaggctgatattatcattaaagccgcttaataatacactttactatccagtaagataaattcctcatcttattcttataaatgttaaagagattggttgtttcattcatttgatcttgcaaataaacctttaaatcaattagaaaatatatttaaaataaatagtggtcttgctctggaatttacttatatataattttgatatgaatgaacatctttacaacatgaaatgtttccttccaggagcatagactatctccacttactctattcttttaaaataatcatctaataaaattttgtaaactttaaaaatctagattcataatttttaagattttttctatgtacattatatttttgctgccattgagagtgggatttttttatttcttaaatctcttatatatagaaaaaaagctgtctttatattgaggtatagtttacatttaataaaatgcatacatcttaagtgctcagtttaatgagttttgacatttgcgttcacacatataaccaccatctaaaacaaggccaccatctaaaacaaggtatagagcattttcatcaccctagaaagttttctcatgccctgttccagtcagtacccccaaaacagccactttctgacttctatcactgtgatttcctcttcttgcacttcatattttaatgtgtgtggaggattcttttgttcagcgtaatgcctttgatgttcatctatgctgtgagtgtatcagtagtttgttcctttttcgttgttaaataatattaccctgtatgaatatagcagaatttgtttatccatttctttgctctttaacatttgggttgtttcaaattttttgtttgttttcttgctaatatgaatacagctgctatgatgattcttgtataagtctatgtgtggacttatgtttctatttctcttgggtaaatacctaggagtagaattccttgatcataggatatatctatgtttgtaagaaacacaaatatcttttcaaagtggttgttattatattacattcctaccagcagtgatgtgagttccagttgcttcacatctctgccaacatttgatgttgtcatcttttttatttcaaccattctgatgatggcatttcgttgtggcttttctgtatgactaatgatgagcaccatattgtgtatcttcttttattaaatttatgtggggtttttttgctcatttcttttctctctctcgctctgtgtgtttgttttttgagattagatctcacatgtcacccaggctgaagtgcagtggcacaatctcagcttgctgtaacctccacatcccaggcttaagtgatcctcctatctcagcctccagagtagctggaactacagtcatgcaccacaatccttagctaattttaaaattttttatgaagatgaggtctcattacattgcccaggcaggtgatttcttaaaattcttttgtagaggggggaatctctctatgttgcccagactggtcttgaattcttggcttcaagcactccttttttccccatttttagttgtgttgtttatctttggatttgtgatttgtaggaattctttatttttatatacttattcttagccactggtctcattagtttcaatagttcttcacttggttatattggatttccagctaagcaattatatgctctttgaaaaattatatatttgcttctcttttgctgtaattttaccttttacgtgttttattattttatggcataagctggaacctcccaaactgttgagtaattgtggtgacagccgatactgatcctgaatataatgataatgttattagtgttacagtattaggttttatatttatttttattaggaatggatgctaaatattccccaatatttttctattgagatgtttgcataatttttctccttcagttcattaatatgatttattatattcctagtttactaattttgaaatatccatgcctctgggataaatcctacttggccgacgtgtattcttaatactgatagattttattcattaatacattatatagtattttaaaattatattcacataagaattgacctatagttttgtttgcatcctttgttgttattgttttgatggatatgcttccttgttttgtgcatctttgtctgatactggtttcagggttatactaaacttaatagaagagttggagcattgttattattttctcctctggaatgtattttttaatacatcagctacacgtgttattttatcattcccattcccctatttcacccttgagagatttttccctacctcacctctcctcttcctatattgttatactggcatatgtcgagctctggaggttcctaaggctccctgttttacctgctctggaaactgctcttggttcccctgctgccaagcataggctttgtctctgttccagaggccctgagttgttcagatttgtattttattttggaataagccctcatgaactaagctgcagggtgtacctagggcagcaataaacacagttctactggccctgagccatgtaataggttgaacatatgaaactccccatatcccaccagtttcaacctacaaaaatggcagtttcacataactcagaataatgcctggactccctcctccagatgtttggaagcacctggagggtgggaaagccttaaattttctctgttagagaccttggaaggagatgcctgcaattgttgtaattgggacacttcgtttgggggaaaggcttcctgatgaacatgtccaacattctttttacatttttctagattgtcctagagagttcttttattattattattatactttaagttttggggtacatgtgcagaacatgcaggtttgttacataggtatacatttgccatggtggtttcctgcacccatcaacccatcatctacattaggtatttctcccaatgctatccctccccttgctccacacccccaacaggccctggtgtgtgatgttcccctccctgtgcccatatgttctcattgttcaactcccacttatgagtgagaatatgccgtgtttggttttctgttcctttgttagtttgctgagaatgatggtttccagcttcatccctgtccctgcaaaggacatgaactcattcttttttatggatatgtgacattccatggtgtatatgtgccacattttctttattcagtctatcattatgggcatttggttgtttccaagtctttgctattgtggatagtgctgcaacaaacatacgtgtgcatgtgtctttctagtagaatgatttataatccactgggtatatacccagtaatgggatttaaagatcaaatggtatttctagttctagatccttgaggaattgccacactgtcttccacaatggttgaactaatttacattcccaccaacagagtaaaagcgttcctatttctccacatcctctccaccatctgttgcttcctgactttttaatgattgccattctaactggcacaagatggtatctcattgtggttttgattttcttttctcgaatgaccaatgatgatgcgctttttgccatatgtttcttggccacataaatgtcttcttttgagaagtgtctgttcatatccttcacccacttttcgatggggttgattgtttttttcttgtaaatttgtttaagttccttgtagattctggatattagccctttgtcagatggatagattgcaaaaattttctcccattctgtaggttgcctgttcactctgatgatagtttctttccctgtgcagaatctctttagtttaattagatttgatttgtcaagtttagcttttgttgccattgctttcggtgttttagtcatgaagtctttgcccatgcctatgtcctgaattattgcctaggtttccttttagggtttttatggttttaggtcttacgtttaagtctttaatccatcttgagttaatttttgtataaggtgtaaggaaggggtccagtctcagttttctgcatatggctagccagttttgccaacaccatttattaaatagggaatcctttccccattacttgcttttgtcagatttgtcaaagatcagatggttgtagatgtgtggtgttatttctgaggcctctgttctgttctattggtctatgtatcttttggtaccagtaccatgctgttttggttactatagccttgtgatgtagtttgaaatcaggtagcgtgatgcctccagctttgttctttttgtttaggattgtcttggctatatgggctcttttttagtgccatatgaaatttaaagtagtttttctaatcctgtgaagaaagtcaatagtagcttgatggggatggcattgaatctctaaattactttgggcagtatggccattttcatgatattgattcttcatatccatgagcatagaatgtttttccatttgtttgtgtcctctcttatttccttgagcagtggtttgtagttctccctgaagaggtccttcacatcccttgtaagttggattcctaggtattttgttctctttgtagcaattgtgaatgggagttcactcatgatttggctctgtttgtctattattggtgtatatgaatgcttgtgatttttgcacattgattttgtatcctgagactttgctgaagtttcttatcagcttaaggagttttggggctgagatgatggggtttctccactctagccacactagcctccatgctgttgctcagggttgttttccctgcctgaaccacttccccctagatattcacatggcctgctccctcacttccttcaggtctcctcttagatcttcgaggtcttccctgaccatcctgcttaaaattttatttctttctgctgggtgctgtctcccttttctaaaagtaacagttttcaccatttaatatacaatatagtttacttatttaatatgttaactgtctgagttctagaatggcaacttgcatgacaactctactatgtcacacattcttattcacctctgctttgtattcccagcacctagtataatgcatggtacatggtagatattcaacaaatatatttaataaatgaatgaaaaattttaaagtgaaaacctacctgtttctctttctctctctctccctcttctctttctctctttttctctttatctcttcctttctctctctctatctctctttctctctccctctttctttccttccttccttccttccttcctcctcccctcccctctcctctcctctcctctcctttcttcagcatgtccagattctccccaacctcctacaaagctgccttagcttgtattcccagtaaatgagagcaatgcctttgtggaaagaagagcagattcctacacaccatagactaagtcatggaatttcccaagtcatcagggctactctggtgccctagtttgtcagccaaaccatctcagcacatggaatgaccttgggctgttaccaagaagtggattccctgtagcagttggcttactctttctagaaaggcctgttagtctctaatatagcattgggtagagcaaactgcagacctctgctacatcccgggaattgaaatgggaggcttgttctaaaattctcataggaatttttaacacactctaaaaatgtccacctttgaatgaagatttagggtcagagagagcatacagggatggaaagtatcttccagactgatttttgacactggtgaactttgtgaccatgggcaagctgttcaacctctctgatgatatgtgatcattccctgcagcccaaagccattccatttaaaaaggatatcttatttgttttctttccagtgtaattatgtccacaacatagaaaatgcctctagcatgtttgtatctcctttatctagtatgtagataacaacataagagtatctttgaatgagagttgagtggtggagagaagtccctgatgtcaactgtccctgatcaacctattgttcccttcctgtagagactactgctattcatccattgatgtactgagttcatgaattatggacccactctatgccaggcactgttctaggaggtgagggtacaacccagagaattagttaacatatgtatttcagacactgtgctaaacactttacatatatcagtttatttaactagaaagagagtgagagagaattattattgtctctatttgaagcacatctgagaagtcttgattattcctaagctaccttttattggaacaaagccttttgtttccctcaagagttttaggaaattgcactggacccagagggaagtgttcttcaatgcctgtgcttggaggaaaggcagatcctcttttactaaagcatcatttgccctatttcacaagcaggattcagtcaaggtagcttctctttctttatttttttttctttttcccaccagcttcaaacgcaaaaataagttcctgctgataaaaggtgagaggcaaggccatctcttggcccttccacaagggtggaaacattgcatggaaaagggaagaatctggagacacttaattcccagtccagctcctccagtttccctcatatctccgccacacaagagaagagaatatggccacttccctctttactagccactaagagcttcttagtctatgcatgggctccccacttgggaatggtataggctctgtagtcagactgcctggttggggcatggcttcagcactaactagctatgtgagcttggacaagttaattaacctctgactctggattcttctctataaaaaggccatagcccaaggtaaaagtgccaaaaggaagaagatatagctcctgccttcagcatctcagagtggcaaatatatcaaattccatgtggtaataggaacataggcagagaattaccaaagcagagagcacaggctaggagaggccctgaagattgcacagagaggtctgggtcttcaaagatacaaaaaaaaaaaaaattaccagcagagaagtgagcaggagttattcaggaagaaacagcacacaaagaaatgaaagagaaggtttgcgatgagtcagaaggtgggtgtgggggttaagaatagtttagcctgattggagaattgagtatgttaggagaaagaactgctggaaaagtcattttttatataatatgctaaggaatttggaatttaacctaagagcacccaatatccatggaacgatttaagctaggagtgaaataatcagatctgtgtttacacagaggatgcattggaagaggtaaattgctcctgagtaatctttcagagactgaaggaaaagagttgtaatcagcacacattttacagttagaatgaacatgacttggtgacccaagtactaagctctaagagttacatggtaattgtgatggaggaacagttgatggagatggaagagggatgagggaggtgcatagtgctcctctccagggaaacatttaaaaaaaaaaaagaaaaaaaatcctatgtcctatgagtatccatggagcaagtctccacccatggtagaataaaatattgcctttttctttatgattgttcatactactgagaatgttggcttaattcacttgctgccatgcttctctttagaaggcatctttactagagaatctcatcatcccgtctcccataaactgcaggaattcttagttttgatgggaaatttcaggatgacgaagatgctgagaatgcaaggtcaattcaaaattatttccagctcatcttaatgtgttcttttcttcaaaagccgataaaacacactgtggcagtcagagctagcaaacaacactcagttctaaggatgctttgatattcccacagcttttaaataaaaaacaatttttcatctccagttacttttgggttttttcttattgagtattggtagatttgtaaaaaaatgaaaataaaaaagtcttttcagaataggttcttaacatcaaattaaatgctaaagcctttctgtagccctttaactttgaaaactgctgtctttgttttagccaaggactctccttgactagacatgctccctggggaaataggcagagttttaaaaatcatgtttgaatttcaaagtatctattaagaaagcatgttagaaaaaataagaggtttccagtaccccaaattcctgtgtcaggtgcaccaaggattgaaaggcttcacctcctttttcccatatccccttttaaagtacatgtgttcctaggatgctgaattaagcattattattcaacagccctcatcatttctggtctctcagtctccgtatcttcccctcagatacaatgcatactccaaacagattgtggttttagactgtgatagagaagaatattctaaatcttcttgtgtcttctccttgttggtcttcgttctaatcattggaatcatgaagaagtttagtttctcttctgtgtgactgacacccctccaaatttgtgctgacaggaatcttgtgtttctttaatgtttaatttaaatcttaatagttcctcattactccttatgtaatcctgaccctctctcatggtggttactcaactgtctttcatctgcttacatatctctaaaattgagattaccatccaaaaggcaggcaataacaaatgctggcaaggatgtggagaaaagggaatgcttgtgcactgttgatgggaatgtaagttagtataaccactatggagagcagtttggaggttcttcaaaaagctaaaaattgagctaccatatgatccagcagtcccactgctgggtatatacccaaaagaaagtaactcaaaatattaaagagatatctgcactcttatgtttgttgcagcactgtttataatagctaagatttggaaacaacctaagtgtctatcgagagatgaatggataaagaaaatgtggtacatatacacaatggagtactactcagccataaaaaggaatgagatcctgtcatttgcaacaacacagatggaactggggatcattatgttcagtgaattaagccaggcacagaaagacaaacatcatatgttcttatttgtgggatctaaaaatcaaaatacttgaactcatggagatagaaagtggaagggtggaaaggtgggaagggtagtgaggggctgggggagtgtggggatgggtaatgggcacaaaaaaattagaatgaataagacctactattcgatagcaccatagggtgactatagtcaataacttaatgtacatttttaaataacttaaaaagtataattggattatttgtgactcaaaggataaggggatggataccttatttgaggggatggatacctcattttccatgatgtgcttatttcacattgcattcctgtatcaaaacctctcaggcaccccataagaatatatacctactttgcacccaccaaaatttacaaaaataaaaaatatataagtagcacagcaaaaaataaaaacagaaaataaaaaaataaaattaagatattcagaaaagaattaatgtctctagtgggttatggctggtgcacatccctttctgtccagactatacctctactgatacagcctaaagcaaaatgagtttctggtagccatatcgcattttgattcaaaataagactaaaccataaagccttttattttcacatgcattaggttgcatctacttcagatgttgtatcattgactttttaggccctcagataatttatcttgatacatttatattgttaggccttattgatcttacctatctgtcagaatctttatggatcttgattctgtactccagtgtacttattatgcctagtgtgccataccgaaattctatttctccttctaaacaattgataaaattacagaactggataatacttaggttgttgaatcattcgtggcatgctttagctatggttgtcaaactagattataaattcacctcattttactatcatctggtctaaatctatccagatcatccataagggtatcaggagagagcttaccagatgttgtgtcaaggtccacatttactgtgcctacaacagctccctaatatgtgagtccaatagcctaagttaaaaaaaaggaggtgatattggtctggtatcatctgcttttaatgaatctattgggacacaatgatttttaggggttcagaaaccatactttttaatcaatcccagtagcatgcatgagatgagcactgagcttacttttccaagaaaaggactgagctctttacatttacctatatggtttccctctctgccagttagggtccttggccactgccctgtggtgaagctctgccctgtcatcctagacagtgggcccctatggagcagaaagaagccagttgcctctagtactgagaaaagcagagtacctggtaagccctcagtgagatattgttggctaagtttgtcacagaagagagtgtctgccaaatgtaccacaccttccctgactgtttgggacgtgttttgaaatgtgaaagactcaaatcccagcagtgcaaagctggacatcatgtcattcaagacaagctagagctgtctctttttttacaggaaggcacagaggttactgagattgagcaattattacacttactgtcattaaattcttctttgtgttattgttattatcaatcccatctgccactgcagctctaggatacaagcagcttcctacgtggtggatatgagataggagccttccagccactggtactccagaagcctttggaggaggggaatcccaatcatgtggggaaggaaggaactataatgtctcatcatctccacaagcagaaccaagccttttctgaagccttttgtgggcactcacctgtgtgtcagtgcatcagcccagactgggaagcccagactcagagtcatgttgcagtgtaggcatgaggatatgtaaacaagcaactgaggctcccttctatgctgtgcaactcgtgtatgacataggatcctatgatattagcttgtcatagcagccatcctgcccaatggtctcacttctccttttgccttcattgttctacagtagcgcatgtgagagagatggtggtatcttaagatagggtagcactatggaaaaggagaaaattggacaaattctagatatttttggaagtataaatgtcatgacttgcagatgtgggaagctgagagaagaggggcaatagagatatgatgactaccagatttttagctttagccactgagaggaattttttttttccaaactgagattcatcttgccttcaggcaacttaggtaggaaggctgtgagcaagggaggaaaaattagctccattttcaaaatattaatagtgagttgcttatttgatcactaaataagaaaacacttgtatatatgagtctatggtgcatggaagagatataaatgttggagtcattcacatataaatggcatgttaaaccagggaactggagaagatcagatatgatggcgatgtgaatgcttttcgttgaccgtaaggagctttgcacataatgtgatgttgttatcttgtccattcctagctgaacatatcattggccaaagaaaattattttcaaattggggctagtcctaggtaattagacctggaagcatttgagggagtaattcagaaagagaaaaggagtgggctgatcccagacccttcccatcccatggccctgtgaggctgcggagcttgccggagccccagcaccagctcagaaattgtcatcctccaggcacacttccaattcaattaatcatgttaatatctataagtaaagtgcagtcaacagttactttaacagtgaatgctaattattagtaggatccatcgcttaagaaggactttttgccaatcttgtcatgtctggggaaaatatcaggaatagagttggcatttctgagaaaataggatgatcaaactattaacgtcgtccatgttataggtggacccggcttggaccatcagtgtgattattacaggtgaagattaaggacacttgagagaaatgttacaattaagatttcctctccccttgctaaataaatggtttcttgctgttgcctctcacaatggtttttgctttagaaagaggctctgtaagtacaggatttctcagttagccagtagtactaggaaatatggtggctgggaaggagggaagggaaaccagatgtccccagagagcccggtggctcactggacatttgatccaaagaccccaggaagctgggctactgagggtgcaacacatatccaaggaccctcgaaactttccttcatttgcacatcaattcattagtgaaagaaacagggactgggccactcctaagttgcagtcactggggagaggtgggtaagtgggccttccccttgaaaagtacccagactggtggaagtgacaaatgtgtaatcaagtgtaataacagctacgtcatgttcagtatttactgcataaagacattttctcatttagcctttttatcaaccttatgctgtagatattagtttccttttccaaaggaggagaatgcgaacagaaaattgagaaactgagaaattacatagtttatttcacgttgcagaatgattaaatgaggggtcaagacttgaattcagcttcagtcccttgcactatatgtctaggctgcacgagtttttaaatacaagtgaagtcatcttttgggttagacttctaacctcaattccctgtcttcagaaatactttcagctactttgtttctttttaaatatgcttccatattttatataaaatgttagatttgacttgatttttaattttatatttctattgaattttattatggaagatgaagatttagctcttaaattcactagccacacacacacacacacacacacacacacaccctcacaccttacttccctctcccattttctcaaaatcgttatacacttgtggagataattattcatgtttgtatcattattgttatgtaaacatgatgtatagctgaaccatgtatgtctctgtggttacattcttttttcctcccaggagttggtaatttgtatctctaacctgaatcttcccctgatttccattctcttatatctaattggctactcagcatctgcatttggatgtctaataggcatctcacaattaatgtatgtgaaactgagttcttgatctctcccatagtccagtacttctccccctccacttggaaatgggtgttaatggcaattccatctctccacttgctcaggcaaaaaattctggaattgtccttgactcttctctatcacttcttccattagaaaatcctattgctttatcttcaaaatgtgatgacctctcaccacctgcactgctttctttggaacaagccatgtcacctctcaccaggttcactgaagtaaccttctaactgatggccctgatctccccagactattcttaacactgctgtgggctatcctgtaatagtgctacttgagctgtgttgtgctacttttctacttcaatctttgtaatgaattccattcccactcagagcacaagcaaaaatcctttcatagtttacatgatctgatccaccacagcctctctgacctcatcattttcaatctctttgtttctcactatactccagctacacctgccttgcccttcctcaaatgcagaaggctactctctcacctcagggcatctgtgcttgctcctctgtttggaattttccccaattaactgcatggcttgcttccttacctcatttctccaggtccttattcaaaagtcactctctcataatgcctttcctgacctccctatttaatatattatttaactccccactacttaactccctttcctgcttatttcttcccattgcattacatatgtgtattatatgtatacttctgtatatgtgtgtatatgtgtgcatgtgtgtataatttattttgctcattgtctgtcttcacacacaagaaatataagctccatgagagtaaataatttttgcctgtttggttcactgacagattcccagaacccagagtaccaggtactctggtacaaataattgctttctgtaaatgtttgttgaatgaagaatagaggaatgaactatattgtttttgtttgctctgtgtgtgtgtgtgtgtgtgtgtgtgtgtgcgtgtgtgtccatgcagctaattcatcccaaactctgtcagacatttaagtctcttagtgaatacatcaggtttcatttctttctatagaggacaacattttaggacaaagagcatgcctggcagtggtgtaggaaggcaaatgaaaagaatcagattgaaaaactgcctgctgggtactatgcctattacctgggtgacaagataatctgtataccaaatccccatgatacacaatttacctatataacaaacctgcacatgtacccctgaaccttaaaaaaagtttaaaaaaatcaatacataaagcaaatatctatatgcatgagtcagtttctgggctctctgtgcagctccactggtttatttaccctgcacaaatgctacactagtccagtccatcctggacactagttcagttgcattctcataagttttcctatccaggagagcaaatgtttctactttgctttttatcaaaagaattttggttattcttggcactttgcatgtccaagtaaaaattagaatcagtctgtcaagttggaatctgaccgtaattatatttagcctgtagataagtctgggaaatatcttcacaatattgagtcttccaactcataaacatggagtattgctctatttatttagactttccttaactttgctcaataatatttttatctttttctgcagaaaactattggactttttggtaagtgtattacaaggtatttcatatttttaaggcaggtgtgaggttttttctatttttatttgtttaacctgttttttttctggtatataaaaaagcaatttaaaccctggaagaaaacctaggcaatgccattcagtacataggcatgggcagggacttcatgtctaaaacaccaaaagaaatggcaacaaaagccaaaattgacaaataggatctaattaaactaaagagcttctgcacagcaaaagaaactaccatcagagtgaacagtcaacctacagaatgggagaaaatttttgcaatctactcatctgacaaagggctaatatccagaatctacaatgaactcgaacaaatttacaagaaaaaaaaaaacaaccccatcaaaaagtgggtgaaggatatgaacagacacttctcaaaagaagacatttatgcagccaaaagacacatgaaaatatgctcatcatcactggccatcacagaaatgcaaatcaaaaccactatgagataccagctcacaccagttagaatggcgatcattaaaatgtcaggaaacaacaggtgctggagaggatgtggagaaataggaacacttttacactgttggtgggactgtaaactagttcaaccattgtggaagtcagtgtggcgattccttagggatcttgaactagaaataccatttgacccagcaatcccattactgggtatatacccaaaggattataaatcatgctgctgtaaagacacatgtacacgtatgtttattgcggcactattcacaatagcaaagacttggaaccaatccacatgtccaacaatgatagactggattaagaaaatgtggcacatatacaccatggaatactatgcagccataaaaaatgatgagttcatgtcctttgtagggacatggatgaagctgtaaaccatcattctcagcaaactatcgcaaggacaaaaaaccaaacactgcgtgttctcactcataggttggaattgaacaatgagaacacatggacacaagaaggggaacatcacacaccagggcctgttgtggggtgtggtggggggatagaagcggggagggatagcattaggagatatacctaatgttaaatgacgagttaatgggtgcagcataccaacatggtacaagtatgcatatgtaactaacctgcccattgtgcacatgtaccctaaaacttaaagtataataaaaaaaaagaactatgaggaataaccctaaacaaaaataataaaataaaatgtgcttcttgaaaataaaataaaaaaggcaatttatttttgtttcctgagcttgtatccactctattaatcatcatcagtaaacatgcttataaattttaataatttatctgtagttgtcggaatttattttgcatatcatgtcgtctaacgataatgacagaatgaattctttgtgccaaaactttgtaccttttccttctttttcattccttatttcactaagacctcaaatacaatgttcaatagaagagatgatgtaccttattcctaacattaattaaaaagctttcaacatttcactattaaatacaccattgctgtagtcttgtttttagatgctctctttaagaaaattccctttccatatctggtttggatgcctgatttcatcacattttctacattcatttagatcaactataagttatctctttattctcttatgggcagttaagttgtttaaatttcatatgtttaatcaaccatgtaaacgtgaaaacatgtatgtttgtaattcattgtatttttctggattcagttttacattttgtctaatttattaaaatctcaagtcataactgagattgaactgtaattttgcctttcttgtaatggccttttcagcttttagtacccaaaatattatgtctaaaaactatgaattggggaatattccctccttgtgtatttttggaaatatttgcacatattgcgtttacttcttccctaaatgtttaatagaattcaccagtgaacccaactgcacctgaaattttctttatggtaaggtttttaattacggattcagtttacttaatgagacatagacattcagagtcagtatttctcatatctagtttatgagttttgtgttttaaagaactagtccatttaatccaaattttaaaatctatgggtataaagttgtttgtaaaattcttttatctttcaatgcctttaggatgtgaagtggtgttgtattttcaaccatgacatggttattcgtgcctttttttctctcctgcccctttcctttttctgtcttgaaagagggctatttttatttgcctttcaaaagctaacttttggctcgttaatcttccctaaatatacttattttctattcattattttctgttcttgtatttatttccttcattctacttaatttgttgttatgttctagttctttagataaatgatttgatcactgataattggccttattttgggctattttatgcatttaaagctaaaatatttctcaatataattttttagcattttaaatgttttgaaatttattatttttattatcatagagtccaatgtatatctgtttttcatcctgttatttattttgacccatgttttatttagaaatattttcaaatgtatggaaacattctagttatcttttcattatagatttcgagtttaattgcgttatgatcattcctcatctgatctaacatctttgccagccctactgttaactaacctccttccagaatgtttttcatgacatcagctttggtctccgggtgaaaatgtgtggtggttgggttcacaagcatatggaccacaaccacatctccccttcccagtccaggaaaatatgtgtgaaaaggaaattgaagtgaggacattgtgtggttgtttaataaagggttaagtcactaggcttggtgtgcttgaacctgcacattctaaagaaagtaccagctctttactggttcctgagagataatttctaaacccttagaatattctgcctaagagttctttatatgacagaacttgggccaatacagaaaactgtaactctgaatataacagcatttctgggtcctgtgagtccttctagtgaattattgaacctgaggatggtactggggacccctgacacaatggtactaaaaaaatattgaggagactggggtatcaaaagtgtattaatttcttgcccaccttgtgtgaccttctgtaaagccaatatttaataagtttgctgatataaatatacaagtagtattaaagaataattcacgaggacttccagttaaatccatcaggtgaaaaacataagatgctacccccattatctcttgagaactcccccataaaatgagagtagatgaactacaaaaggaataagcaatagaagactttttgctttaaccattcagttataaatgcaattaatttatattgtaggacattatgaatgtcctacaatcttaggcaaaccaacatcacaaaagacaaggtacaaaataaaaatatatatcaactcatcactgaataaaaagagactaaagcgagaagaaagtattctaattaacatctatcactaaggaccaagcgagatcagtgaaaacaagttatccagataacttttggagaaatttcagaaggcataagtacaaagtaaaagtatgaaaagacaatcttaaaacctgcttgggaggaaaaaaaaacctacataagaatggcatcaaacatttcaactgaaacatgaaatacaagaagactttgtgatgtaaaatgattctgaaatacaataattttaacctaaactctatgcccagccaactttctgttaagaattagagcacaataaatactaatttttattatactttaagttctaggatacatgtgcacaacgtgcaggtttgttacacaggtatacgtgtgccatgtgggtttgccgcacccatcaactcgtcatttacattaggtatttctcctactgctatccctcccccagctccccacctcccaacaggccccagtgtgtgatgttccccaccctgtatccatgtgttctcattgttcaactcccacttatgagtgagaacatgcggtgtttggttttctgtccttgcaatagtggtggtttccagcttcatccatgtccctgaaaaggacatgaactcatccttttttacagctgcatagtattccactgtgtataaatattattttaactacctgtgaaactcactggaattttttagaagcccttaatgacatactcaagcaaaatgagccatgtgtcatggttttcattttggaaggatagatgatggttttaagaaacggtagcagttacagaaatgagaacattttaaacatggtttaaatgtttattaataatttggctgtgaaacataatggaatagtaagaaaccatatgtaaaataaagaagcataataaattctagaggaagatttggaaataaagttaacaagcttcatttaattgacaaatagaaatttgtcccctatgaataaagcatacattgtttccaagtgcatttgagcacaaataatagaatagaatggaatttaaaagtggttgaaaccatcagggcatattctctgaactcaaggcaataaagctacaagacaaagatatagtcctttgcaaaaatccatcttctcaaaaattttttaatttccgtttttagtttggatatcgggggtacatgtgcaggtttgttacgagggtgtgttgtctgatgctgaggtttgggcttctattggtcctgtcatggagatagtgcacatagtgtccaataggaagcttttcggcccttgcacccctcccttcctccctccgtttggagtccgtagtatctcttgtccccatgtctatgtccatgtgcacccaaaatttagccaccacttataagtgagaatacataatattggttttctgtttctgcattaattcagttagaataatgacctccaacggcatttgtgtttctgtaaggacatgattttgttctattccatgatgtatatgtaccatattttctttatcctgtccaccactgatgggcacctaggttgattccatgtctttattattgtgaagtgttgcagtgaacatacaagtgcacccctctttttggtagaatgatgtattttcctttgggtatatacccataagtgagattgccaggtcagatggtagttctatttttagttctttgagaaatcatcaaactgctttctacactggctgaactaatttagattgcaaccaacagtgtataagcattcccttttctctgcagccttaccaacatctgctattttttgactttttaataaaagtaattctgattagtgtgagagagtatctcattgtggttttcatttgcattgtggttttcattgagcatttttaattatgtttattgaatgcttatatgtcttattttgagaagtatctgttcataggccaggcatggtggtgcatgcctgtaatcccagcactttcgaaggccaaggtagtcaggtgacttgagcccaggagtttgagaccagcatggacaacatggtaaaaccccatctctaaaaaaaaaaaaaaaaaaaaaaaaaaaaaacctagctaggcgtggtggcatacgcctgtagtcccagctactcgggaacctgaggtgggaggatcacttgagcccaggaggtcgaggctgcagtgagctatgattatgccattgaactccagcctgggtgacagagtgagactctgtctcaaaaaataataatgtctgttcatgtcctttgtccactttctaatgaggtttttttttcttgttgatttgcttaatttccttatagattctgtatattagtccttaatttagatgcataatttctgaatattttctctcattctgtatgttatttactgatagtttcttttgctgtacagaagctgtttattttaatttggttctacttgtcaatttttgcttttcttgcaattgcttttgaggacttagtcatacattatttgcttaggctgatatccacaatggtatttcctaagttttcttctaagatttttatagtttgaggccttacattaaatctttaatatattttgagttaatttttgtatattatgatagataggggtccactttttttcttctgcatatggttgtcaagttattctgacagcatttattcaataaggaatctttttgccattgcttatttttgtcagtattgtagatcagttggttgtagctgtgtggctttatttactggttctctaatctgttgcaatggtctgtatgtctattgttctaccagtaccatattcttttggttactgtagctttgtagtatagtttaaagtaaagtgatgcctctggctttgctctttgcttaggattgcttttgctattcaggctgttttttttattttttgtttcatatgaattttagaatagctttttctaattctgtgaaaaatgacattgctagtttgataagaagagcactgaatctatagattgctttgggccatatggacattttaacaatagtgattcctccaatccatgagcatggaatattttttcatttgtactgcctatgatttctttcagtagttttttgtagttcttcttgcagagatttttcatttccttcattagatgtatccctaggtattttttgtgtgtgtgtgtattacaaatgggattacattattgattccatgctcagcttgaacattattgttgtacagaaatgctactaacttaaatatgttgattttttatcctgaaactttactgaagttgtttatcaggtctaggagactttggtggagacttaagggttttctaggtatagaatcatactgtcagcaaagagagataatttgacttcctcttttcctatttagatgtcttttatttatttctcttgtctgatcactctggctagaacttccagtattatgctgaatagaagtggtgagagtaggcatccttatcttgttccagttcttaaggggaatgctaccagcttttgttcattcagtattatgttggctgtggatttgtcatagatggctctttctattttgaggtatgttccttcaatgcctagtttgttgaggtttttttttttttttatcatgaagtaatgttgaattttatctaaagctttctctgtgtatattgagatgatctttttttttaataattctgcttatatggccaatcacatttattcatttgcatatgttgagccaaccttattctgtgtaataaagcctacttgatcatagtgaattaacattttgatgtgctgctgaattaagtttgctggtattttgttgaggatttttgttctatgttcattagggatattgacctgtaattttcttttttgttgttttgtctttgccagattttggtgtcaggatgatactggttttctagaatgagcctccttctcaatttttggaatagtttctgaaggactgcctccagctcttctttctatgcctgatataattcagctgtgaatccatcttgtccagagctttttctcactgataggtttttttttattactgattcaatttctgagctcattactgatctgttcaggttttcaatttcttcctgattcagtcttgggaggttgtgtgtttccaggaatttatccatttcctctagattatctagtttgtgtgcatagagttgttcataataatctctgatgatcttttgtattcctgtgggattggttgtaatgtcaccattgtcatttctttttctttttttttttttaatatactttaagttttagggtacatgtgcacaacgtgcaggcttgttacatatgtatagatgtgccatgtttgtgtgctgcacccattaactcatcatttaacattaggtatatctcctaatgctatccctccccccttcccccaccccacaacaggccccagtgtgtgatgttccccttcctgtgtccatgtgttctcattgttcaattcccacctatgagtgagaacatgtggtatttggttttttgtccttgtgatagtttgctgagaatgatggtttccagcttcatccatgtccctacaaaggacatgaactcatcattttttataggtgcatagtattccatggtgtatatgtgccacattttcttaatctagtctatcattgttggacatttgggttggttccaagtctttgctattgtgaatagtgccgtgataaacatacgtgtgcatgtgtctttatagcagcatgttttgtaatcctttgggtatatacccagtaatgggatggctgggtcaaatggtatttctagttctagatccctgaggaatagccacactgacttgattgtgcttgtttagatccctctttttctttgttaatctagctagtagtcgattaatcttgtttatcctttcagagaacaaacttttcatttcattgatcatctgtatgttttttggcagtctcaagttttttttagttctgctatgattttagccatttcttttcctctgccagctctgggattagtttgttcttgtttttctaattcctttaggtacaagtcagattattaatttgagatttttctatcttcttgatgtaggtgtatatccctgtaaactttactcttaacactgcttttgctctcagagatttgggtatgttgtttctccgttttcatttgtttcaaagaattttcaaatttctgccctaatttcaatgtttacccaaaagacattcaggagcaagttgtttaatttacatgtaaaatatgtggttttgagagttcttctgggcatttctattttttttttaatttttatttccataggttttgggggaacaggtggtatttggttacatcagtaggttctttagtggtgatttgtgagattttggtgtacccatcacccgagcggtatatactgaacccaatttgcagtctcttatccctcacccacctcccactattttccccattttattccactgtggtctgaaaaaatgcttagtatgattcagttttttgggatttattgagacttgccttatggccaaacatgtggtcaatttcagattatgttctgtgtgcagatgagaagaatgtacattctatgattgttgaggggagtattcttaaaatgtctgttaggtccaatctgtcaagtgtctaatttaaatctataatttgtttgttagttttctacaaagagagaatctgtctaatgcttcttggtgggatgttgaagtttcccactattattgtgtgactgtctaagtcttttcctgggtctataagtacttgtttatgaatcccaatgtgggatacatttagattcaggatagttaagtcttcttgttgaattgaaccctttatcattatgtaatgactttctttgtccgtttttattattgttggtttaatgtatgttttacctgatggaagaatagctacccctgttcttttttgcttcctgtttgcgtaatagatttttctccatccatttactttgagcctataagtgtcattgcatgtaagatgggtctcttgaagacagcaaaaagtggcttttgttttttttattcatcctgtcactctatgtcatttaagtgtttagaccatttacattcatggttaatattgatatgtgaggttttgtttctgttatgatgttgttagcaggtttctttgtagtctgattgcatagttgctttatagagtctttggcttatgtacttatatgtgtttttgtggtaacagattttgttctttcatttctatgtttggaactttcttaagcatctcttataaggctagtctagtggtaacaaattcccttagtgattgcttgtcctcagaactattttagtccctttattagtatttagtttacatataataaaattaaccaattttaagcatataagttttgtcccatacttataatcatgtaaacattgtcatgatcacaacatagactatttctatcttcaaagattatgccctctgcaatcaatcttttcctcctactcctggtctcctgcatccgccaatcactttatctcgctgtatttttgcttttcctagaatttgatgtaagtatcatatagtgatacgagtgatgtatgatgtgtatgatgtgagtatcatatagtacattgtcttttgtgtctggcttctttcattcaacatagtgcttttgagatttatacatgttgtttcttgtatcagtagcttgttccatttggttgctggttaatatgccattgtatgaatataccacactttgtttattcattccccagttgatagacatctaggcttcttttcagtttgggtcagaacaatgacgtacaagtctttgcatgactccatgatgttatttcacttgggtaaataactaagtgtgggattactgggtcatttgacaagagaatgtgtaattgtaagggaaactgccacatttgcctttcaaacagcagcttatgagatggtcagttcctccacatcctacacaacaattcatattgtcactctttcattttagttagactaaataattagactagtggttgtgtagcaatatctcactatggttccatttaattttgataaagtaagtagatttagatcttttgcccatatttttgtcagattgtctgaaatatatgacttctatatatttatacatacagtcttttattggctttatattttacaaatatcattcagcatgtggcctgcccttccccttttccacaatatgttttgaagagcaaaagttttttactttaatgaagtacagtttatccatttttttgtatttggctttgggctttttgtgtccatctaaggatttgttgtctaatccaaatcgtggacattttctcctatgttttcttgtagaagattcatagttttactttttacatttagatctattgtccatttccattaaaatccttcatacaaagtgaacaaaacatcatggttctttttttgtttctttgtttgcaaatagatatccaattattcagcaccatttgttaaaaagagtatcctttattaaattatgcagcacccttctagaaaaatcatgaacatttaatgagggtctgttgaccatataaatgagggtttaggtatagcctcttcattttgttccattgagtgctatgtctgtccttttgccagtacctcactattttgattaatgtagttttattctaaatctcataatccagtagtgttaagtcttcccattttttgctttttcaaaataagtttgaatgttctaggttctttgcattttcatattaattttagaatcagtatttcaacatctatgaaatatatattgggattttgattggaatggcactaaatttatagatcaatgggaatgaattgatatcttagctatgttgagtatcccaatccatgagcatggaaactcttcatatatttatatcttatctaatttctctcatcaatgttggtagttttcagcatataggtcttgcacataatttgttaaatgcacccctaactatacatgtaaatgcattgttaaattttactcctcaattatttcattgctaatatataaaaatcatattgcttttgtactggctttgttgactttgctaaacttatttgttttagtagcattatttatatttctaaggattttctgcataagtaagcattgcattggaagttaagatgattttgcttctttttaatgtatatgtcttttatttctatcttatttcattgactgaaacttccagtacaatattgaacagaagagatgagagcagacatcctcccaatgctcctctagggagaaattttcagtctttcttcatgagtataatgttagccgtagctttttacagatccccatcctaagagaaggaagtctccttctattccaagtttgctggagcttctatcctgaataaatattgacttttatcaaatgatcattttgcctctattcatgttttttttagtctatgatttggtgatttaccttgattatgatgttcaaatgttaagccaaccttacattcccagaataaatcttactttttcagaatacatgtcctttttaacatttatatgagtttagtttgctaaaatgttactaaggttaattatatctgtgtccatgaggatactgatctacagttttcttttctttttttttttttttgagacagagtctcaccctgtcgcccaggctggagtgcagtggcatgatctcggctcactgcaaactccacctcccaggttcacgccattctcctgcctcagcctccccagtagctgggactacaggcacctgccaccacgcccagctaatttttttgtatttttagtagagatggggtttcaccatgttagccaggacagtctcgattacagttttcttatagtgttttgtctagttttagcatcagtatattactattctcgtgtacgggttaagcatccctattccaaaactatgaaatctgcaaggcttcaaaattgaaaacatgttgagtgccaacaaatggaaaattccacacctgacctcatgtgacagcttgtagtcaaaacatacagcacacaattttcagccttcccaaggataaaaggaccccccagccctgtttagctgtgatgtgtcttctccatggacactcatgcaattatttccacaaaggacaatacagtatcatgtgtgcaggctagacacaccaaacagcaggttctcccatgatgctccatatagggccaagacatatgttttactcattgtggttttttgcttattctctgcaatgtggtataaaaatattatggaaaatgtcaaaaaggcctgcagacacccctatggtaacagtgataagaataagaggaagcatttatgtttgtctgttgcacagaaattcaagttatttggagaaactggatgatcatataagtatgaaatgccttacagaagagtatggtgttggaatgaacaccatatatgacctgaagaaacagaaggataaactgctgaagttctgtgctgaaaatgatgagcagaagttaatttaaaaaattgaaaaacactgaaccaaactaaaaatggagatctcaatcatgtattgaaagagtgcatccatcagcattaccgtgaacacatgccacttaatggtatgctgattattaaacaagcaaagatctatcatgattcaatgaaaattgaggggaattatgaatatttattaggctacttgcagaaacttaagaaaatacacagcactgaattttaaaagatttttggtaataaagcatatgctgaccatgaggcagcagagaaatttattgacaagtttgccaaagtttccactgatgaaaatctgacactggaagtccataaagttgttgacacatcactgttttggtgttattgccccagcaagacactgactacagctgatgagacatcctctataggaacaaaggatgccaagtgcagaattgttgcattgggatgtgctaatgcataagacacacataaatgtaaacttgccgtcacaggcaaaagcttgcatcctcactgttttcaaggagtgattttcttaccagtccattattatgctaacaaaaaatgcatggatcatcagggacatcttttttctgattgatttcacaaacattttataccagtagcttttgcccacggcagggaagctggactggatgatgactgcaagattttgttatttcttgacagctgttctgctcatcctccagctgaaattttcatcaaaaataatgtttatgccacgtacttaccccaaatgtgacttactgagttcagccatgtggtcagggtatgcttagatcagtgaagagtaaatataaaaacactttcttgcacagcatgctagcagcagtgagcagaggcatggatgtggagtgttttcaaaagaagtttagcatgaatgatgccatatatgctgttgccagtgcttggaacacagcaactaaatacacagttatacaggcctgacacaacttctgtcctgtaactatgtccactcatcatgatgaaaaaagtgatcactttgaagtattccatatgtcaagtgagggaagaaaatgcctgaccttacatatgcaaaaaatataccttcagagtctgtcagtcagctggaagaagtagatattaagaagtttctaaaatcagtaattaaactccagttgttccttcattaaccaaacaatggtgaaatagtcaaacagttctgaaacaaggtgattgtaataataatgacattgaagataatattggtaatacttcagaaaaagtgcccatagatgacatcatgaaaatgtgtgataggtttattgaagcactcactagagcagcatgcatttataagacaactagaaattatgtcagtttataaaatcaaagagagacttctaagacaaaaatcagtgtcaaagcagataactctggagaagatatttttaaaagccattctagcagaatgcctcctcatcccgagagaagccacctcctagtccctcaactgcttctgatgttccttctcacctaaataaaaaacagtgtacagtaaccttttaatcaaaacatgtgtataatatgtaatatatataataatgtaggtggagactgaaagcctgctgctatctgttgtttaacagctgatacaggtattctggtgatgctagtgtgctatttggttaccctgaatacattattttttcactgtattaatggcatgtcattattttactattatttatttgtgaataaatatgagaaagtgattatcagtaacgtaaatttatagtcaagaatgatggtgatgccaaaccaccacagattttccacaggaatatctgaggtaatgacatctttgctttctcatggttcaatgtacacaaactgttttacacacaaaattactaaacaacttttttttgtaaaattaccttcagtctatgcgtgtaagatatatctgaaatataaatgaatttcaggcttaggcattatcctgtccccaagacatttcattatattttgtatatatataatacatatatatcatatataatgcaaatatatatatgcaaatatttcaaaatccaaaaatacctgaaatctgaagcacttctggttccaagcattttggataaggaatattcaacctgtaattagttgggaagtgttctcacctcttttgttttctggaaaagctgtgtagaactgatattttttccttaacgatctggagtattctttgttggaaggtttttagcaatgactttaatttctttagtagatataagactactcaagctatctattttttctttagtgtggtgtgattgtttttatcttttaagtaatttttttattttatataaggtgtcaaatttcttgtcataaaattattcataaaatttccttattattttaatgtctatggtatctatacagatttacagacttccatttttatgttgataattaatattttctcattttcttttctgatccagtgtcactaggatgttgtttttattgatttttctctagttcttttatgttttattggttttgccctttatttattatttctttccttatatctcctttttgtttcattttctcttgtttttcatgttccttaagttgaaacttaaatcattattttgaaatgatacttttttttgaacataagcatttaccgctatagatttcctcataagcactactttgtttgtgtcctacagattttgatatttgtgtttttatttccagttcattctaaaataattttaatatccctgttatttttctttaatttgtggataatttggaaagatattatttaatttctaaatatctggagattttccagatgtctatgagtaaattttaatttcatttcattcttgacaaaaaatatacttcattataatgttagtcttcttgagtttaagggccaagaatatggtttatcttggtggatgttcagtatacacttgaaaagaatgtgcattttgctgttgtaggatggagtattgatgggtggagtgaatatcagttaggtcatgttgattgataacattgttcacgtcttttatattcttacttcttctcttttcgtatgttcagtcaattactactaatagagcagtgtttaaatctctaactctacttgtggatttgactgtttctactcttgattatatcagatttgtttagtgtattttgaaagtctgttattagatgcatacacatttataattgttatgtctgtttgatgatttgaggaccctttatcaatgaaatgtctgtttcctccatggaaatgttccttagtctggaatcttctttgagattaatacagtcacttcagctttcttttgactagtatttacatggcctaatttgttttttatcctttaaaaatctttttttgtgttgatattttaagtaggttttttgtagacagcatatagttgagtcatgctttgttatccaatctgaccatttctcttctttcaactgaagttattaagtatacacattgaatgtaattgtcaatgtttaaatctgccttttctaattctaattgtttcatccatacttttgttcttatttttctcttggattgagcacttttattattccattttatctgtaataatggcagactatatatactgattagctttttagtggctattttagtatttgaaattatacctctttatcttatctaatcttaattatttcctttcttctgcttactttaatttgttcttatttttctggatttttagaacagaagctgaggttattgacatgaaatttttgtccttgtcaaatagatatttagtgctgtaaatttccctgtaaatactgctttggctgcattccacaaattttaatatgtgtgttttcattttaattcaggtcaaaatactttctagttttcctttggatttcttctttgacctatggattatttagaaatgtgttgaggccaggcacagtggctcatgcctgtaatcccagcactttgggaggctgaggtattgagctcaggagttcaagaccagcctggccaatatagcaagactccatctctacaaaaaaatttaaaaatatatccaggcatggtgacatgtgcctgtagtcacagctactcgtaaggttaaggtgggaggatctcttgagcctaggagattgaggctgcagtgagctgtgattgtgctactgcactccagtctgggcaacaaagcaagaccttgtctcaaaataaataaacagagagagagagagagacacacacatgtattagtttccaaatacactgatattttttagattccttttcattatttatttctaatttatttccattgtggtaagaaaatatactttgtatgattgaaattctcaaatttaaatgaaacctgttttataattcaaatataatctgtcctgtatagtgttcttggtgcacctaaaaaaaaaagaatgtatattctattactgtttggtaaacggctctttataaaatgccattagttaggccaagtgagctgatagtgttatttaggtattcaaatctctgactataattagggatgtgtctgtatatttatcctcacagttcttttagtttttgcttcatgtattttgagagtgtgctgtgaggtgtgtaaacatttagaatttttatacatttttaatgagttgaggcctttatcataatgtaatagctctatttgtccctggtaatatttattgctttgacatataatttgtctgatattaatttagccactccagatatatttttattagtattagtatggcatttatttttattagtgttaattatttttattagttaattcttttactttttatctatttgtatctgtacatttaaggtagatttcttgaaggcagcatataattgagtcttgccatttattgaatcaggcaattgttgcctttatttagaggttcagaccattcacatttaagtaattattgggatagtttagtttaaatttactaccttactatctgatttctatttctatcaaaatttgtctcttctaatctttttctcttttccttttcgctgccttttttggattaactgaatatttttaatcattgatttcgtctccttttttggtttattagctataactccttgttttattttagccaattctttcaggtttagagtatatatctttaacttatactggctaacttgaagtgatattatgccatttatactatatatagtataagaaacttacaacagtttcaacaattctagctggggttatttgggttaataaaataaacatttatgcatctcaatatcgatttttcaaccccagagaggactctaagtggtcctgtttggattatgtgcatatccctaaacaaacaacagtggacaagggcatgaatgctttggtcaacctgaattcccgcagaaatttctgaaggaaattcataaaggtgggaaggagttcaccaaacaacctaagaaaaggaatgcaaaagtgcacggattagacaaaaactacagtgatcaaaggccactacaaccatacagatcacagaaagagtttatagatcgacagatagagaattcacatcagcttgctataaattcccaatatatctttctaacaataccatatttagccacacaaagcaggggtaaatgaagctttctttgtatggtgtttttcttccccttgtgctttccagggtacccagctgtcagtaacacttcttcacatctgatacctgtcaaggttaaaaaaaaaaaaaaaaaagccaaatactctgccaccctttatatttgacttttattatcattccagaaaacttttagtaagaatctaagcatttctgtgtaaatcagagttcctcaaccttagcactattgaccttttggactagataattttttgtattgagtggcttccctctgcatcatccctgagctctacccactagatatcagtaacacaccctcctccacagttgtgacgagcaaaaattcctccagatagtgtcaaatgtctcgttggggagcaaaattactcccggttgagaaccactgattgaagggaatgtttacaaacatcaagagctacagcttcttgacaacaaatcagcatcagctcatggggagaaagcagaattagcatcagatgccaatgaactcttgttccatatcccagcaagcccatatctcctcaaaacatagtgtctgttgtttaccactgatgatttagctcccagcatctggaaaaaacaatgctcaaataccacaaccacaacaaatgctaaaagaataggtgaatggatgaataaattaatggatggatgaatgagtgaaaatttaaaaatctggatgattattcacactgttgctcttgggaaatgaatgacataggctagtatatgtatgagaaaatgggatattttactattttacttgaaaatttctatattggaattttgtcattttaattttataatttagaaaactttaaaggatttattttacaagcacttgaaaataaaatcaagcattttctccttgagaacttttttaaaaatttgcttgttttcattagaagagtcaactaatatttattgagcatcttttattgttgaactaggggctgttctaggcagctgggatgcaacaagacagagaaagtttctgttcttatagagcttacattcctttttttgatacaaaatattatagatatatatggggtacatatgaatatttattacatgcatagaatgtgtcttcgtcaagtcagagtttttggaggatccattatcttgagtatttatcattcctatgtgttggtaacatttcaagtcctctcttctagctactttgtaatataaaatatattgttgctactatagtcactctactctgctatcaaatattggagcctattcttctatcaaactgtatgtttatatctactaaccaacttccctatatcccacctgccacccacacacccttcctaccctctggtatctactattctagtctctatctccatgagattaacttgtttagctcccacatatgagtgagaacatgtatctgtctttctgtgcctgacttatttcacttaacgtaatgacctccatttccattcctgttgctgcaaatgacatgatttcattcttttttatggctgaataatgttcaattgcgcatatatatatatatatatatatatatatatatagcacattttctttattaatttgtccgtcgatggacacttagattgattccatgtctttgctgttaagaatgcccctgaagtaaacatgcaagtgcaggtatccctctgatacacggatttcctttcctttggttaaatacctggtagtggcattgctggatcatatggtagttctatttttagtttttggagaagactccatgttgttttccatagtggttgtactaatttacattcacaccaacagtatataagaattcccttttctccacattgttgctagcatgttattttttgtctttttaataatagccattctaactgggataagatgatatctcaatgtggttttattttgcatttccctaattactagtgatgctgagcattttttcataaacttcttggccatttgtatgtatgtcttttcttgataaatatctattcatgtcttttgcccacttttaatgatattatttgggtttttaaaaattttttagttgtttgagttccttttatatcctgcatactagtccctcataggatgagtagtttgcaagtattttctcattcaacacattttctcctcactctgttgattgtttcctttgctgtgcatgagcttttaaatttaataaatttaatataatcccatttgtttattttttgttttattgtctgctcttcaggcaggccttagccatgaaatatttgcccagaatgatgtcttgaaatgttttctccatttttttagtagttttacagtctcaggtcttatgtttaagtctataatttttttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttaagtctataatttatcttctgtttatttttgtacatgagaagccataggtatccagtttcctttttctgtatgtggatctccaattttcccagcaccatttattgaagaatgtattctttctccttggtgccttcatcaaaaatcagttggctgtaaatacatggattcatttctgtactatctatcctgttccatttgcctataaggctgtttttataccaatactatgttgttttggttactgtagccttttggtacattttgaagtcaggtagtgtgatgcctccagcattgtcgtttttgttcagaattgctttggctattcaggctctcttttggtattatacacattgtaggattgttttattaattctgtgaaaaattacattggttttttgatagagattgcattaagtctatagttgctttaggtagtatgattttgtttttttgtttgtttgtttgagatggagtctcgctctgttgcccaggctggagtgcaatggcatgatctctgcttaccgcaacctccacctcccgggttcaagcaattctcctgcctcagcctcctgagtagctgggattacaagcatgtgccaccatgcccggctaattttgtatttttagtagagatggggtttctctatgttggtcaggctggtttccaactcctgacctcaggtgatccactcgcctcagcctcccaaagtgctgggattacaggcgtgagccaccatgcccagccagtagtatggtcattttaacattattaattcttctgatccatgagcatgggatgtctttccatttgttttgtcctcttcaatttcttcattagtgttttgtagtttttcttatagagatctttcaacgccttagttaaatttgttcttaggtattttttgtagctattgtaaattggattaccttcttgatttctttcttggctagttcattatcagtatatagaaatgctactgatttttgtatgttgatttgcattctgaaactttactaaatttatcaaatctaagagttttttggtggagtctaggtttttccataagatcatatcatcagcaaagaaatggttgacttcctcttttccaatttggatgccttttattttattatttcattttttttaatttgttttcctcagagatccttgttctgaatgatgccttttatttctttgtcttgcatgattgctctggctaagatttccagtaccatgttgaataagagtggtgaaagtgggtatttgtgttgagttacagatctgagaagaaaggctttcatcttttcagtagtagtgttcatactaacattcagtatgatgttatctgtgggtttgtcatagatgacctttattattttgagacatgttccttctgcacttggtttattgagagtttttatcatgaagggatggtgtattttatcaaatgctttttctgcatctattgagatgatcatatgatttttgtccttgattttgtttatgtgatgtatcacatttattgatttgcatatgttgagccatcagtgcatccctggtataaatcccatttggtcatggtatattatctttttgatgtgtgttggatttgacttgctagtagtttgttgaggatttatgtagttttcttttttgttgtgtccttgtcaggttttgtcactgggataatgttggtctcatataatgacttgaggagaggtctttccactttcgttttctgaaatggttttaggaggatttgtattagttcttctttatatgtttggtaaatttcagctgttcatccatccagtagttgggttttctttcttgggagactttgtattactgattcaatcttgctactcgttattggtctgtttaggttttctattttttccttattcaatcttggtagcttgtatatttccagaaatttatccattctcctaggttttctggtttgttagtgtacagttattcataatcgtgtgtgatgatcttttgtatttctgtggtatcagttgtaatatctcccttttcatttcttgttttgtattctgtgttcttggttagtctagctagtggtttatcaattttgtttatcttttttttgaagaatcaacttttcatttcatttattctgtgtattttttagtctatctcatttagttcagctctttattatttcttttcttctaattttgactttggtttattcttgcttttgtggttccttgagatgcatcattgggttgtttgtttgaaatctttctacttttttgatgtaggcatttattgcctatgtcaaacttcctcttaacactgctttcactctatcccattggttttggcacatgtcttatttacatttgtttcaagaaattttttgcttttcatcttaatttcttaattgacccagtggtcattcagaagcatgttttttaatttccatgtatctgtaggtaccagagttcctcctagtattgatttattgttttattccattgtgacctgaagatacttgatatgattttgatttttaaaactgttgagaatcgttttgtgacctaacatatgctgtatcctggagaatgtttcatctgcttagaagaatgtatattttacagttgttgaataaaatgttctgtaagtgtgtgttagttccacttggtctaaagtgtagtttaaatccaattttttgttgttgttgattttctgtctagatgatttgactaatgctgaaagtggggtgttgaatttccccaatattattttatgggagtctgtctctctctttagctctagttatatttgctttatgaatctgggcactccagggttggatgcataaatattcagaattgttgtatcatacctcttgctggattgatccctttatcattatataatgaccatctttgtctttgtcatttttactgtttttgacctaaagtctgtttgatctgatctaagtatagctacttctgctgactttgggtttctgtttgagtggaatttttttgcatccctttactttgggtgtatatgtatcttgacaggtaaagtgtatttgttgtaggcagcatatagttggataatgttttcttatatattcaaccagtctatatattttaagcagattatttaatctatttccattcaatatctcttttttttttctttttgagacagagttttgctcttgtcacccaggctggagcgcaatggcgcagtcccagctcactgcaacctctgcctcccaggttcaagtgattctcctgcctcagcctcccaagtagtttggattacaggcacctggcaccacgcctggctaatttttgtatttttaggaaagacggggtttcaccatgttggccaggctggtctcaaactcctgacctcaggtgattcacctgcctcggcatcccaaaatgctaggattgcaggtgtgagccaccatgcccggcctcaagattgcttttaatatgcaaggctttgttcctgccatgctcttaattgttttctgatcgttttgtatgttctttattcctctctttttttctaattgtcattttggtttggttgttttctgtagttgtaccatttgaattctttctcttcctcatttgtgtgtttggtgtaccagtgagttttatactttgatgtgttttcatgatggtaaatgttatcttttttattccgggtttaggacttctttggatatttcttctagggccagtctagtggtgataaattccctcagcattttcttctctgggaaggactttttttgtgaaggataattttgctacatagtatatacttaagtggctttttttcttcaccactttgaatatgtctctcttgccctgtattgtttctgctgagaaatactttcttagcctgatggggtttcctttataggtgactagacacttttgtcttgctgttgttggaatcccctctttatctttgactttaagtagtttgactataatacgctgcagagaagaccttcttgctctgtatttgtgtggggttctctgagccccctatatgagtcttttctagattggggaagttttcatctattatttcattaaatagattttctaatcctttcattctctctttgcccttggggacactgataattagaatattgagtcactatgttgtcccataggtcacaaagcctttctcattcttttttattctttttatttatttttgtctgactggattatttcaaaagatttcaagttctgagattctttcttctgcttaatctaatctattgttggaggttttgactgtattttgtattttattcaatgaattcttcagttccggaatttatgtttggttcttttaaaaaaaatgtgtatctctttgatgaattcttttccaattttctgtattgtttttcaaaattatcttgtttgctgagcttctttaaaatcagtaatttgaattatttacccatgatttcattgattttttattggtatctgttgctgtagaattattgtgttcctttgaaggtgtcatatttccttgctttttcatgtttcctgtgtccttatgttaatatctgcacatctgatgtaacaatcacttattccatgttttttaaatttgcttttgtagagaggactcttctctgaagattatctatgatgttggttgagtagggcactttggctttgattttggatgcaagcaatagcgtagtttctgtatgatctccttggctataaatagtatcagtggtatctgtgatttatttccttgatagcttagggtgtggttattagtggaggctgtggtaaagttttctgggaactaggttattaggtaggccagtggtacagcagtggtctgaagatgcctgtctttgagccccagagtgatgtatgctggctctggtattagtgggtccaagtgggccaattactgggcttccaggtggcttgctgaaatgctagtagtggcagcagtgggcctggcatgtggactggttctcttgcccttggtcagcagacttgatgtgggcaatggcaatagcagtgattgggccactcactgaaatccaagttggtctgagctgtaatgggttggatgggccagtctcatggtgcttgcaagtgagtgccaattgtggtggttatcagggggttgagttgcccgcacctcagaccctgggaagagtgcacatgtgccaacagtagtggactaggctgggtgatttccaagcccctggatggcatgctcaagtactgagaagacaggactaggttggcagaattgagacttgtcctcaggtcccctggtaatatgttcaggcatggctatgataggtaggaacaaggtggtccccaggcagtcagcagaatgctcaggtgagggcactggtggcttcagttcagggctgccactggggagggcacagacactctcattgggagcagcataggtaggtagttgtgcagcatgtgatttgctcatgcctcagtcccccagcagcttgcagctctagtgacagcgggatttatccttagggtacacaaaagtatctggcctcatctcctccctggcctggtggtagcatcagtggcatcaaaaccagggcaagacatagtcctttaggggctcggctttcagaatgtcactgtgctgctcagggcttacaggcctgtgggtcacagcatgagctccctctttgaagcaataccactgtgcaatttctaggcagctctctgtgttagtctctaggcctgtgaggatcgaggggctctcctgtcagtaagatagtatgtggtgggaatgtggaccctgggaggtctctcacttaccctttccctgtgttagggagcttctcccagctcccagccaaaccccccgagcaggctacattgcttccatttcctctgttacctttggtgcttcctgtcacttttttgtggaattccagtgttctctcttagatgatctattccaagtgtgaatatctacttgctattttggttcttttccatggtagaggcacatagctgcctgttgtttgtttgttccttttttttttttctttttaagagacagcatcttgctagattgcctaagctgtacttgtactcctgggcccaagtgatcctcctgccttagcctccagagtagctaggattgtaggcacgagccactgcacccagctaatttgctattttgtaaagtacaaatatggacttttgcctggtttacattctgaatataccatcaagtctgaggtttgatttttttctcttttaacttatgagcaaatagccatattgtataaatatttttgaatgggcttatgtcggaggaaaacaaacaaaccaccatacctagcatggaagtaatctgacacatcacatttaattatgtgcctcagccttgagggcagagattagacggcatgcattttcacatcccgaaccttacaaagtgtgtgcacagtgcgggccctcaggaaatgtatgttgaaagaattgattaggaagtttcataggcatagttttggttaattctgtatttactttgccaaaccaagattttctgagaaggatgaggggagaggagagagctaggtgccgtgaaaagccttttaaaggaagaacagaagttgaagagcaaagtgggccagggagtcaggaaacaaaagggtgatgtgtggggacagctgtggtctctctttcctttctgccaccagcaggaggctgggtcaatccttccctcttcagtaagggcagacactgctcctgcaatggggaacccagcactgcagaacaagccagagtctgctgtgtgtaaaacctccagtcgtatagaattctagtccccaagcccccatatctcccaaaaggggaatgcccagtcacatgggtcccttgaggtcatggctccaggaaccagcaaagcctagcttgcaaggagaggtcatttatttacactgggcaagcaatgcatgatgcaagaagacacagagtctgccttagtgaccaaagagatccctttgcctcattctcctgtggaagcaatcaagaaagggaggttgggcgaggtgaccttccagagccgaatctgtgcttctaaaaatagaagcatccttggagaactgagaaggggagggaaagctttggacattgagggcaagaacctgaatccccagagcattgtcagtaggaaactgtattaattagacacaggcacctcagctcgataacctcaggtatctctcagaaattgaaacgaaatgaaatggctttttttccctcctttctggttatactgtccctgagctaaaaaggagaaagagaattgtgtcttctgacctatctgaatggctgcacagtgcctgagatatcttccccagtggagggaaatggggagtctttagaggcacgccagcaaaagaaaagagctgctgcaaagtggaactgtgaaaggcaggcagcagggccacctgggggtctgggtctctgttctctccctgcaaggaggctgtgcgggactaggcgagtacttggctgtgtccagggctctgaatgtgtgggctcgcagggtgccactctcaggctcatgcagtgtccttgtttggagctatgcgatagactgtaagtttccagggtccagtggagccgtgtgctggtctgcacagatcgtatgcagccagggtgtgtgctgagctctgtggcatggggatcgcgtgtgggagattggaggtatgcaggagtacacagggaggatatggtcgcaagtttgagggggctgtgtacgggagtgtgtggggtggtgtggaaacctgttgagaggcttcatgatgctgcatagggctgtgtgcagagctaccctgggccgtgggtggggcactacagtactggagggcacctgtttgtgtaactttgacttagaggctctgtgtgcattgtagtagtgatatgagtggagccacataggggagtctgtggaggatttgttaaggctgtgagacttatgcactggaggatgtgttctgggctacctggacacatgagtctgtacagggctgccggtgactggatacatggtggcagaggcctgaacagggttacagctttgccatccaaagataggctgtgcctcctcagggtgaggtgctcccaaagtgcagggatttattattctccctgtgactgacatgaacggaagagataccagggattctacaagctgagcaaaaggggcagtgtgttccctttcagtgtggcctgaagctgagcctcttgcacaccaggctggagacactttctaatactttagtttgtgctttctcaacaggacaacgtggatctgggagagctgatgttttccctgtgctatcttccaacggctggcaggctgaccattaccattataaaagcaaggaatttaaaggcaatggacataacaggagcatcaggtggggcattttcaaattcagacttcctcatgcacttctactgtagtaagtaccttataaagttttagtatggtaataaagcacattgactctggaaccagactgcctaggcttagccctagtcctaacacctgtgtgaccttgggcaagtcattttacctctctgagctttggattcccatcggtaagatgagagtaattatagcgtctggctcaccgggctgttgtaaaactgaattcataaatataaagccatgagaacagtgctagcatatattaagtgctacatattgttaattattgttattattacatttagccttctatatccaccagttccacatctgtagattcaaccaacgatggattaaaaatactcaggaaaaaagtaatacaacaataaaaataatacagttttttaaacaatacagtataacaactatttacacagcatttatgcctgattaggtattgtaagcaatctagagatgatttaaagtatacgggagaatgtgcgtaggttatatgcaaatacgatgccattttatataagggacctgagcatccttggattttcctatctgtgaagggtcctgaaaccaattccttgtggataacaagggacaatagtactctcttgggtctccctcaccataattgtgaattggacctaccatttacacacactgataaagcttatctaattgggtctttcctcaaatatcatcatcccaggctcattgaagactgagaacaatcctatgtccttattaaagggaactatgaattttagatttttccagtaaaccaagcattaaattctgaactctaacaagaaaaaaaaaatgcctctatatgcattgctaactgtgcaaattcacaagcaacctctgcaggtgtttcccaaatgtggtcacaaaacacccagtacaccctggcttacatcctctgaaatcaaagaacatcagatgcaatatattctgcatcctatatcccagtgtttttgtttttttaagcagaaagaaaaaaaagctgtggtccctctggtcatctaagtccctactggactgcatataggagtcagagcaatgcatggttatgcaggtgaaaatagaacaaggacttcccaataaacagaagaagagtgagatagctgttaggaccagaagagccctatctggagcagaggccagccttgccacctgttaccccatcacagtgttgcaccccaaggaagcctgtggcctttctctccctgatatgctgagctgcttctccttttgcaacccaagggcaggccactctaggggctcaaggtctctatacttaaggaattccactcccagatgttctctgtcctctaggaattcagaaattcagagtctaggaattccctttcttaaagacctgaaaagattccctgaggtggctcagagctggggggcctgttttcagccttggaaatgctggtgcatttctcttgctatcctggccaggccagtcttgagttctagctggaatgtctcctaattccttaacagatgttttcaaactatttttaaattacacacattttcaggagacagtatcctgtgctttttcttgaatgagtgacttaattatcctaactagttgctccccagatatcatattaatgacagtcctccaactccagtccacaggcaggtaaaggagttcagcataccatagtccatgaaaactcacagtgatataactgcccacctaaatctatacgtatcctcacagtactcctgcttctcatggtctgtccagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactatgaccggtgagatacctggaactcttttccagtgcaagttcactgtgcccaggactgggaaggcagagggggagcagcagccacagattcttacctggtgtcccaggctgcaggaaatgagtcaactagcagtgcatgggaagcacattgacaggagtcacctctaaaccatgctgtagagtcagactaccaaagtgtctctcagcactcccattcttttctgccccgttctcattttttttcctattcctacatcctcccccaacctccacctcttccccttttcatctttgcacaactcctagaatctcagcttggagagctgtggccccacaggttttatcttctgtcaggcagtgctaactgcccttcattggaaggattccactcaaaatggcagaatgattactttcgccagaccatcaacatttccaaatacataacttcaatctttttccttctcacaagtatttaataaagattgtttccttctacttaagtctgaaaacaaacacagaaatgttctcctgaaagtgctagaatcagtatggatgacaaggtacattaaaatgtataagatgctcaactttttaattaatacagcacagaagagatatttatagcctgcattgtagccaattgtgtatttaaaggacagatttgaaaaacagtcattttaatatgcaaaggaagtaccaacagggaattatacatgttaaaccagtcattagactaaaatgcaaagtctctctttaattggaaacctcccacgtggtctggacacaattattaaaaaaaatattctgacttctaatattatttgtgactaagaattttcccacatacctctgaaatatcaggaaggcagcttcagtgacctgaacactctttccagcagatgcctgcgtgaagcatgacagtcttccaacccaaggagcacgtgggttggctcagctgcccatgagtgtgacagcccatgctgagcagtagaccttgtcccatctcctgtgggcaagaaacaacaccaacagtgtcaggccccagtaggggacattgcccaccaactgtggaagcctaggccagcaatttttaagctattgccaagtttcctgcatggacaaatctgattatgtgagctctgccttaatttaattctcagtaaactcatgaatctggcctggaaaaattcatggcagaattcatggggcttctgcatgcatttgattttaatgggcagagactcaaatatccttcacgtgacctccccaccctcatctcacctttatgctccatacacaaataggagaaaaatcactcatctttgcaggagggaaaaaaaaaagagaaagtatgtgagtttggatcccatagaattaaagaattggccatatcagtccagttataccagggactttttaaaaaactgctagagaaaacaaaaatgtctcaaggcggggacctacctagggagagtttcagaaatattagccttggccgggcatggtatctcacacctgtaatcccagcactttgggaggctgaggcaggtggatcacttgaggttaggagttcgagaccagcctggccaacgtggtgaaaccccgcctcaactaaaaatacaaaaattggccaggcatggtggcatgcacctgtaatcccagctacttggaagctgagacaggaaaattgcttgaacccgggagctggaggttgcagtgagccgagatcatgccactgcactccagcgtgggtgacagagtgagactccatttcaaaaaaaaagaaatattagcctcaaggtcaaaggagctatgtatctttctatagttgggaaactaactgggccaaagaagctgaacttagaagaaaggagggacaagtataagacaataacagtattctctaaagagaggaagcaggaagatccataagcctccttcacttaccttagtttgtgggctgaagacccatggctgccagacacaaaactgctccctcacccatgcttggttgcctcttgtgggaattagagcagccattattgcaagaaactcatttcagatgactccctctttattacatggaggccagcctagatccaggacgagaggtggcatccttagcacaaatcgtggggttctttgaacaaggttcttggaaacaagttgacccatgtcagttttaggacagccagggtatacgttagatcccaagtcctattggccgtgaagcttagcctgtagttttaagtgaggaaatgaaaaaacaaacaaacaaacaaacaaaaaaccacatccccaattccttcatcagtttaattgagtagctattgatcttacataccaaaattttaagaaaaaactattgtgggccattttcacagtgtaggtcacaatgagatcatcggcgtgtgtcaagtaggcaacgaggctgagaggctgggcagagaccactggagtgaaatgttgtcatatcctcggaagcccattgcacactggcattccctggtggaggtaagaccctaatccacatgctccactttgcataagagtaaatgctttactgttgaaatgcaggagctgccaaacatatgagtgcaccaggatctatggtcatagacgggttttcctggttgcatttcctggggctgttgggacttgcattcaatttgaggctgaatctgtgcttcccaccagtctggtaggttttgagtattgatcagagatcatccctcattttgattgtatttttaaaagatcaagattctctgcttctgtgttaaggctttgggttggtacttggagggcatctgcaaggtgtgggtgagtggggactttcaggccttcgtacagtgacttgagactgactttggaaaaaacataaggccttgattctaagaccagctctggcaccaacctgtgattctgggcaagtgggttagtatcaggttcaactacatataataaaaaccaaaacaaccaattataaattaaaaacaaatgaaatgagaatttatttctctctcttatatacaaaaagtctagaggaaggcagtctggagtatcttagcagctccatgatcaacaagagacctagacttctgtctttctgcctcacagtcccagtgtggctttgttccttgaagtcccctcattatacaatatggctgctaagctccaaccattgcatattttctaggccacaaaaatgtgcaaaagggcaagagccaaaagggcacacattccctttttgattctctttgaattctcatgcaagactgctatttacatttaatttagtcacaaaacttagtcacgtggacatgtcaagttgcaggggatagttggaaatgtaacctttttgttgggtgtcaatgtgtccaactaaaaaccagggttctgtttgcagagaagaggaaagtgaaaacctggagtcaaccggccatcattctgccactcacatcctcattcattcactccctccccctttacttctcattcattcttcccctacttatctttgctcattgattcactctcttatttattcactaacttgttctctcaaaaataatttgcactccctaagtaacatgtctgagggtccaatgctataatagctacagaaaatacagatatgaataagaaacagtcctttcccttgtagaacttacagactgtaaaataaacaaaagatgacatgtaaactaatcttcgagaggcacaaatacaagcatttccatccatataaagtgctacaaaagcgcaaaggagagagatgtttactgtgcttagaggagattgtgaagcatctctccttcatgctctcaataagtaaagagaactgagcccccgggaactggaaagccaggagggcagcagcagttatttactgaggatgcgtgggttccaggcagagagctttcctctgttctcctggtgcaggaagctctcttccatgcaaagccatctgagaggccaagactagagcctcacccagtgtgggcacccctgccattgatagtcaggtgagtctggttgaagtgaacacagggcggctgtggagaggcagagaggcagagaggccccaaacccagacaggggaaccaagggacatctttgttggaagtggggcaggaaggagaaggcaggacagggtttatggattctaaccatcagggcacccagatgtattcaagaagagcctaggaccccctaatttgcgggttcttaaggatagttctgcccgtgggccataggagcaaaattgatccctaagggagacccacaggatctatgagccacttgagaaggagctggagactggtgctcactgaactatacctcacttcttcagctcctggtggaattctcaaaggagtccatctgtgggctcattagattttgggggcctgtcactagcagtggcatttagaagagttgtaatagactttttgcacccttatgagccattgctgactttaattcttattggtaattaggagtatcagagagtgttaaagctctgtgcttctcaggaaacaagaaatgagaaaggagtaaggatgaggtgtgtggtgtagggctgagaggtgagccctgattcatgcacaagcagttttttttcagtgacctgggcaggggagtagtcctgggtggagtgttgcacacgggtccctgagtggcagtatatgcacgtgttacacaaaggagagtgcagggagcaggccttggaggccttttccttcactgtggagaaaaagtgtgatataaattcattcacctgagagatattcctcaaaccccaaacactcagctttttggaaatctgtgctccacagttatgtaactgaaaagtaaatgccattagggttaaaccactgaaacttagaagtcatttgttacagcggctaaaattactttggccaatacaatggtcatttctgaactgttacagcagaactaaggaaatgaaatgcctgtggggcttatatgaagggcaagccttcatataagcagggggagggcaaaccttcctataagcagaggcagagggaggctgcctcttccccgttgcttcctgtctctttgaagtacacgtctgggactccagatccatcctgagagaggaagtgatgctttttcttttaaaaatgaacattgagctggcagaattggggcaatggtaccagatgagatgaaaaacagtattggagaggttggccatgcttcgttagcagctgtaaggatggaggaggcaacaggcagactggccagaaacattcactttggagttggaaggacctatattcgaattgctgtcctgccactcactagatgtttgtttttccccttctgaacctcagtgttctcatctgtaaagtggccataacagtgcttgtctcacaagagggatggtgaggattaaacaatctatttatatgaaatgcagcattgtagctgatatataataaacactcagtaaagttttcagttatagttgttattatgtatgccccacattctgaggggctgctgtgtgtccttatgggcctatgtcctgtgaagaaatatcatccatgtgtgtcatggagaataagagaaaggccgggaatccaccactcctgcaccccagtgagccatcatctcagagtggggggaaggggtcatccagtacttggctaaacacagatgcacatatttaagttttgtttctttcctcttttccttggccttaaagacaggctgctgttatgctctctaagaaccttttaaatgtcttctttaaaacaaaaaccagcaattaaatctcagtgctcatgataacagagtatgtgagtgtgcactcatgagcatgtgtgtatggaagacagagagagagggagagagaacgaagatgggggccctgggatttagcatggagggaggctggcctggcagaagctcttcactgctgaggaattggttaggtctaaactctgagccctgcagagatctggcagcctgctcagggttgcatccaatacaccctgaccttgccagggcaggtggcagatggaatcttcaaagccagtgagttcaaaaatccgtttctctcgcaggaattctggatgaattcactgcacactcaaaggtcagccagtagggctccctttactccccatgatgccaaaggtttggaaagctgtgaaaactcccccaagcagactgcctagggcttaggaatcggagcaccccctccatagggcctcagatgacagagctctaagagctcccttagcacggcaccctcctccaccaattcaagagaagatggtttcggcctggccatatcacaacacctttcctgcctcctgtatgtcaagatgaccaacatcataagcctcatggagaataataggaaatagttccaagttttcatcgcttccctgtgtagtgccatgtaacatctgttgtatgaataagtactaatcttggtttggtgggaagacgagacacagacactatctggttaaatgaaatttcacttttctaaaagaagaaagagaatccgatcagaatatatagtcaagatcagcactattatcctataggcataggtgtaggattccaaacaccaaagttctactcaaggcgtgccccattttggatgtctgcctcactccaagctcaacctttgtgcatacacgtacatacagctacaaaagttctgcatgtctgactgtctgctgggaccagctcattgagcctcctgcccctcttcaactcagaattacataatgccaagtataaccagaaggcagttatggtacaatatgcccagacataaacagagccctcatttatcaccctcagcctctagaagggtataaacttagagtcaaaggactacagcaactgtcagttacccagacttgtagttacacaagcagcccgtgtaaaccatctctagatattatctgtcaagtgtccagcagggcctatctggagtcttggagatccacatattcccaggagaatgtatctgattgcccaagatttgattaggtgtccatcccggtgcaatttgctgtaggtctggggtcatgaaaatgtgacctggacctacctcagcaggagttttgggagtagacttcttgagaagagtccgcacaggacagggaaattgtctaaaatgaacatgaatgactgtttcccaaaggaatttaaagtgaggagtgagaggctttagcactgtggccaaattgttattcacaacagatttaggaaaggagcaattcaccaggaaagatgggagtggggagagcatggggtgactgggaaaagccacgtaggaaatcaggttcccatcaaggggatttgggtgtgttgcagggcttgggtcttgttgagaaccagactagcagggaagaacactgagacaagacaaaaagaaaagcatggactgaaacgtacaatagggaaagtcctagaaagtgctgctactcagcaagcattaaggcccccaagactgcaggtctttggaaacacctgaattccagacccctgtcagttggtggggaaccaaggctgccaattccatgcattgccctctgaaggagtggcttatgggctagataaatgaacatagcaaaagcctaatacgtgtgttaggggatggcgaaagagaagtgagcagtcaggacgtggagggctacatgctgctgcaatatcttgcccatatgatgaggtgctcccccccaatatagtccagcatcgtgtctcatgtctcagtgtctctgagaacaaaatttttgttatgaatgaaaacagaaaaaacaagaaacatttaaatcacattaaaatagggcaagaaaacataaatttatttattatctgaaaggatacataccatcttggtaagaaacaggaagaggtaaatgaactttatcttgctaattagtagttctcggtcttttccaggttatgtcagtctctttgggataattattttctcctcttcctaggagtctcctctctccttccttcctccctcccagctaggtatagggaagtacaaaggctacctcgtggcattggctggaactgtgcatattgttctgcttgtctttgggcatcagacttcatcatcactacctctgctgctgaggatcatggctggtgtaactgtgggctatagtctcagcatagaaacttggccaccttgaggctgatgagaccccacatcagctgttgaagtccctgtggatccctgagggcaggtagcacctcccactcaatgcttggcctgggagcttttctttgcagcccttaatacagagtcattccccacttggtggaattccctgaaattctaacaaccaatactctcacatccttcaggcatttgggcacacaagggagccacaggagactcagtgccatcacaggcatcttcttcatgcctataaagttacatggtcatttctacattgttcctctagcctgtgttggcccaggggtcatgtttgccttaagcttccccctcaatccatctaaacttggggtttcaagcctgaacggtaaagccagaacctctcctcctctcttctctgtatctcttctgccaaagggtctctgcttcctctacctgtctggtggaaacaatatatatcttagcatgatttccctctacctatgactcacgctcagacctccaaggtttcctctcagcatgtaaggaaacatttggaatttggatcccctttttctcaataaggcctggctttaagataaagttgcatggtcatttctacatgtaacatgaaataagatacttatttcataggagactagctgatcatttaccttgagttatcagccctcagcttccaagaatatatggcgtttattcaatgcatgcattttctgatttacagacaataagaacattatctctgttacgtaggtattgagttagcatttggtgaacaaatgaaaaaaaaatgaatgaatgagatatatatagaatgaattgagttcccttcgttctaaagttccagaattcccatgcagtggagtacacagtagaagtcagttcagacaaggtgtaaaaaggtattgagaatggatttgtattaggctgttcaaatagagatggcccttattaagctccaagttttaattaccttttctctatttaggagaagaacatgaaaagggaccaattcctcccttggttccaataaactgccacgtaatgacaatggctttgcatttttgaataatgagaaatattcagaactgaggccccttagtgaatcatgagggtccccctctacttgatgtaggcagccaagtcctagagcgctcaatatgtcctttcataagagagaagaaacacacagagatcccaatggtgaatggcagactgctgtgccctaagtgaaaactgatcaggaggtgacaaggactttagcccacaagttgacctttctcactaggaatatattttagcagcagttttacacaaggtaatgctttgccccatctacctgtgaagataaagaagagaaaaataataggaatggggtattttttgacaaaatgaagaaattattcttcagattttgttgtaaaaaataaactattttgaatggtgagatttagcatgccagcacgcataaacacctgcagggccgctgaagcaaaactgattgcagagaacataaaaatctactacaagtttaggatctgaaaaacattaacagacctgttagaatttgtgtcaattgctgtaagtggccagaatgctgtttggacaagcaggcactgttagtattagtggggcattgtgtttccagctggtagaggttatggttaacaaacaaagctagggccattcagaccttcccaagcaaatcttctttcttgtattgaattatctgtagaaaaaaagagagagagacggtaggcattttctcatctttgtcagggatgggtgacttttgtgacttttctgaaggtttgtagagatagtaatcatacaaaacataggagtacttagggtaaacactagaggtataaaagataatgacaatgtggtagaaaataacatttctgcctgaacagaaagtcaactgcatcttgactctcctgtcattacagatgaccttgctccagtagtcactgccttggagcatccctgctgcacacttgaatagctattaaataggaaggtggatgacaatgggcttgagccatcagctgtctccatctccagggatggcattcagaggtgattgctaacatgataggccagttctttccccgcagatgaaatgaaccagagtggtttatgccactctctgaaagaaacacactccctcctgatagtgtggtgggaggaagactgttccctcctggggaatggggcctggggcaaaggcggagcaccctggcagaggacactcaggaagcccactgctcctggatatgaatctttcagaagacgcacttgtcaaatgctgtcttccaaacatcaccagaacaacctattgataagacaaagctgagtttattgctttcccaggtaatggaaggggaagggcagagtctcatttgttgagactttgaagtgtggtttaaggtgggtctctccatgtgacgagggagatgaagtggggaggtggggaccttggttaggtttggatcagtgtcatgatataatagctgaggtggaacagcaagttgaggattttgagcctgggattcaaagagtcttggggtgtaaactgttgatgctttctaaggaatagaaattgggaagtcccatgagtgaatacttaagttgtagtaatgaagacaatagaatagtacagccaaattaatggagggtctgtgttggaataggtggttttagtactcacactccagcaacaaaaagcagaagggaacctcacaaaagatcctgcccagtcctgtgggcacccatacaccgacagagtgaatatttattagttgcctctccagcatcaagccccttttctgatggccctgatttctgattaatgattctagggagcctggctccatccttgtctctggtgatggtacatatgacagttccaggctaaacctgtcaagctaaccataaggattaccactgcatacgctgattcagtccaagagtattataaaacatttggtgtgaatgtttggacaaagatgctctctctttcttgttggatataaacaaagcactatataccctgggagcagctgtggcttctttggatctctatagaagatccaggtttagggagaaaccaagcccatagatacaaagaaaccagattctcagtcatgtggttgagctcctaaatcaaacctctcccaaacatagtgttacctctggcctttataagtatgtaaacgtatatattcccttggttgtgtaagcaatattaagcagaatttattttatttgaaatgaaaaacatcttatttaggatacaggtgaacactcacactgccccagttggtgttctttgggagtgaagagaaccattcccaaagctgtcgcgagatcagctcttctgcctggctcactgcggtatgtccaatacctaacaaagtgtgtggcccacagtagactcccattaaagttttcctaatggagcaaattattaatgttcagataattaacttgtgtgttaaaacaagcatggtgaaaagagggacacttgactctcagtgacatacaaatattatataaggttaagaaaaaaactattttccttttgcatttatatgttattcaaattctacatggagtctcagggcctgtgggaagctcttcattttatgatcactcccttgagctgataaaggcacagttcctcaggagtgaagatcagtcacatagctgtcctttcccttcaatgtcttatgtgatgtactgcaattcatttatttacagcaaaaatgaagatctacactcttttaacacaataattttagcaattctagtattatttttatttctacgttatctatttttatgtaaaactcaaatgtatatttaaagtcttcagtcattggtggtagaattacatatttttttcgcaccttagataaaattcaggatgtaaaatgtgatgatattgataatcaaaatgcttgaaataaagaaaagagggtttctataaagcaaggggaactttaccattcattgagaaattatataatgcaattgtaacttttaggtatatggtacactatgatgagttatactcaaattgtcagaaacagaagcagttatgaataaggcaggaaaacaatagggtgattttttccttcatagcttaggatctgaatggtgtgtgcttagatgctttacatattaatagtaagtgttcatattagtaaagtttactaaagagcggtcataaaaccaattaatatggtttaaatatttgtccctgcccaaacctcatgttgaattgtaatccccaatgttggaggtggggcctgatgggaggtgcttgggtcatatccatcatggcttggtgcggtcctcttgatagtgagttcttgcaagatctggtcatttaaaagtgtgtggcaccttccaccctgccttgcttctgctctgccaagtgagatgctggctcctcctttgccttctgccatgagtaaaaacttcctgaggccccaccagaaaccaagcagatgtcagtaccatgcttttggtacagcctgaagaactataagccaattaaacctcctttctttataaattgcccagtcccaggtatttctttatagcaatgcaagaaaagcagtaccagaagtgaagtggggtattgcaataaagatacttgaaaatgtgggagcagctttggaattgggtaatggacaaaggttggaagagtttggagggcttacaagaagacagaaagatgagagaaagtttggaactctcttagggactggttaaatggttgtgaccaatatgctgatagtaatatggacagtgaagtccagactgatgagacctcagatggaaatgaggctcttattgggaacaagagcaaaggtcatctttgttatgctttagcaaagaactcggttgtattgtgtccataccttagggatttgtgggagtttgcacatgagagtgatgatctagagtatctggcagaagaaatttctaagcagcaaagcattccagatgtggcctggctgcttctgacagcctaagaaatgacttaaagttggaacttatatttaaacaagaagcagagtgtaaaagtttggaaaatttgcagcctaccgtgtggcagtaaaagaaaaagcttttcaagacagaaattcaagcaagctgtggaggaaccacttgctagagatattggcataactaaaagggagccaggtgctaacatccaagacaatgggaaaaagacctcaaaggcatttcggagaccttggcagcagcccctctcattacaggttcagaggcctaagagtgatgaatggttttgtgggccaggaccagggccccacggccctgtgcagcctcaggacactgctccccacatccctactgctccagctctagccatggctcaaaggggcccaggtccacctccagctgctacttaagagaatgcaagccataagcttgggcagcttccatgtggcattaagcctgcaggtgcttaactgtgggtaccagagtgaaggtttagcagcttctgcctggatttcagagggtgtatgagaaagcctgagtgcccaggaagaagcctgctgcaggggttgagccctcccagagaacctctactagggcagtgctaagggaaaatgtgggattggaggtcccacacagagtccccacaggggcagtgtctaagggaactatgagaagggggccaccagcccccagacctcagaatggtagatccactgacagcttgcaccctgtgcctggaaaagccacaggtattcaaccctagctcacgagagcatccctgggggccaaccctgcaaaaccataggggcagagctgcccaaggccttgggggcccaccctttgcaccagtgtgtcctggatatgggacatagagtcaaggattattttggagctttaagatttaacaacaatcgggcatggtggctcacgcctgtaatcccagcactttgggaggccaaggcaggtggatcagttgaggtcaggagttcgagaccagcctggacaacatggtgaaaccctgtctctactaaaaatacaaaaattagctgggcatggtggcaggtgccttcaatcccagctactcgggaggctgaggcaggagaatagcttgaacgtgggaggcagaggctgcagtgagctgagattgtgccattgcactccaccctgggcaacaagagtgagactccatctcaaaaaaaaaaaaaaaaaaaaaaaaaaaaaaaaaaaatatatatacatatatatatatatatatatatatatatatatatatatatatatatttaatgactgccctgcagggtttaaaacttgcatggagcctctagcccctttcttttggtcaatttctcccttttggagtgggaatgtttatccaatgcttgtacctctattgtatcttagaagtaaatgacttgattttttatattacaggctcatgggtagaaggcacttaccttgtctcagatgagactttggactttgaacttctgaattaatgctggaatgacctaagactttgggggattattgggaacacatggttgtattttgcaatatgggaagaacatgagatttgggaggggctggggtggaattatatagtttaaatatttgtccctgcccaaatctcatgttgaattgtgaaccctaatgttggaggcaggacctggtgagaagtgtttggataatatccctcatggcttggtgctaccctcatgctagtgagggagttcttgcaagatctggtttaaagtgtgtggcacctccaccccccttgctcctgctctgccatttgccacactggctccctatttgccttctgccataagtaaaagcttcctgagacctccccagaagccaagcagatgtcagtgccatgcttcctgtatagcctgcagaactgtgaaccaattaatctgcttttctttataaattatccagtcttggatatttctttataccaatgcaagaatggactaatacaccaatcaagaaagtaaataccatccaaagggattaagattgactataaattttaaaatatgaacattctgaatttttcttcctgttattaatgcttaatgaagtcctggaaatgggaacggagaagtggatccaaatacatccacatctgcgtgtgctttttgctggggctttatctgcattctctctctgctatggtctgagtgcttgcatcctcccaaaattcatatgttgaaacctaatccccaatgtgctggtattaagagatgggaaacaattaggttatgagggctctgccttcatgaatgggattagtgcccttataaaagaggcccaaggaaacttgtttgccccttctaccatacgaggacacagaatgatggccccatccatgaggcagagagctagcactcaccagacaccaaatcagctagcaccttatcttggactttccagcctcaaggactgtgagcaataaatttctgtcatttataaattatccaatctaagatattttgttatagtagcccaaaaggactaagacatcccccttaatgactggagtcagaatcacatcaaaaaataaggctgagttggagccagcaacatttattcacaagagaaagacaggaattggactggctgcagagaggcccacagagtcagagaccatccacctcagctacagcacagggctcagcactgtatttctggtgttagtgctattctcaattctgtccctagttcctgctactgaggaactccatacacagcaggacagtcttctgctgtgccatgaattcaaacacaatctgtaaagacagtgaaggaagctacgtctgtgcttaggtgctttagagaattatcggcttgcagtaataagagaaatgtctgggctgggtagtcctcaaagactcccatgtggttcaagataacaaaatataaaggctgagcatctcgtgctcccaacctagttctaaggcgtctatggagggatagtgagtggggctctctatggcagtgattgcctctaatgaaggaaccaaaagccaggcagggattagggtgggcttctggttttagaaaacatgatggtagagctcttcataggaagtttttaagatcaaggtaggatcctgcttggaggatcgtagcctggcagtctggatcagcctggtggtggaggtgaagggtgtggaagctggactcactttggcacacaaagttcaggaatgagttgacaaccaaggccccgtggctatggaagatcgtatcacatgaccccaaagtatggcagggcagccagcggagcagttctacctctctaccttgggcctgcagggtgacatcaacattgataacattgaaggcatgatgttgtcaatatttattataagcacacttataatcttaaatttgcactttatcctagcctccgtggtgcctattgtatttatgggtgagtagttggaggtgacagaatataatctttcagttgcatttaaagttttatgtttcttaaagttacagaaagttcgttcccaggactggggctaatggctcttctcctgctccttacagataatgtggcacttccattgcctagtatggaaccaatatatcacatgaatgtgcacttacctagaactagtcttatatcaggaatgaggatccagggatccttgcaaagaaagaaataataattcagagaaaccctacactctcaggataagaagggggaaaatcaaggttcccgccatcaaccaaatggtttgagtccaggcagaatctaaaccatcactcacagtgcgccatctgctccagcaccagccctcctgattcttttgcaggtcagcaggcatgaaagagttaatagcaaaggccatgagaaacttgctcgctgttatagagaaatcacttttagttccagttgctgctgccagaggagatgcttgagagcaagataggaaataataaggaagaaaaggacttttgaatcacatgagagtcttcgaggactactcagcccagatgttcctcttattgcttcaagccaataattctctaaagcccccatgcacagatgtagcttccttcactgtctttacagattgtgtttgaattcatggcagaccaggagactgtcctgctgagtatggacttcctcagtagcaggaactagggacagaattaagaataatataacatatatgaaataactgtattccataactggaaatacagtgctgagccctgtgctatagctgaggtggatagtctctgcactttaaaagagagtctttgagcaactgcagacaaagactgatataacttcttgattagaaaatcagctgaaaggccgggcgcagtggctcacgcctgtaatcccagcactttgggaggctgcggggagtggatcacttgaggtcaggagttcaagatcagcccgactaacatagtgaaaccctgtttgtactaaaaatacaaaaattagctgggcatggtggtgcatgtctgtaatcccagctacttgggaagctgaggcaggagaattgcatgaacccaggaggcagaggttgcagtgagccgagactgtgccattgcactccagcctgggcaacagagccagacttcatctagaaaaagaaaaaaaaaaatcagctgaaaagaccagaagagaactccatgagacagggaataatggtgagccaggactattataggagaaacagatctgggccagattcaggacttcacccattccaattttagagaggagggcttggaatttaaggactgagcccttccaccatcactatccactccatgctaagagaacattaggtggcctctgtttttaaggctctgtgctgctgagcaggacatgcttgctattgaggtgggtaggatagtaggttacctataaggttccttccaggcagtaaagaaactgaagaaagagcaggttaggaaaagggagagaagtgttggtgcagcagccagccacagggaaaggaatttggtggccttggagggagggaaagtggggacagtatcttcagtaggattaacatggatttgcatttgaattgtaaaatgagaagttgcttagtcggatctcagactgagggtccatggtgctcctatatgtttctagattatttgtaatatgctgtttatatgcatgtatatgtacaaatgtaagagctcttagcaaacttaagcatacacacaaagacttaaattacttgtttaatacagtggtgtccagttggtttttttgtttgtttgtttgtttgtttttggccaaattctttgatgaagtcaaatctaatttgaaagttgaaggtctaaaacagataaatgcaagagctactgtgatcgaagcagacaaattgaggagagcaaaatcatttaatcaaagaggaagacgtgacccagctcaacttcctggtggacgacctcagctgtgctgttgttactagtgtctaacaggaagaggaacctaattacagctcagccacttcgagctgctgagcttgagcaaattatctcatctctctgaggattcatttcctcttctgtaaaatggggatatcagtagctagttttagataactgtgtgaggatgattaaatgatacaacatacctgaaagcacctagcataatatctggtgaaagcagtgaaagacgctggacaagtgtttgtttcctttctgcagccaattaagattctgggaaactgtaactctacccaggctttccagtagcttattttttattgttctattgtagtgcttaaataaggataacttttccagagatagcctaagtttctcatttctctggctcttggaatttccagtgcttcacaaagactttagtgttaagaatgtaaggtgtagcacagtatttcaataagtccccagttctacatggaagggagcagtgtgccacaaatgttcttggcattgattcacatttagatatacatttcagtcatgacatggacatagatataaaactgaaacaaaagtttcacgaaattaataaacataacgtgatgcactttttaattttttttcattaaaaatagactactggtcacaatcattaaattaatttcacaaacccataatgggccactgcccattatggattcaataaacactgtgtgatatgcactttgaaaacgaccactgtatttggatccagtgtgggagtgataagaaggaatatggactcatcaccaactgcccatatttttaggaccctctagagtgattttttttttttctgaaaagccagaattctaagattgtcatcacatattttcaccggaaattaatgtcattccttggttttagcttctctgcatagaacactacatgcctgagtttgtgttgccacatttgcatgggcacaaataagttatttttaccacaaatatttaaccttccagtttgaagctgtgctgtgcttagcctaaacagcatagagagaccaactgtgtttataattaaagaaaaatgctgtgcaaagccacagaaggaaggaagaggcaattcttgttggaggtatgtgtcactgctttcaaggggttccctgaggtgcttgactccacacggactctttcattcctgctaggttgcgaatactacaccaagtgctgtggacagagagatgtagatgaagcaccggcctgtaaagagtctggtgggggagtctgacaggaaattgttccagtgtaatagtgtcaatcatataattggtggtttcaaattttgtatagatgggagagttgtcagccttccacaggggagagggtggtgaccagagacacatgctgaccccacttgagcaggctcttggaaatacggaaatccttcccaataggaaaggaaaggttgaagatacaagagagggaggggataactgctgtgcgggctttgacctggagatacgtggcccagctcttctcacagagcacacaggatgctctgccctcctataacaggcacatcagggccccatctcatctttgtggcatatggaagcaaatgttactccatgggcaggattcagaggcagccatgtgctgctcttagtacaagggcagaggacccagcattaatgcagtgctttctatcacctttcccaactaccagaactttggcccacccatctgcctcctctctcccaggtctcttggtgcccaggttttctctgcatacttgctgcactctctggtgtcctggaagcagctctgccctcttccaacctggctcagccttgaaagggccccttttttcacattggtgcaggtaggtcttttgccaccatccaagccttgttcctattcttctatcaacttccatcagcttgtatggaacaacacatcccctccccagtgctctgctgtgcacattgaaactgcccttctcagatcagagccccgcccctgtcatcccatgcacctcctacatcccgcccctgactcttggatgtcgcacttctgttcagacttcatctctgatttcagcattagatacagaagctttttcctgctaagtcctctcctcccagatctaattcacagccagcaaatccagctgtgggcagtctttgagcatttactctaaagctctaaaggacccaaaggtgatgcaagagccacctccctccactcagaaaggaaacactcactgtgtccatttggcttcaatcagacaaacccaagacattcagagggatgaaccgacctgaaaaatatccctaaaaacctactttaacagaaagcacaaagtttcaggaaagaatggaagaaattatagaaactggaattatacaaactagtaggggcatggaggcatgcacacagcttagaagagaaggaagtcactctatctgcttcagtgtcatgatggtgtgagaccttgaccaagaatgtaaatttaaaccttctgggaaactttgctgtgctccagcagacaaagaaaaggaggctgaggaaagtgtcagagccaaggtggactgataggagggaggagcgtgtctaatctcaagcagcctgctctggtgcaaggacacagccaggaacactggaactcaggaacactgggacacacctgccaaggctgccagagaagcatttcatgggagtggaccccaaggccaagtcacaggaattgcagtcaagcaacatcaagtcaaaagacaggctgcaaggtaggaggtgaagacatgagcagaaggctggagagattgagcagagacttcaaagctggaaatcagactttagcaaatgagaggtcaggacaaggaagcaggggtatgttacagagcagacaagaggcagagcccaccctggaacatgttattcacggtgcctaccatctcagcctcccctgcatgcatgtacaacttcacccctaatatctgttgaacaagcagccctaaccaccgaggtttgtaaaatgtcctggccacaggtgattggatcaagatggggacatgctcccagaaagctgtttatgggctgtccagtgacttatgacatggcctggcaccccaaggtgggttgggtcaattagattatgccaccaaacttagaaatgtcagggaaatgaggcaatcatagttccttctcttgggcttctctaagaatccatttctattattgttccataagtactttattatagaacaccataagcactcccatctagactctcactgaactgccttgattcagcctctgttcccgtacaacctgaagactcaccagaacacgtatggacttgcagctgtccagaagcacagtgatgaatggtgtgtttggccactccatttgttttcacatagtttcccacagtttagaagtgctgaagatgagaccttaaaagagttggaacccccctgagtagaaaagaagctggaattagcaaaataacacaaataggcatgagattcatcctactgggaggaagtcacccttacaagaagagaagcacaaatgaggaggacccccgctcacttaagtgtaaaaaaaatgctgtgtttagaagctcagtaagatcacagttagtgacttttcccagagggggtataagaagtttcatggagacccaaaaggtctgatggcaagataccttcccaatgttgagtaaggcgccatagtctgccaaaactcttcaaagccactgcttctcatggacataaacgttccaccagaagtgaacatggtggtattttttgagtggaacaatgaaagatgtgagaatacaggtggtattttcattgcttcttcctactgccctttggaactctggaagactgaagaatatctaaagatgatcagtagtggacttacaagaataggttgatatttagaatgaggttctgaaacacagcttaagataccagaataaatcattctagccatgagtgcagagaatcttacaaagacatgggggactatgttgcttagcgactgatcagctgatctcatcaagaggatttaaaaactgataccaggaggaagagtaagacaacacaataaaatagacaacccacaagaccagttgctatgaatgacatccagtgggatgtggaaaaaaagggttccaggacaggaggtttccagtgattcacaggagataagattgaatcctagatgtaagtgatggccatggccttgggtgtcctaatgcatcctgcagagagaacaaacagaataacccaggacaatgatcacagccttgtagatataactggcacccaaacatgtcaacagaccacttagaagcagacagattaatgtgctatacatgcctgaagagctgtgtacctaacgttgaaagctcattgatacacatattgtgggcattagcagaaatgagcctgccagggaaatatgacaggtggagaggtgagactcctaaaacaaatcaaagcactagtacagagataaaaatccagtggtgagggagaaacccactgaggagatgtttcctggaagtcttctttggttaaagacaaagtgaaaacttctccagttgctttgctacaagtattagaatacttttgatgtaatgaacagaaatcctgacacaaactagattgaacaaagaaactgtagcatctggacaaagggtctagagataggattgtagattccatggttaaggatggggggttccgggattgtagattctgtggttaatgatggtatcaggaacaccagttcttcccaggctattgggccatccttccttcctttctgttcatcttcaggttggtcgcaagatggatgcaggtctaggcattgcatccagacatgaaagtagccacaggaaaacgcacttcttgtagctctctgttaagagcaaggaaaaaattattcaagtgcccagcaaactggctccttacacatcatggccagaagtatgccaatttttgaagcagtcactggcaaaaggaatgggactgtgtgggcccaacaggttcagccctggagatggatcccttcttctgggacaccaagaaaaacaccatccccttctcccctggcaatacccagccaaccttccagctatgactctcccccacaggcaccctgtttcttctcatgacaactctgcactccattatccacctcctgggagcaaaccattttgtagcctattccaaaaagctcaagccagcacagacaccacagggcagcaaacgaaatctgaatctcaaagcttgccagaccagcagcgcccactgagaaactctccagataagagatgatcccaggaaccccaccgcctcctgccatgtctctgcacatgccatcaacgctctgctctcagtgaaaatggctgaggggaggagcttttcctctacagacccaacgctgccatttcccacccctgtggtgggactcgaagaggggctggagaacacgtctccacacacatacagctgtggcctgcttttggctctctcctcccactcttctgcagcgcaaaccagggtggaggatggtgtcagacccgtctttcggaacacttgtcatttcaagaaccagagaggcaaagcccttcaggcatgtttggagtcccagagagctcagcacaggactcgtgctgccaacactgtgactctagactatcttgctgggaatcgggatttcagctcctctttccacacaccttcacccccagcactgggcacccacttctgcagctccccactcaaattggtccccctcctttatgacactgggcttctctggattcctgtcagccgttttctccagtcctggggctctcaatatctccaaatactcacatgggtaatgggttccttgacccaatgacaagcatctgtctctcaaagagcagtaggcctttcctagggcctctgccatcagctctgctgccctttgctgccctcccctggccattgacatcactgcaggtaactcttcaggactctgatgggttcattgatacatccattcaaaaaaaaagtatttaggggccctgtgtaccacgcgatgtccagacactgaggattcagtgataaaaacacatggcgcctgccttccaggagtacacagtctagtgaggaaaatgagagagagggagaaaagcagagagagagagagataatgaatgaatgagaatgagaatgaaagaaggaatgagaatgagagagaggactttttgaatgggaatgagtggattctggtgtgcccttgtggaagtctagatttgctcattgttctgcagacccgactgcctaacatgttcacctgaaaaggaatcccctggcctcccctttggaagtggagttggagaatttattttaaaccgaatatttctgagcaagtgcaaagcaccctacctggcactgaggtataatggggaaatgctggtcccatcccccacagaatttacaatctggctgaggaaatagacataagaaaataattagattgtttaataacagttatggtgttacctggtactgtattctgtcttagtcatacctagcaagagctccacacagcaaggatagggcatggggtccatgttttagggggtagaaggagtgaaccacagagagcacagcccgtgcacatggtaggcacctcaggaagtgctgaatgcatgaaagaggctgcgcagcagacaaggctcctgggagccaaggccagtgtctccagccagctcagctgaaatcagcagctcatgtgctccgttcttcaccttcagcatgcccacttcatcctgaaactctcttctacccaccacctcatctccagatgcagatcctaatgtcccagacaggactgttggcaggttccaagtcaagtgaaggataattcaagagccacagtccaatagtgcaggagccatatctgctctatttgccattgtatacccaatccttcacatagtacctggcacataggaggtactccataattctgtgacggttgttgaatgaatgcatggattttgcataactattcaggcaagagcttagcttctatagagaatttggtcatgattggattcatttgatcagtggaagcagccattccagtttactatagaagtaacattccagttactatagaagtagatttagaacctaatttggcctattggctacaaaaagggtacagactctgagttgtagtgagactgccagtctacctgcaggtcgatgagggctcctccatcctccctgggctgagatttaatagtgcctctttttgctcagcctgctctctaatcctcagggtgagagatcagtatgaactgacaggtctgagaaatcttcctaggggaggaagaagggtttccagctgcaaggagagagcagcgtgcagtgacagtgaggcaccaggatgtagaacaatgctgccagaacatattccctgaggtttgggaatgaacttcttcaagggctgtgctccctttttgatgggtcctagtgggcctctgtgctggtcgtgaccgacttttcttcaatgatccagtggaggctgcaatgtattttgcttaaaactacagctggtttataattttggcctcagacagtaattacagctgctggggctccttggagagataattacggaaagaattcagcatattcattttatctacacacttaaccatcaattaaatcattaccatctaatcctattccagagtctagaaatgttctgtgaatatataattttgaaggcactgaagtttgttttcagatggttttaagtgaaaaattgcccaatttccatagccaatggaggctttctctatgaaagcagagccgagagtatctcctggcttgtggttgctgcctccctgggggcctgcaccacataaagggccaagcaggaatggattgataggcgggagctgggactttgcctttgatctcccatggagtttgtgattttccaaagcaggattagcactgggacttagaggtcagtggctggagacagacaagagggtggcttgttttgccaaggagcttccaggagagtcttcccctgctgggattctgctagggccctgggctgtcatccacttatcaaagtcaggatggggtcttttcactttgggaacccaggagagagtgtggtatttaaaagcatgagtgctggagctggcttcactttctggctttgccatttttgagttgtgtgtccttgagcaagtttctaaattcctctaaacctcaggttattccactctttagcaacacaacaatagatcctacctcacagagctgtgtgagacttaaatgaaaaaatgaatgtaacatgtttaacacagcatctggaacttaatggatgctaggtaaactttgataattgatattattcaacatacatgtatgtacaagaaaaggagagaggcagaagggagaaatcaaatgtccaaaaatgtgcttcagcgggaaccagggcctctgaaagcatatgtggcatgggctgggactgcccctgggcttcactgtccagccttggactccacggctgctctctgctctctctgaccttgacttcccttggggatggtcgcctgggaacctctgactgcagtccccctctgtacccctcctccctgaccctaccctctcatggctccagcctggtgctcctccaaaaaccttgctgcactgctggtaccctgaatatgcctgttctcctcctacacttccaaccatccttttctctctttctcatgggctttcgctggctgacggtgggatatagtcatgcctcaagtttctgacctaagtcactttttgtttttttctacaccacacaaagcagcatctgggaagacggcccacagggatgcaactgcttcctggcctctttcagccagggaggcaatttttctaatagacaggagtcttgggctgaatcctcttcagactgttcctaacactggaatcccagaggcactgtctatacagtggggccctgaggaagtctcctctttgtgagctgactcttccagatggctgcactagtcctctggccagtgtttgggctcagacaatcctaccctactgtacacggtacgtggctcctgtgctgaagttactaaaaagcccagctcttgtagctggcatagaactggtcacaaggctggcttttgccctggcataagccgcgtctatgtgggagccccaagctgggaaccagccccaggcacagcatcaagtccacgtggcagacttgcctgaaaaacacccacttgaccttatagttgtgcctatcaccgagccaagggctgcaaaggaaatgaaaagctcccaactgctgaaatcatggagctggaatatcaagtctctatgttcaaggataatcatggttatcgttggaaggactgtacagtgaagattaatttttaacctcctctgagagttgtaagaattaaataagttaataaatgcagaacacttacaagagtgcctagtacctaatgtgtgctcaatggatattagctattattagtatcattattattaaaggagaaaccaggcttcatgaggtttatggagtcttggccagaaacactgattctcctgctttgagaactctcaggagggcttactcttgggctggtcctcctgtccagtgatctccagagccagtgacaacatgacaacttcctgatcccaaacattagcatgtggtataccacaggtaccacaggatggtcttttaggaacgtagatcctagcacttcccagagcaagggaagaaaaagccctccctggccatcccccccagcctctctgccttgattccctcaaggggaagcaggaggggatgcccacaagctccctctccagaggcggaagaccaataccctcatttctccttgcttctcctcccctcctcctggagaatgtgggtaggtggttcctgccctgccctttctgtctgtgagcccactttggtccctggtcagctccgcaggcctcctgcaatcactgctgaatcatgaatgatccactgggcagtgaggacccaatccctgaggggagcttgggagagaagcatgggacacatcagcatcgccagggctgtccacctcagggcccagaggcatacatcctggtgcccttttgcttcactatttgcagtttggcaacatggaagtgtgtgtgtctgcagagctggtgaggtcactctgtctgatgcaccactaaagctttccaatgttctggaagtgtctgattcggggtctgatcaatcttgccctcatatcgctgattctctgagcagggacagatgtggccaccttcctgtaccatagtgaatacctcagggaactgcctgcccccttcatgactcaccctggtacctcaccccaattctccatctttctctctggctctccgtggcttccttttataggttagaacccaagttccttagagggcacacagaggccttcacaacctgacccctctctatctggaggcacagcccatcactgcttttgaacattttatgccccggccccagcacacaggccacttctagtaccctggcaacactgctctgtggtgccactttgcttttgctcatgctgttctctttgtctgcgatagctacacaaagctccctcacaaacattcacttccttcgaactcaacatacagataaacttttctctgtatatatatctttgtgatagctcccacaatcctattttgtaattttgtgttggttttactgaatcaactatgagttccctgagaacagatactgtatctcattcatctctgaatcctgaggccatacagataaccttttctctgtatatatatctttgtgatagctcccataatgctattttgtaattttgtgttggttttcctgaatcaactatgagttccctgagaacagatactgtatctcattcatctctgaatcctgaggccattgtgtaggccccagcgtacaactaggtgcccagtgttggctgaatgagagcaagagggtgggttcagcttctcatttgctcagcatgaagtgtgcaaattccttcctgactcagaaattagggatccttcattgacagtcattgtatggtttcagaagattgcacgttcaaatgtctacactcgaaaaagctgaatgaaaaacaccctcaccaacagcatctcatgttttgcctaacagcatgagctctgcctctctgtaggggctttaagcaaagccttgacagtctgcaaggagagaatagccatggggctcggggtcccgtgaactttgggatatttcacaaatatcctaaatattgttgagacagtctagtgactttgtgaaactgaggagaaatggggaggccttctctccgaagggcttcagagccatctggttctatctgggatttattctgaatgcagcctttacagtgagagggcgccacactcaggtgcagggatctggcttgagacttggggaaaacatcattgcctttgatggcgcctgctaaaagcagtgtggacacagacacctcatgcacatcttctccgttcagggctccaaatccctgctgcggctcgcctcaaggcggaacggggtagcagcacacacctcctgttccaaggaagacagcatctgctgtgagtgtgccgctttagcaagatgactgtgctttattgattgcaatttcatgctgcgattatgcacgtcaatctacgctgaaaatggcaactgtgccccctgcatctccgatgttgtgtggtgtgtggttctgttttccagacatactgaaatagtttgaaaaagtggcaaaacctgctctacagagcaaaaagaattatcttaaaataactcacttttcataggccttcaaacgtcattctttagcagggcccaatgagtgaggggcagggtctctacagcttccccagagacctgaacccctcttttcagtcgtggcttcacggtggatgggtcatcactaaggatgagaaggctgccaggcccagttgactggggtggggcagattcagggcttgaggtggaaaggaaaactgggagcagcaggggcttagtcttcacagaatgaaggagggtggccaagggtgttgctgatggaaccagggaggagaagccaagactcagagggttataagaaagtggaggagcaaaggcatcaaggagcaaaagaggtcaggcatggtggctcacacctgtaatcccagcgctttgggaggccaaggtgggcggatcacttgaaatcaggagtttgagaccagcctagacaacatggcaaaaccctgtctctactaaaaatacaaaaattaaccgggcatggtggtggatgcctataatcccagctactcaggaggctgaggcacgagaattgcttgaacccaggaggcaacagttgcagtgagccagcctgggcaacagagtgagactccacctcaaaaaaaaaaaaaaaaaaaaaaaaaaaatggagcaaaagcgacaaccttgccaggccaccctgaggtgcatagatgcatggaatgtgagggactaagtggcctcttgagagtgctacaaagaaagtgttgtgacttcaaaagagaaccaggattcagttgaagtgagaaagtggatagaaagtttacatgaaggattaaggatgtaggggaggtaggtgtggagcaccagaggaaggctggagacagtggaagtgggggctggtttggagaaggggaagtacagggcaggatatgatgacagtagggacaagaaaagcaactggactgggggtgtggaaagcacagcctgccaggtttgatctcaaggggcaaagtctgcttcacccacaggaagcaaggtgaccaggctatcctagaaaataaagccacagccatcctcagaccagctgttctcctagagttgtttgagagagggcctgaactgtctctcctcatgtacccatttattcgtccattccccagtgtttgtgagcattgggtctggtgggcccctgctcttcccaccaccttaaaccctctcctgcctgcccaactaccaccccctcccctgtgcccagctaacttctcaactcctgtctgccttctccccgatgccagtcattgcccgcctcccaagcaggcatgctttgcctgtaatatgatccctccgatgaataataatccaatgttacattttctactctatccagaccactgtgctcagtgctgtacaggcatccccagtttaactctcaccctgtgaagtaaacagttttgtctccccagataaaagaagctgaggcttaactaatttatccaacatcatgaggcaaataactggccgagctatcagattaaggtagatggtattatttcttcatggttatatgccccagcacactcttgtcagggtcttgactccaatgacttaggactcgggcctgggatttgcttcaatcaatagaatatgaaaggatgacaacatgccagttccacatgtttctactcacccccttgaacttttagcatctgtcatgggaataacatgcgctggaagacgggggcttcttcagctcggtcctggaacaagaagacgcagaagtagatttctacctgtctggcagagctgcagccaaccacaaactcatcagcaagaaattagtgtgtattgttgtaagcaactaagatttggagttgttattgtaagaaaagctgacaaaatacagatttaaactcacagtgttcctccatctctgcctgttggacatagctaccaagcttatttgggtccaaatgcggacttacttctctccacctgttaggaaaggctttctctcttcattattttatcatcaagatgaatctcacaacctactggaattccagtttaacttttcttttccttctcttgccctctccctggaaaaagttttacacatgccgacacatgtcagcaaacctctcaacctcacatctgtgctggtcaagcggctttgaagacacagctataccagtcagagcacaatcagtttctgacatggtcagtgtcgggatcacacagtaatgctggttttaaaagacttttctttctcagctgttattattcagctcacttaacaattaaaactagaacaatgccttagaatttttaagaaaattcttttgtttccatcctgctggcaccgattcatcatcctttatgacttcacattcccaaatgatttgtgatgtaggttttttgctaatgtactttcagttgttttgcttctgatgtttcctccccacctaatcaaatgcttcaaaataaccataatttctaaacccagtaggacataggacatgcactgaataatatgcactaaaatttattaacagaaagccctttgtttttaaaactctgaaagctaatggaatactcttttttactttagaaggcatgctgtgttctgtgtggttttcccacagatgtgtttttaaatgttgcattctgttaagactaaatgttgtatttgcaaagattttactcccccaaagcagaacataatttccctcgctatcttagcttgaaaaggcctgaagtgaaaatgtatgactttgcttatgcagcttttcttctcctcttcagataaaagaaccacattttcctttgaggactcacccctcttccccctctaaccatgtggtttgggtagaggcatccacatcctcagctccaggaatgtctttgcatctccccaggcttaagcccaatcatcacattcagggattggttcggggtgagtgtgtgacccaatttaggcccaggaattttgttggaactatccggaaaagtcacatctttccactggacttgaagctgtgaggatgcaaatgtggggttgttggctgctatctcaccatcaaaataatagagtgcactccgggatggagtgaaacaaaagaaagcatacttgagaagtagagaaggtgataatgagtcctgatgacactgtctgaacctctggatccagctgtgcctgaaactgttccttgcaagggactagcatgtacctcatgaccgacaacaacaaatctgacattgctgctggttggattccaactctagagaaagagatagctagaaaattagtctgcacacacaaaagcagagaaaaaatacacaaaatacccagtggttaattttaaaatgtgaatgagcaatcaagggtcactaagtaagacagaactgacagcattaatagaggtttatatttaaaacacacacacacacacacacacacacacactgaggaaaaacaaacaatgataagaaatcaaattcaagtgtaaaataaatcaaaagtatagtaatcttaagtaattaacatgtagaaaatctactcacaagcacttctgcttgttgccacattggcctcaagtattagataagaatgtcctggctcccagaggccttctcactcctgattctgttccctgcagttctcctcactcagaaaagctgctctctgactctgtccactgcttctttcccacagaggtgtaggtacgtaagttggggccatttcaaaggcaatcttctctcatcctcttgtgcaatgtcttgagaggctgctctgaagaagttctaatttttgacaaagttttgcttctatacggtcaaaatgatctcactggggtttccacatgttgctcctggtctgtccattaggacagctctgaacgtccccttcccttccagagtgcttttgtttttatttttgccttacccatactcctttcagagagactggtccttagagcagaacataaattccatacaagatagcaatggagccagttgcccagagagctttgaacgggacagttatcacaccctgagtcaagtagaatgctttgggcttctaggaacagaaaacctaacccaaactcctttttatgaggtgaggttttgctcttgttgcgtaggctggagtgcaatgatgcgatctcggctcaccacaacctccgcctcctgggttcaaatgattctcctgcctcagcctcccgagtagctgggattacagtcatgcaccaccacgcccagctaattttgtatttttagtagagacggggtttcttcatgttggtcaggctgctcccgaactcccgacctgagatgatccccctgcctcggcctcccaaagtgctgggattacaggtgtgagccaccgcgcccggccctgaaactcctttaaagaataaaatgaggccgggcaccgtggctcatgcctgtaatcccagcactttgggtgcctaaggcggatggattgcttgagctcaggagttctagaccagcctgggagacatactgagacctccgtctttacaaatataacaaaaattagccaggcatggtggcgtgcccactatggggaggagtgggtactgtcagtacaagctgggaagatactccaaagtgtttctgtaacccctaggagccagccattggcttatctatcatcagttcccatgaccatcttcagttgtcctggtctctagcatgcacacattcattcagccagtgtttactgagccccgccatatgccacatgctattcccaacactgggaataaggtgttgagcaaggcagtgagtggggacccctgtgccgtggaggttgcattctggtggagggagacaggcaaattgcatacagttgaacagaaaataggtcatcacaagctggacgatgcaaatacaaaggcaagatgtgacagcagtgatggggcactcctttgtgctgggtggctggggaaggccctgagaaaatgacactttccctgactgaccagaagcagacagccaagcagaggcctgagaagtgcatttccatcacagagcagatggccagcatgcatctctggagcaaggaccagcgtggcctgtccagaagtagagaggaggcaggtgtggccaggaccatgagcaacgagaggtagagttgtaggagaggaggccgaaagggagtcaggccagggcgcagagggcatggcccctaagttcagatctcagtcgccctcctcaggagcaccagggaagaggccttaagcccagtctccttcagcaggcaccctctgtggtctcctcttgtttgacaggccagaggctcccagctggccaagagggctcagcttccccacagggcaggataccaatccctaagtccaggtgagtcgccccttttctgacattgctgctccccagtcacttttctttcctttccttgctacctacctgatttccagcccttgatgagagtccaagcctccagctcccagaatcacccttcattttaatactcaaataccctgagtccccaccctttctctctagcccttagttgatgtcttcctcccatttgtctctgcagtggcctgaggaatggtcttttttgcatctcatgattccagatgatgcttaccatttccgctctctgctgcactccaggcttctctacagccatctttagaggccttcagctgcttctcccagccaccatcttctccctgccctatccccacatcctatcccaagcacggacacagtccctttccccattcccccaaagcatgcaaatgccagactatagcatttaatgaagatttcctaagggctggggataacacgagtgaagacaatgcgagtaactgaaattaaaaattctatagccagggaaagaaacatccatctaatatcataattgtctctgccaataggaaactgcctacggggaacacattttacattgttatgcagaataacacagcctctcattctgagattggacctgggcattacctttaataacctaaggcccctgatacctccccaaagagctgtttccccagcaccccaacacactgtcttgcaggtggtttcttcactagggtgccaggatgaggagatgtgtgaagctaaagtcagctcaaagtcagctttctctccactcaccaagtggtgagtttgcctggaggaggcttctgtttctaagtcacacaaaggcccaatgctaacagcatggctgagagatacatgccgtggcctactatcagccacagtgtatagaggacagcagatacacagatgagagaaaacgaattcagctaataggttttatttgttttgacattgtgagtatctttgagatgaaaagctaatagttggaatagtgccaaaaatcttaatattattaataacatatcaataaaagcctctaaacctttaaggataaaagaaagtttcttatcttgtatcctcttttcaaacacatttaagggcctttgtttctgtctctttcactgagaaaaaaaaagcaagctgcaagacaatacattttctaaaattagcacacatttaattgacttttcaaaatgaagttctattcaacctattagatgtgtatattccatacaacattccaatgtttaagctatttttttttttttttttgagacagattcttgctctgtcatccaggctggactgcagtggcgccatctcggctcactgcagcctctgcctcctgggctcaagcgattctcctacctcagcctcccaagtagctgggactacaggcacccgccaccacgcctggttaatttttgtattttttttttttgtagagatggggttttaccatgttgcccaggctggtcctgtactcctggatccaagtgatccacccacctcggcctcccaaagttctgggatttagacatgagccattgtccctggctcatttaagctaattctgagactttttcccaaatacagaaaaacacatctgtaaatcaccattggagaaagaaaggagaacgtgaaggtcctgggaaaggggtgaaggcccctgcttgaggacttcatggggttggtacttagtccctcatggtatcacaataggctatgcattctacagctgctctttgtgacctgtgtaaattctgggcaaaaatggcctttccctgggtcatgtctgctaaagcaagtatcaccatccagtcagatggggctgatcccagcaggtgcccaagaaggaagtcacccactgtctaaaagtcctacataatcctcagggttcattttaggtgccacctcctccatgaagtttctagtgagcaatgccccatttggaatgaagtactcccttaatagtttgattgtatttagattgtatttgattatacatttaccacttaccacctctcatttttattttgtagttagttggatacatctgtcttctctcctgatgtgaactctttaggtctggggcatagggtctgtcagtacccactaaattgactatttttagttgatttggacttactgcagaccttttactaaacatggcaattgagcttttgctctctgatcatggagaagtttccagtatgcaatagtcaggaggcaggagggggctggtcagtgtgtaagtactcaagggaggattaaaacaaggtacagtctgcacacagctcctcacagtgggtggaggcacccagaggagagaggcaagctgcctgcacatgcagcaggctggttacacctccctccagtgtcttccccatgtcaggcaaatgagagctagaggaccttgggatcttgctctttagccagaaaatggccaccctccataagtggtaatggtgatatcctgaaatcaagttcacaggtgaacagatctaatgtccattttattgttcactaaagtttagggtcagttgagagtgggtgataaatatatgactcttcattcattatctctttggtatttatatttttgacttattttttcagaactccattggtccctattcaggaaatgctaaatttaaacagccccgtcctgttttgggaccagccacctagagttctcaagtgctaaaggcaacgacctccttcccatcctcactcaccagtaattccacagggccaggctcagtgagatctgtcaaggcaagaggggtgcttcagctgatcccatactatcactcaattctggttttctgactctcttatttgttttcaatccaacctctacactccttcaagtactaaagtacaaatctgagcatgtaactctcccacttaaaaatccttcaataactgcccttcattctgaacaagatcaagatcgagttccctaccttggcattcaaggtcctctgcgaccctgcctccatctcctccttatactttatgttggggccacacctaatggctggtggttcacacagtgctttctattcacccccatgcccttgcttctgctttaactttttcttgtgctgtcctttcaacccctcttttcctgcctagatccagcctgtctttttagcatctaatcagttgtcagcttcttcaggaagcattctgaagatcctgtggtatgagctaaatgcttctcgtctgtgctatcctctcctagcaccctgtgcctgcccctgacatagcatttggtgccacttgatattatctgtgtgtgtgtcatccccagcacctcccactgctccttgagaatgggcctaagtgttattcatcattgtataacaagcacctggcaaaatgcctggcacaaagtcagcattgaataagttcttgttggacagaatttcaatttcttctatcttacaacttgtaaaatgatttttacaagttttacttactgatttcttagataaattctccatgtcaatttttcttcaaatctacaggcatagtggttctattaatgcaccaaagcaactgagagctagctctgaatgccaaagagccaggcaacacccatgagaatgaagacagtggcagtgaaggtcccagtcatcatctcagatggatttgcagtgtcatgagggctcaaacagttctcataaaggtctttataagagacttaccttagtttaaaaggcaggttgggaaacccatgaccatttcctccagaaagcacagaattcctgcaagcctggggtcactattttggctgccatgctgtcagcttatcccagcaatctttcaaggtgcttcactgtatggcatcatttgctgtattgtaagaattctgttcaagtaagaatcaatcaagcttcctttgaaacaatcactttgcataaggaaatgggagtttcaaggatgtatttatttgttcaacaaatattgattgaatacctactataggtgctgaagatacatttttagggacaaaatagtcaaaaatctttgctctagtgaaacttgactagtgggagacacagatgtattatgttatagtgaaggtaaatgctatgaagaataaaatagggccgggtgcggtggcgcacacctgtaatcccagcgctttgggaggctgtgatgggcggatcacctgaggtcaggagttcgagactagactgaccaacatggcaaaaccccttctctactaaaagtacaaaaattagccgggcatggtggcggtcgcctgtaatcccagccactcaaaaggctgaggcaggagagtcacttgaacctgggaggcagaggttgcagtgagccgagatcatgctactgcactccagcctgggcaacaagagtgagactccatctcaaaaaaattaattaattaatttaatttaatagagcaagcaatggggatcagaagtgtgacatagattgtttactttttacagggggttaattttaatggaggtaattgtagggctcacaaacaattgcaatatttgagcaaacacttgaaggaggtgagggagcaagccctgtggccatgcagaaatacacgctaagggaacggccaatacaaaggccttaaggaggttcacacgaggatagtgaggagagtaatgtgggggatgcaggagagaaaaaagagagagaagtaggggatgagatcagaaaggtaacagcgggcagagctcaggtaactggaacccagtagagcttcaaaagtactttggctcattcgccaacatggcaatttttaagagagatgtgacatgatccaaagttatcactgatctctctgctgctgtgttgagaatagactagataatgacaaggttggacgtgagaatacccattaggagtctactgctataatctagatggcaataacagaggcttggacagtgtagaagcaaggaacatggtgagaaatggttacattctgggtatattttgaagggagacccaatagggttttctgtagggtatgagagagaaaagtaaaggatgattccaaggttgaccgtggaaagatagagctgccattaagtgagctcaggaagactgcaggtagagcacctatgtgggatgatcaggagttagacctaataggtttgaagcaactattggatatccataggaaaacataaaatagcagttagatgcaggaatctagagttccagagaaagatcaggctgtaaaaatggatgagatgtaaatggtaaagagaagaggtcccaggactaagaactgggacattctatttaaaggtaaagaaaagaagagaaaccgatagactgagaaggagcaagtcattgaagtagtaagaaaaccaagagggtttggtatcctagaaggcaagaaagaaattgtttccaggaagagggaatgcccagatgtgacaaataagatgtaaataaaatgaagattaagaactgacattgggtttaccaatgtgctggatattggtggggtactggtttgaatagtgtcctcccaaaatttacatctacctagaacctcagaatgtcaccttatttggaaataaggtctttgcaggcatgttaagatgagcttatgctggatcagggtaggcaccaaatcccatgactagtgtccttataggaaagccatataaagacctagagggacatacaggagactgccatgtgacaatggaggcaggaattggagtgatgcagctataagcgaaggattgctggcaaccactaagagctaggaagaggcagggaagacttctccccaagagctttcagagaaagcatgggcccactggtaccttgacttcagacttctagcctctagaactgtgagacaataaagttctgttattttcagccatccagtttgtgatacgtcattatggcaaccctaagaaactaacacacttgacgaagcagtcactaacttgtctgtaccttgattttctcatctgtagaacaggaataaaagtacctgcctcagaggattgtggtaaggattaataatatatctaatattcttataatagtacataccaaattctacataatgttaactgttataatgattatagatctaataattctgttttgaaataaaaacacttttttcacttgttctttgctaaattctcattagcttattaatttgacagattaaattttcctaaacttttaaacaccaattttacgtttaatcaaattctcttaaatatttttaaatgagaaaaaagatataaatctagtgagtaaaattctcctaaatttttaagcattgtttaagcaattgattaactacatttctgtgaatatttcaagctaaaatcacaaatttaaaatgtgattatattaaacactccaaacatctaatgcaggtgttaaacaaaattgttctcaatcatgtaactcttataatgctaacaaataaaatcttatacatttaggtgaaatgatgttaagcatttcaatatcttaaaaataagctttataaatgtagtataatagattttcctaagcatttaaatggtgactataaatttaactagttaagttattctaaatatgtccattaaaatcatgaatcttataattttctagtgtatcagattgttaagcatttagcttaaaaacaaaaattgggataacaacatgtgtattgcacttgaataaataaagtttacacaaaagcatcatttataattcttatttgttaaccctttctgtgtcacagttactcttctaattactaggaacacaatgatcagtttaggagctctttctaggaattgaaattacagagatgaccagagatttgagtcccaaattgcagaggtagaataaccgtgcacagacatgggatggggcattggttgcctcacaggggaattttaccagagctatgaattaataaggcaagtttcttcttctggttggcttctgcttgctgtactgtcagtgggagacaatcctaggctttttaatggaattttattttataacccagtgcatcacatatatcctaggaatctttccaatttcacccttatcgaatttttgttataacttttatcattcctattccgtgatttgggtagatggaattatggacacacacactcacacatagtagtcacagagcttcctgctgagacgtccttttattctgtgttccttctcttcatccttgattctatagtcttcttttgaccacactgagcccttcaagaatagaatgtgcattatttatctttgtgttttgtttgtttgttttttgagagggagtctggctctgtcacccaggctggagggcagtggcatgatctcggctcacagcaacctccacctcccaggttcaagtgattctcctgcctcagcctcccaagtagctgggactacaggcacccaccactacacccagctaatttttgtatttttagtagagacgaggtttcaccatgttgaccaggctggtctcgaactcctaacctcaggtgatccatccgccttggccttccaaagtgctgggattacaggcgtgagccacagcgctgagcataactttgttttcttagggctcagcacaaatgcccggtgctcaataaatgtttgttgaatgatgaatacatgtaatgaatattaatttgaagtaacagactccaaacatcctccactttacttcatcaggtagagtaattttggccctatagtaatttcctatcttgccacctcatcgaaaaatatgacagtccttgtcttaccttctgaatggtgccttcactgtagcctttgcttcttgattgtttctaatgagcccctctcagtaaataacaatctacatgtcacacatgccacgcaccatttgccacctttcccctcaaggtctacttgacggtgaatcttaacacactctcctgtgaagtctggactgttcagaattcatttctggactaagaatcctttctagaaaggtgctgtagtggagttaccattcaaagcacaataatttaccattctgggcatagcacttaagagcatacattttaatccataaaagcatggtggcagattctggctctgccatttactacctttattatttggcctttttcagactcagttacctcactgtgaaactgtaattgtaatatctatcacagagggttaaggtgaggcatgaatgagataaggtatgcaaagctcttaggatagagctagtgcttaagcactcaataaatagtagttgttgcccaaatggaccctttcatttttccatgctactggcccaatctcctgaaaggcagtatagtcacattcatactgctttatttctttaacatacttgttcttaaagccgagagaggaagtaaaaaaaaaatagaatgtcctctttacagaaagaagctaatcagattgtaaactggcagcgcgtgataatttttcatatatttgtaaagctgtgctaagcaacagtcaacaaaatcagattctaaaccagcagagcatgatgaatcttcatatatttgcaaagctgtggtaagcaataaatagtcaacaaaatcctgagatttttgtgctttttaaataaaattttaaatgtaaatttaacaatattaagtacataataagattaaatcatgtaataagaatcacttccatttttgacaagcttcttagttcagagcccttaggtacttcctgtaataaagtcccattttcagattcacagagagatattatctaatgtttcactctgtcttttcatgttcttaatttggggtctgtttcaatggcctgtctcatatcagctgtcatttttgtgatcgaaatgtcacttcacattacagttttcattaggacagttctcatctttggtttcaattcaatttaattcaaattagatccttatgtctcaggacaattgaattcacttacaatcttctctgttcagataggattgtaaccactacttcctgttgatactactggagttgttggtaccttctaaacccctggtactgcctgggagcccaccaggtctcataacaaggacactgctgcttctgcccatggaaatggggctggcaccagcactggaaccagccaagctagcattatgctcaacagttattaaaccaccgttactgtctccggtgttgatgactgagtctctaccaccttcctctcaacaaaatcccactgggtcaatgcttttctgaattatggaaaaatctttcttttctcacattttgttttatacaatttttggctgaaaaacagctcactaggttataggagtttggaaaggtgtaatttgcttattttgtttgatttggttgagattttctagtcttcccccaacagaagccagacaaaagggggctgaacaacaacagcaaaatttactcatgtcttctcctgagacaactttttcagaactgacttgtatgcttgactttccctagaataagtttgttttcaagaggcttttcttgcaatattgctggtagcaatgaccctatcacgacaccagatgtattgaaactccttaatcctgtcatcttgtgggcttggtcccagctcacaagcattctaggaccttagtggcgctgtccagaagaggaaaagattcagagcccagaaaactcacccaagtgaagggctgcaccttaagaagggggagaccagtaggctgcaccgccgtatttccagaggctgaccttgattctggctaattacacacacaaggaaattcaccaaatgagcaaaacccagctatggagttcaggtgggagctgtgctatgacttggccattggcaacaatgccaatgctagtggtatccctgggtatggggactggtaaaaaaaattggctaaggttgcagcctagccctctaagcaggctttagacaggccataagaaatcaggtacagaggtggtccctaaggctgggtactttgggagagctaaacccaaagcattctgaaggaactgcttaaatgaagaggtaaaattaggtcataatagggaaaaatgaggttgtgcacagaactgtgggggcaaacaagatacatatgcatgtcactagctgggggaatccagagaaatgggataagcagctaggaaaccataagtgggatgtggcacctgctgtatgctactagtttggactagggttcttaaaggaagctcatctggctagatttagggagtctagaaagccaaggcagataaagtacttttaatacatcagaaatgtagactggacctacagagggaattgacataattgctaaagcttggactttgaaattggaagtcttgggtttaaatctcagctctgacacttagtcacagtgtggccttgtgcaaattagtgtctctacaacgctgcatcctccattaaagaaccccacggggtcttttaagaacttgtaaagtccatatcccagtgcctggcatacaataagtacccaaaaatgaaggaatatgggctgataccatcacaactaattccagaccacattcattggtgacactgagcctgttaacaatttgctttctctgatgggaaggaactcaggaattggcaaactgatatgggtatgggtttcacagttgaaagagcggctagggaaccacgggcctgatgtagatggtggcttagaaagtagagctattcggggccaggcgcggtggctcacgcctgtaatcccagtactttgggaggccgaggcgggcggatcacgaggtcaggagatcaagaccatcatggctaacacagtgaaaccccgtctctactaaaaatacaaaaaaaaaaaattagccgggcgtggtggcgggcgcctgtagtcccagctactcaggaggctgaggcaggagaatggcatgaacccgggaggtggagcttgcagtgagtcgagattgcgccactgcactccagcctggggacagagcaagactccatctcaaaaaaaacgaaagtagagctatttggatggtgctccagggtagcagctgatctggcaaactgatatttgaaccacaatattaagacaaatatcattcagtctttcttcctagacacagaaacaaagacccctttcccagagatgtgtgtgtgtgcccacacacatgcacacacttcaaagccacgggtcacaatcaaacgtggtttccctttgcagtgaacacactggcttttaatactttccttaagtaagttatagcctcacatgtgaacttttgatctctgaaatgaagtccataaatttcattgtcagaatggttgctactcttttatagtttacgtgtaaattttgttattcctatatccatagaagtcacttcagttttttctctctatggccacagtattactacatttaatctgtgctggaaggtgccctgagtttaaattaagttgaatgctgggctgagtgtgaaacacaagagatactgctagtctaagtctggggcttccttaagagagcccctccttcacatctcggaaacaaggaatgatgttgcaccactcagacctcatctttccatcccagctgtattagtccattttcacgctgctgacaaagacatatccgagagtgggaagaaaaagaggtttaactggacttacagttccacatggctggggaggcctcagaatcatggcaggaggcaaaaggcacttcttacatggcagcagcaagagaaaatgaggaagaagcaaaagcagaaacccctgataaacccatcagatctcgtgagacttattcactatcacaagaacagcacggggaagaccggcccccatgattcaattacctcccctgccgggtcccttcccacaacacgtgggaagtctgggaggtacaactcaagttgagatttgggtgggggcacaactaaatcatatcaccagccttacctccgaccacttcattcctcacactacagtccagtcacaccaaattgtgatgattccttcaatgcaccatgccctttattgcattctgcctttgcacagtctctttcctctaccccaagtgacccttcttctttccagagggattcctcttcagcctaaatggcttagctcaagactcatcaatcagaatgctctctatagacctcctcaatccctttgaagttactttctcccttcccattgcccctgcagtattctatgcagcttctcacatcataatatctccatctgtgagccctttgaaagcagggggagtgtcctacttatgggcttagtatccccagcatctattaccatgcctggcacttgtttggtgcacattaaaaatgtatgaatgggccaggcacagtgactcacgcctgtaatcccaccactttgggaggccgaggcaggcagatcacaaggtcaggagttcgagcccagcctggccaacatggtgacaccctgtctctactaaaaatacaaaaattagccaggtgtggcggcgggcacctgtaatcccagctacttgggaggctgaggcaggagaattgcttgaacccaggaggcggaggttgcagtgagccaagatcgcgccactgcactccagcctgggtgacagagcaagactctgtctcaaaaaaaaaaaaaaaagaaaaaaaatgtatgaatgaaagccaaattatttttttgttttttcttcctgcagaaacgatgaccatgggtaagaggactgcttgtgccaaggacaaaataggacaaccatctcacaaagatcttaagtaactttttccatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttgaaaaactccaaccttgtcttatttaacttgggggaaggggattctccaatgtcttttccaggataaagaaggaaattaaaataccatgaaaaaatggacatggcagtagaaaggaaacattctgatcagaccttgggaaaagctggtgccgagagagggagaggccaggtgtccccccacccaactggcactgattctcagccccttcctcttacttctgttggcttcaaggagacctgcccttgatgtgtgttgctgctgaagcaccctcccagccagtgagttggacatatgcagcaggcactttgatgtccaggaagtacactggtacatgacaggagcaagggtcagggaggggaggggaaaggtttctacaatgcagatgttttcaaaattctccaacaatcatgactctaaatggtatgatttagggctgggtgcagtgactcacacctgtaatctcagcactttgggaggccaaggcgggaggatcacttgataccagaagttcaagaccagtctggcaacatggagagaccaccatctaatttcaaaagagaccccccgcccccccggctaatttttaaaaaattagcaatgtacctgtagtcccagctacttaggaagctgagataggagaatcgcctgagtccaagagcttgaggctacagcgagccaagattgcaacactgcatttcagcctgggtgacagagcaaggccctgtctctctaaaaaagaaaaaaaaaaggtattgtttagttcacatggccatcagtagaactacatttcatatgatgagaagaaaataattatttattttacacttgagtcagggagactgacaaaggataggtatggaaaatggcttgctattttcatggccaccctgtcctgcaatgcggggggtgggaggggggacattccaatgacttactgctgcatgacaaagcaccaaaacatagtggcttaaatagaaatatattgtctctcatgattatctgagttgactgagcttagttgatgctctcccctgcagtctcatggttgctctcagatggcatctggggctggcatcatctgaatgcctgcctcggatggatgtccataatggcttcttcactcacatctggctctggaattgagataactggaacagctgcagaatggctggacatctctctccacatagtctctccatatggttagttcgggcttcctcaccacagggacatctcaagatagtgttctgataaagtgactggcttcctccagagctagcattgcaagtggtccagctagatgctacaaggttctgttaagtaagttctaaaggaacctagagtcatttctgccacatactagggtcaagagcaagtcataatcttgaatcagcccagattcaacgggaaagaaattacacaagaatggaatacgagaaggtgtggctcatcagggccatctttggagaaagtggggatgggagtgggagtggggaggttaatgagttaaagggcttcctaggtagctgtcattttaaaagcacatcgaatgctcaacacacatggagaatgcaatgagtaataaggggtagagaagaagggaagagctaaactggacagttaaacagtataagctaaagaaaagcaaccgattctgactgatacagtgcttatgaactttcaatgaaaacaattttatgcaaagtaatttaatgaactgagaaaaggacactaatatggatgtgaatatagccaaaaacaatgtctactgcctgtatgtggctcctgataattctgcaggccacttagctgcccctggccacccacttcactgatagccacctgggactattgagggtgtctagcttaggagtgcccagcctctggtattgccattcaaactcaacccagagaagaaggctcacctgttgcttactgtgcccttccacatccttacaaagagtatctctctcacacaggagtcctgagttggttgctggcacagaccacaaccagaggctgagtggccagtgaaactcctctgagactcaggttttctctctaatgggaattcctgactcttccttcttcagtcctctctcgggaccaaagaggaaggacacccctcagtatcctttggcaatcaccgtggacacttccgcagctatagaggtgttgctttgggatcatctaagacagagtcaagcctttggcaatgttcaggaaatgctggtatgtctctgagatcagctttcaagaggagaggcatgttatgaatggggcctttctgggatagcatacactattctttgttcgttctttctttctttcttttttttttttttttttttttgagatggattttcgctccacttcaggctggagtgcagtggcacaatctcggctcactgcaacctccgcctcccaggttcaagcaattctcctgcctcagcctcctgaatagctgggattacaggcgcccaccaccacacccagctaatttttgtgtatttttagtagagacagggttttgccatgttggccaggctggcttcgaactcctgacctcaggtgatccacccgccttggccttcccaagtgttgggattacaggcatgagccaccacgcccagccccactattctactttctatcaagtgcattccaagataggctgaccttcatggaagaagtgaaatagaaaactgaggaaaagaaaataattggaaaaaaagtcccacaagtcaagaaagtaccccaaggaagacttacaggacaacttccaaggcaaatgggaaaagagaacattggcaatctaggagctgcaggagagagccctggtcttcatccctaagcccaggatgaatgtgaggcaaaaatagtctctgttcttttggaggaagaaaaagcgagtgagcaagcaagcaagagagagagaaagagatagagaaagaaagaaaaagagggagggaggaagggaaggaagggaaggaagggaaggaagggaaggaaggaaggaaggaaggaaggaaggaaggaaggaaggaaggaaggaaggaaggaaggagcaagctctgagcagtgccacagacctgcttccagtgtccctgatataaagctctctttgctcagtctcccaagagaacagatcaagcttctcccaaggactatggcaggaacccacttccttcttccactcaaaagacttgtcacttgctgctgggatccctgggcatatgggctgcaaaattcaactagctgcgtgatcacctctgtcacctcactccctggtgtcttcccacttgtgtccaggagctctgggcctgggaaggattaacaacaaagattaaagatggcccacaaggcctcagaggatcaggagccagccctgaagtccagaaattttgactaagcctctgtcattagggtctcccagctcatccataggctaatgccaaactttcacaacagctagtggttctcatgacacctcctcctggtagaaaggaaagaataagtcaaaaggacctgggccacagattctgtcctcttgagtcattgattttgcctccctaaactatatcttaagatagattactctgtgaaagctggatgaccattgccagacaatttaaaaagtatatatatcaatatgaaatggattgatgataatattgcatattatagtttatagcacatggatggtattgcttttatccattttctttattttttgaaaattgaatttgtgattttaaacattaaagataatagaaaaattaattttttggctcaatactagatttattatagctattattccaataatttattcattgaattaaagttatttcaaaaccatttgacataggaatattgatagtttttttttctaccaagtgaacatcatcttcaagacattcacacaatttagataaaattccttttgcacagcagctgtatccagaggcttgatcttggatttagatttaaatttatcaaagaaaggcagtttttaaaatttgcctaattcaaagctcaaagactaatgaaatcctttcttcaaatacctgaagacatttgtattcagggctctagagatgagcttatgaactctataaacaactggtaagtaaaccttccagaaacaagttttacctttatagcagtacccttctctgctggtaccaattatccctcctaaaggactacttctatgtgtgaagcctcagtgggacccattgcccctcagtgggccttttctggctttgaaaagaaaagaccccagcatggtcctcaagtcttctgatgtttatataaagacggcaggtccttgtagaagtgtttatataaattaggaaagattcccccacctaccttcaacttatgaccttctttgactccagggaacaaggaaaaatcactagtttgggaaaggtagctttcagtcttgaagctgtaattatacaggggttaatgactgggaaggaagattaaacttttactcactacttgaaattattctagtgcatgatctcacttctttgggttctaatcctaaattatttgccctattctggtagttggacatagtggtggagaccagctggctcctagaaagtacaaagggaactccacccagttaccaccaagcacagtgcaggttggagacagccttttcctgaggtggggctgaggacctgctctgccactgaccaatcctgtgatttccaggcctcaccttcctagacactctctgctgtcagggatcctgccagacacttgtcagcccctggtgcagccaggtcacggccatatctgagggataaacagcactgcacctgtgactatacttggcttctacccttctgggcttaagaggactttggcaatccccaaaggactcagacacagcatgaccatgggaaacccctgcctagaacttcctgccttggcccagcccatcactggtttttacataatggtgcttggcatttctaggccactgtacacatatacacacacaagcacaaatgcaattattgtgcaggaacagctgcaaagaggctggtgcagggctccatgtccttcctgaaagtggctgaggggagcatggtcctaccacagctgggagacttgactttgtgcatccctttatagaaagaagctctctgactcttacagaagttgctgcatgggaatgccagagataaggcacctgcctacctaacacagtagtttagtcttctgagaagcctcctgtctcctttgatacctgtgaccctcagtcatggcagctcctccatcaatttatccaatgtgaggatggatgacactcacctccataacccagtctgcagccaggaaagtgtcagtagaggtgaccccacctttccaggcccatcatatgtgggtcaagaaaggatcatgtccaagaccacagcattaatgtttaataaggcttccatttctattgaaaagttgtccttcacctgcagtgtttgcaactgattgctagcctgaggaacactgggcaagaccaagatgcatcatagtgtggtggacagagccatgagctggggctgggtcccagagctctgctcctgccgctgaggctgaaaccacccctgctggtcacagtttcttctcacatgaggaagggttggcctactatgttctatgctcttccacctctggtgtctgtgtgtctgtgaatctagggaactgcttgtgcccagcactgaggaaaccgggcacctggggtgggatctatgcaatcctagacacacgctgccagaaatccaagcacaggctaactctggagggtaggttttggtgatttccacagacatcagccgtctctttaccccctccattgtttcttagtttccccttcaatgggttttcatttttaataaatggaaaggaatttgactttgagattgtcctgaaagcccttgtaatgaccagtgatgtctagcatggattataaaatgacaactggcccactaaacagaggaaattccattttgagttaaataccaaaataagttctttcaatataccctaaagagttcaccacagtcctacaggtaagccagatggatgagaggagggcagcagaaaggagagcctcctggatggggagcttgtgcacagagaagcaggtattagatgaagaaaagacagaaagacaatctgtgtggttggttcacatttggggcaggaaactgggacccacagggagggtgctgggcccctcctgccctagcctacttctttaagaaccaacctgtgatccctcccctagggcagtgatagaaatcttcatcctaggaagctcatgcctctgtccccagttcatgccactctgtgcttctgagaacatcaagacagaggtgtctggagtatcaaaagcaaaaaccttccttctccacactgcatggctcacacaagccagtgctgtccacccaccaggcctgtgtgtgcaccagactgagacgtggatttccagggccctgacgctctattgactgcaagaaccatcatgcttgtatctcagcctatgtttttgaaaatcaaactacccattccattatccatttagcaagaatatcaatcagacttattgggtgaggaggggagaagggagaaggtttgtgggcagtactttttctagatggaatacgttctcattcaagtctaaaaaggaaaaggactagtaccttggtcatagtcagatgactacctgaaaagcctctggcctttagtagctaaaggctctgaaaccaatagtttgcacaaacattgacccaatattggatctaggacactgaacaaaaatcacccaaggaggaactctctgggaacagcaggtaacccctcagctttatgtcctagggctccgttcccaccagaaaaaaaatgtttatagaaccccagagacctaacttgggaacctgtgcagcacagaccaagggtatgtcctatcctggggagacacagagcccagagaagacccagccttcccacccatgccagccagccctggccctggggtgtacttcccttcacctgcagggaagaagccaggtgaccatcaagcaacatgacatcatttcctggccagcaagccttctccagctgcagccacaccttccatacctctggattcactaatccacatcccacccccatcagcagctctcagtaatcaatcagtccccttccctgtaaccttcccactattcactcccagggcctccccaagctgtgtggatgtaaacaagatttcagaagcccttggcagagatatggttaccaggtgctgaagaaacagagactcagagtaggccacctgagcccacccagccacacctggcatacccagcatttggctagtgccagttaggaccagatactcagcctccagggagaataagttcataggaaacttcccaagtgagttcaaaagccaaaccagaatgatcacagtgagaggtgtgagcattctagggaccccggcgcacatggttattttaaagagcagagtgaggccattccaccaagtgcatgtggggcaggcagctgtcccatcctgggggctgtgggaaggcaggaccaggctcttcacttcaggcagagaatgcaccactgctaatcactgagagatttcggaccacagggcatttccagtaaagcatagggagttgagggagaatgttcagaactgagaagactagactgtgctctgagtagactgaggctaagagtgagcaaaaagggtaagaagaggtgaatggctaggtgcagtagcagatgcctgttgtcctggctactcctggaggttgaggtgggaggattgcttgagcccacgagttcaaggctgcagtgtgctataacagcacttgggaggagccactgcattcaaacctgggcaacatagtgaggctccacattgaagaagaaggaagaagaagaaggagggaagaggaggaggaggaggaaggagaaggagaagaggaagaagagattggaggaggaggaaggaggaggaggaagagggaatgggggaaaaggttgcattttggggaacttctcacttatgtcaaatcataggaagcagaatagactagaaccccctctctctccaccatgtgagaatatagtcagaagtctgccatctgaaagccaggacaaaggtcctcaccaaatctgccagcaccttcatcttggtcttcccagcctccagaacagtcagaaataaacatttgttgtttaagccacccagtctatggtatttcgttatagtagtctggacagactacgttggtgacacagcaaactgtgtgtggagatagaaggtaactaaatgtatatctgacaagaattggagatatcacaagtatttacttatgactgtcatttttgaccgtcaatgtaaacaatgttatcagcccctagttttacggggccttctagagggctctctcctgactccctaacacaattaattgaagatttttaaatgattccccaaatatatatcattatccactagaaaaatgttcacttgcttcaacatcctcttgcccaaaacttctcagtcagaaaactgttcttaatatcgaatttaaactccttcttcaatacatctattccttttattccaacctgaagcagaatttagtcatgaaattccacagattgctccctataactccactctcacatctttctcttttacataacccaaagatttggaaagacaagagtagacaataagcaaatgaatatatctgggagaacattatagtacttaagaaagaacactgcttcatgcccactcagcacctctcactcatgtgacctcacaactggattctcttacactattttctgagtgtgtgtgtgttctagtaattgtaagttcctgaaaggcagagccatgtcttctaattttcatagcactttggctcaagaagtcaataaagacatgtagccataagttggcacacttattaaaaccattcttattctttactttcaataaaaccagactcctaaggaccctagctctgattttcatacagactgacagatactaactctgaaatttgtaacaattaatttggtatttgaggcctgcccttcttcattcagtgccctctccctcaccccaagtggtctgcatttgggaggtgtgatggtccttaccaaggtctccctggacagtcaccatggagtctagagggtttaggttcatcttttactgtctctgtgtgatgggggaaggtggaaagaagatgatttcctcttaaatggtggaagggcctctcagatttcatgtggattataatatgattttgatagtcgggaaaaaaaaactctttacggactaagaagaaacaagatgatcctcataccctgaaaagtcctttccaaccttctctgtcaaacttctgttcttcccttggatgcaaatgcatgacagagcttgcagtgagctgcagaaagtgttgggaaaaacccagagatgaagagaatagagacttccaagagagcgtgtagtcaaacatccacccctgcctatcccagtgggtcccacaggtctctactggagtcatgaggtggtgtgtcccctactcattgctaagacccatgaacttggaggagacagtccaggggccatgatctggaaggggctgaagtgaagcagaataacaaacccacatccagttctagatcctgctacacaggagagccaaggcaagtcatggaaacaggttatgatcccaggagagagacagagagcagctgagtgagcaaaatagggggcagcctcaaatgatttctgaagcataagtctaaacctaatgccaaacagggctttttcatctgctcagagtcttagcatgagaattagcttcctttatttacaaagattggacagagacagggaaagggagacagaaaatataacaacagacacaggaactcaaaatccctagttttccttagccagtaagtaccaaggcagacatttctatatacttaataatctctgaaaggtccctatacatgatacaatagctgatatccatatggtcatcttacgacattaagaaatgactttgaaaaagtaagtttgaaacacgcttgggaagatttccattaaaatatttaaagttaaaaaatgttttggcatcactttttgaccttttggctaaagtcaagtataaaaaatgttttggcattttcccaagggaaaaggaatctcatgttttctgaaaatttatttatgaggactgtctcatagagaaatgagatgacacatccacagtatcgcatggtttgtaaatataacattaccaagagccttgtcttcacaggtatgtgggataggctgaactagagaaatcacctcaaatctctccagtttgctaagggctagagacaattgagcccctcaaaaatatatgatttggggtctgtactaaaatctattaagtgggccccaataatagggctgaggaacttacgtgcatccatgcaaacttccaggtgtctttcaaagaggccatcaggtaatacaacctggttgcaaggtgggggagggatgaattatataaagggccagttctggaggcagacataagcccaggccaagaagaaaagtaccgttggttcaggtgttagtctaggcaagggcgatcaaacagggctgcaaaactgagtaggagatacattgcaaaaaaagcaggcggccgagattggaactggaagaggcaatgctcaatgttcaatgcttacagggagcctcgctggtcagagctactttttttgtttgttttgtttttttgtttttgttgagatagggtctcactctttctcccaggctggagtgcagtggtgcgaacacagtccactgtagcttctacctccccagctcaagcaatcctcctatctcagcttcccaaagtagctgggaccacaggctcatgccaccatgcccagctaattttgtgatttttcatagtgatggggtctcactttgttgctcaggatgatatcaaactcctgggctcaatcaatcctcctgcctcggcctcagagcaacctttaaagggctgtctgtgtgtgtctccctccataaggaatgtaacacatactccctcctcctttgcctattgattactcacgttatagatcttagcttagatgtagttgcaaagacttccctgagcctgagaaatctacatgttcttgggaaggaattggcagacaatcaaggctcctaagcagggaaattacacaatgaggtttgcatactggctccctcactctggctacaatgctgacactagacttgaaggggtcagaagggagcctgttgtaaacaacacaggatctggccatcaacctgactccctctcttgcctctcattcaatcactaaccaagctctggcaattctacattctaaatatttctcagaggcaaccagttagctctctctccactgtcacaactctagttctggccctcatcattctcttttcagattattctcacagcctcctaatccatctcccaccttgaatttagtcttgccctccaatccgtccttcacctggcctcaagagagacctctgtaaacacacatctatttatgtgttattcacttgaaactctaattgctgtctcactgttcttaccatacacctaaaatgtttggcatgtcctacaaacttggcaaggtctggcttctgcctaacctactgaagtagacactgatgcatctcccaaatttactctttaggaggacattcatttcccagctgtgcaaactattaacaactcacagctgagtccctttccaggaattgccctcatccaaagaaaagtgcctcactcaagattatctactctccctccttgggcacagctttcatccaatgactgcttgatgcgggagtgccaaggtctggtttccttgcctcaatttgggacatatccgatgggccctcctatctccagagcccctcatgggatcagttgaggcctgtgttgcaactgcatggcagtttaacttctctctttgcccagtcatgcatccttcactccccacaggtgttccagacagcacacctgaagaaacatcatgcatgtaaattggtctcagactctgtttcctggagagtctgacctacagtactctcccagcaacattactcggacatagaaaattcatatggaactttaacagttcctcaagtccgctgagctctctctgctgtatgggtttttgcacaagctatttctttttccctagagcatttcctacctttttcctattcaccttcaagtctcagctaagatgtcacctcctttaggaagtcctcctgattcaccaagctcaggtgctctgcctttatgttgtcatgacatttagtactacctcatcaatgcttaattagacaaattataatgcattctatttatgtatccatgtgttatctcccctgctagactacatctttttttttttttttgagacagagtctctctctatcgccaggctggagtgcagcggtgcaatcttggctcactgcaatctccacctcctgggttcaagccattcccctgcctcagcctcccaagtagctaggactacaggtgtgcgccaccacgcccagctaatttttgtatttttagtagagatggggtttcaccatgttggccagaatggtctcaatctcttgacctcatgatccgcccgcctcggcctcccaaagtgctgggattacaggcgtgagccaccacgcccagcctagactacatcttctaagggtgtaagaaatatgtctattgtgtccatcattgtaaccctagtgcctagcccagttcctggaacacactagggatataatatgtattagtttgcttgggctgccataacaaaataccacagactagaagcttaaacaacagaattttactttctcatggttctgaaagccagaagtcccagatcacggtgtgggcaggtttcatttcttatgtgctctctctccttggctagcagatgatcacattcttgctgtgtcctcatatgggcttttctctgtgcactaacattcctggtccaaatttcctctttgtataagggcaccagtcacattaaagtccaccctgattgtctcattttaactaaaacacctttttgaagaccctaactccaaatataattacattttgaagtcatgggggttagggctctaccatatgaatctgggggcaacacacttcagcccctaatagttctatgtttcttctctttccccttccacagtgctgtctgtcccagaggcagcaagcccacagctctcaccaagcaccaatgcccagattagccttcccctcaaatttccaagattcaggattcaacatgttacaggtattattctgcctggaatggggtcaaataggtggcaggaggacttgaagaattcactagttacaaaggggagagacctttcaggctgaggaaactgcataagcaaagataccacatgttaaatttcatggggagcttggagacaattagatgtggctgttgtggaggatgaatgtggtagatgccaattgttgaaggaagaaaggttgaccgaggttatacggtaaaaagctttcattttggcataaaatcagccaacactttatctaaagagatgaagatagggaattagaggctgttccaatcactcatgcaggaaacaatgcaattaacttggtaaaaggttggaagatttgaagatgacttacagcaaataactatcaggaagggggaagcaggagaggtatgacaagcaaaagataaagggaaaaatagaggcaaagagaaaaaaaaacagaaggaggaggcatcctgttcatatctaaatgacgaattccaatatcccagaagggattctgttgactggggttctgcatcctcaaaaaggcaaagtctcctccagactttgctggagttgactagcatctctcagcaaagtgagggagtactggaagcagagaaggctctagatatcagaaggtcggttaacgtggaggcacagcagcaaatggagccaagagggatgaaggcagcaaaaatttccaaaaggaactggagatctggatgtgatcagcttcagggggctaactgggatgagagaattgatatatccggctccttctcatttagagaaaacagtcagctcaggcctggcttatagattaaggaccagtcacctggatccaaccacacagaggaaatagtggtggatataaaggagcttatttcccctctcaggataccggggtagaaaagcggaaggatcagacacttgcagaggagaaaagagaagtcactgtgcttgtccactgtcctggctagtaatagcaacggtcaaggccagaggttacgtgtaatgaagacagtggagctaactgatttcgtccagctgcaggtctaggtgcggcaggccatctttttcacccttatccacccggcacccactgaggagggactgttctaataaagatggcttcagtaggccactgcgagtcaaggctgggtctgtctccaaagtgagtttggtttttctttatgaaacctctggtcacgagaatatgagagtttccactctggttctgaactatgggtcatcaatcctaatgggttatgggttccagctgtgagatttgctgtccctgtttgggattacaaaaagtaaatgaagctctccagttaagaccaggtgtgggcagtcagagctgagaggccaggagtgtccctctgaagaaggtggtgaccgcagagaaagtggtgctgggcctgaatcactggtgggcagagatggtgcctgccagtcctgagccaacctctttggagcccactccacagagataagagcaacagcagccctgaaagcacctcaaggacttctgctgcaaccgaggcttcccactgcatttcccccttacagactctccagtaattctttagactctgtaagtatggcatgtgtatttcattgaaaaagtaatgtaagcatgctctagaaaacccaggaaagaactacccacaccaccaccaccgaaaagttaattagatacaatcagagttttcctccactggaccttatccatcttagttcacagtctcagagttaggacttgaggcatttgtggaagtaaatcaactagagcacccttaagactttattcaaaaatgctaggcatgagtaatttcagagagaatattctcacttggagaagcagcgtgagccagacagaatttttaataaggatttaggaggcagggtcagctgaagttcaactggtttagggaatagtgcaaagatggttctaagaaatatgaggaattgtttctaaggatgatgaactactgtttgggatttttaccgagagggtgaggaggaatagttaggagctgtggccatatggaagaagggtggggagaaatattaccgggcataaggaagtttaaggaccaccagtggaaaattctcagtctatgtgtctcttttaaaaaaattttgtggatacatagtaggtgtttatggggtacgtgaaatgttttgataaaggtatctattagcgtctcttgtgaggaccaaatggaaacacaggccttctgactcctggagagcattcttttcacattccatagatgccccagcctttctcagtttggcaggtgattgagaaagaaccccaaggcgtcctggcctttcccatggaaaggcaggttgagataagaagagggctggactgcacagacaaattcaaagattttaccaccttgtcctagggttataatttatcttcaattggaccagggcctgcaggagtttagtcctacatatttctggcctgcagctacatgaagggaattctgcctccagtgattgagaaaactcaaggatttccttacaaaggcgtttcactttttgatggcttgaccctggaagcatcactgtatcaatgattgttgttgttcctcttaatcaaattattctcagctccatcctgagatgtttcagctgacagcctggatggccaggcctgtagcccattgtacctttctgcccaaggggcgatgtagccctgtgcactggctgttcagagatagtggtagatccatgtttatttttcctggctgtgcctttaagagctgcaggaatgtgaagggagtctggatgaggggtggggtctcccaataggacttctggaaaaggatcctgggaatttttgccagaaactaaactgagagtccaactttaaaaagttgggggtggtttgtgttggggaaggcctgcgattggactgcagaatccactagggaggaggaaagcaaaagtaaaaaggaaatagctgggggaagggaacggggggaagccatcttcaccccccaccccaatgcacacacaattaagccaggaagcagcttgcaaccactagcctggggagggtccgcatgtgtcaagggtgagggcaacagatgctggacccagggagctctctgccacaggtcagtctacaaggcctcagggaccaacttgccaacagctggacttgatcactagctggcaaactgagctcacgtatcgggtggaataacaagcggactttgctctctgctgtgcaaaacgctgtttttagaggatttgccacagcagcggatagagcaggagagcaccaccggagcccttgagacatccttgagaagagccacagcataagagactgccctgcttggtgttttgcaggatgatggtggcccttcgaggagcttctgcattgctggttctgttccttgcagcttttctgcccccgccgcagtgtacccaggacccagccatggtgcattacatctaccagcgctttcgagtcttggaggtaggtggcatctgtacaccttggataagtaacaggcttcccagaagtaccttatttttacccatgcttctctatctactgggttgtatttttcccagatagcaaatgacacattgccaaagttacactttaaaatgctcatagtctggcagtttagagccgaactccagagtccagtgtgctacttccagaccttaagcacagttgcactttgtgctctgatttggcagtttgtctcatctgtaaaatggggataatagtagaatttatgttgtaaggctatcctgaagatttaatccatagctaaaatactgcctggcataatggtatgtatctaaaatgttattattcaccatagttcattttttaaaatatgaaacttaaaaatgttggttactttttcttcatgttttagtgtttcaggctgataatggatttcagcttttcgttttgtcttttatgataaaccattaggtcactgtaaaaagtcatgatatcaatgtactgagaagtcttagtttcttttgctgaactggatttagacttagaagtgagcagatttcagccaagttaaacagaaagaatgcatttgggctgccacctcattaaaatgtgcaaaacccaacattttggcagcctggacaggctcccagggacaaatgtaaccctccaccctagcctttgccacaccctggcattgattattcatacttaatggcttgcttttgtacaagctaaattgataaattatttatcttctttcaaagaccctcttattgctaataattattttatacattttcctgaaaaatcttcatgtccaaattatatgttcttctagttatagtcagggtaaagtaattccacatagcaggccgaatgcatttcctaagggcgtccagccaacaggctggggcctggaggcagtggatgaagtgttcccagacgagcggcctcttgcgcttcttcacttgctccctcctgagcctcacctccttagaagtgccagaatgatgctcagtcaggatccctctgcatttagcaccgacttgccttgggagtaaagccagccaaatccctgcaaattgtctttcactaccttaagaacttgtcaagggtatgaagtacagactgatccttttatagctatgaatgtggatttgaaaaagacaaggatatgatctgtatagatcttcccaccccagtcctgacctgaggtgaagccaagtcgcaggtggcagtcactgttggccagcgcagacacttaacaatacagtgatagcattcccagcctgagaagccagtgtcggaggggtaggaaaaaagagggtagggatttagggaattattttgggtctctctttctgtctttctcccttcaaaataaacagccttacgtattgttgtttggagcatacatttttacatttgtggatagaattttgataaaccatgccaaatgagctttaagtagacattctctttgaccaagcaatcccatttccattcatttattcttttgttcagcaaatatttattgaatagtattatgtgcttggccctgtgccaagtgctagggacggatattctggaaatctaccttaaaataatctgatgaagatgtaaatacaaaggtttttttttcccttaataatctgatgaagatgtaaataaaaagtttttttctcagcattgtttgaatgacaaaaaattaaaaactatgtaaatgtacctcaaaaagagtctaacagaataaataatgggatatcaattaaatggaatgctctcattaaagttatggtataggtatactttaattagtatcaaagtatgttcacaatatatctgcaagtgaaaaagatgatacaaaacatatagtaaaatcacattttaaaaatatatatttacatatgtatgactaaatgcttgggaaaacttttaaaaactgatatactcaagtatcaatactacctttgaatttaggaattatgggagatttcaatttttcccctatttgatgatgtgtaattttctaatccttttctataaatgataggtatttatattatttgggtaatttaaataacaagcaataatttgcaaatttattttctgactgaagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgaatcagaggacaagacactggcagaaatgttgctccaagaagctgaagaagagaaaaagatccggactctgctgaatgcaagtaagaaaactgcatcttttcctagcccttctagggactattatgctcagaaacacacagactcagagcagtcagggagcatcatagagtaatgagagtaagaattggaggtgtgcttttgtgtgcattgctgagagagaaagctatacagagaacaggtgtccaaagagaaatccattctcgcaaagccattctttctttcacacacagtgcctaaagcctccatagatggtgaaggctatagtgccaaaagtcagcccaaagagactacctcctgataaatcttggtttggtggagatgtgtggtcccagattttttcagggaaagtagcagtttggtggattctacatccagtacccaggctgtagatagcatctgcaaatgtaccaagaaacagtcttaaattggaaatggcaacagccaaccctcagggatgggaactgcagtgaatcactattgtgtgtgctgtctgagatggtgatatgcatgggatgtggtctaatcttgtgatccatcagaatcacttccaagccattaagaataatgtgtagcagctcaaattataataaacagtatcaggcaataaacacacaaatgacaaagaaaaattttctgtgcccgagtctatttcattaaaacaatgagggagacaaatctcccacttcagggtttgtattctgagatgttttcattgcaaataggaagactttatttacatgctaattacgtctgttccaattcaagaacctccatcagggaaatgacatataagctgagtgccatcattgtgctaaaagtttcacataccttctcaatgtaatccttctaagaacttcatggtcactataaggaaaagggtcttcctaaatgaggtgacacttggtctcagttttgaacaaagaagttagaaacgaatgagtagagggtacttcaagtcagggcacaatataccaaaggcatgagggtactgtagcaccttgacatgtagacccgcaaatatggctgagtgaaagctttttagagaggtgacagtagggaaactaggttgaagagctcagcaggacccagttaatgagagaccttgcatgctagatgaaggaagttgaagctcactggagaaactatagagaaccattgagcaattttaaacaagggcatgatacgaaggaagaggctaagactagagagaggagaccagtcagggaatgctgcaatgatttgggcaacaagtaatagtgttggcattaagtgtcatgggacagagaacaggtggatttgagagccattgagaattggaatccacatggctttctgactgctaattaaaactaaatgatgagtgagagagatgagtccaggatgtttcccaggttttgggcttaggtcatcgaatggttggtatgaaatatgctgagatggaaaactcaaaaggagtttgggagcacttattactctataatttttttcagaccatttataattttgaaaccatttagttcatttattggctcataggttatttcctacctccctatctgtaatgtcagctctatgagagcttggaaccccagtttcatgttcaatgctgtgtctccagtgcctagaatggggtctattcaataaatagttttcagtgagtaattaaacaattaaaacaaataaatgagtagatgtagggattgtcaacacaggcagaggggttagttaggctttggtgggggggggggcggggaaccaaaaaacatcttatccctgagtcagaagaaagagaggagggtgccctgcctataatatgaagcaatgggtcaagtaagcaatcctttttggccctgacattgtcctgagatgaatcatcctcaaagagggagaagctggcggtaagcacagagtgagggaaggaaatgggtcaaaagaggatgaacaggggcttcctaaaaagctgatggagaggactgggtgctaatgtggcctgagctagaatgtgtccgaactctcacactgggggttcaggcaggacgctaagtctgaatagtggtgctgaattggatccctgagctgtttctggtccctggatactctcagcccaccaggtgttgagactaccctttcccattccagctagagctcagtggaggtcctgagactggacttgctttttcaacccccatcctctgcccctcagatctggtagttctgaaatatcccctctcctagctctgtggtatatgaaaacttatttctgaacctatcagagattgctacatccatgtctgttgcctctggagctcacatttgatgctgtgttggtttgtaaatcagccaatacttgttgcctcccactactggatgggccctgtgctgcactgcagggatggaggactgagtaggacatgtctgcatcctgctgtagcttccttaccacttctcttgcctcccacagtctgcctcctgtcatgcagaccttccacaacacaaaatagatcataattctcctctgtgtagaatgtattttcgtcatttaccatcaattatcaacaacaaaaaaatccattcaaatctcctagctttcttttacataagaaaggccctttacaaagtgatgcaagttgatctccagctccttctcccataacttacccaaatgcagtttaaatatacatatacatatttttatgtatgtgtgtatatatgtattaaaatatatattatatataattaatatatatttatatattttttcctagcaatcctttatgactcaaaaatgctgtgaattctttgtgaagacctatgagggtgaggatagaggtgagggggctgccaggcagattggcctataatgctcctggagcaattcattcagtcctcccagggagcatctcacatatccgaccacacaagtctgtatgtattcaactcctcagtcattccacaaacatactgacatcttcttttctgcattcacagagcctaggtcatgtcctcccatggagaaggccacagaaattgtttacagaagaaataacaatggcagaggcccctgcagagcttagtttaggggaagacaaacctagaaacaatcacaacggtgtgattagtgtctcctcgatttattatttttagaggttctctatctaggagtagactttggaatgtcaatttattcccgttaggcactgttttgtattgtatatattatgcacactcctgcttttttgccatttctgttagtaactatgcctatatcagttctcatgctatacaacaaattaccatagatttagcatcttaaaactacacatttactacctcagagtttctgtgggtcaggagtccatgcatggcttagctgggtcctctgctggtacttgtagggctgggaccctcagctcctacagcctctccttgccataggcactgcacaacacagctattgctccttcaagtagatggagagtgcttctctttaggaagcgcctagtccctcttttcagggcttttatgtgattcagccagcccacccataatttcctattgataacttcaaaatcaactgatttggaaacttatctgtatatgcaaaattccttcacctttgtcttacaatgtaatgcaatcacagagtgctgtcctgtcatacactcacaggtcctgcccacactcaagggaagggaattacactgggcatgtacaccagggggtaaaaatcctggggattgtttaagaaatctgcctatcacaatgctttagtctgataggctcagctggtgctactaattacctgcacccaccttcttcctggaagactctgatcttcctgtcttccaaccatggcctctagagactgtgccagttacagaccttccattaaaatcctgaagactcaagttagcacctttctgtgggcaaaaaccatgggattatgggctaggaaggcattgccagaggtcagatcagagggtttcattcatatgtacgcattgtcttggagagtttgtaaacccctacagaatagatgatgcaacttccttggaaaatttaaccttgtatctcaggagacttccaggaaattctagtactaatcttaatggttctcacttattttaggaatattattcaggcaactactaagggccaagtactgagaataataagataaaattgttctataactaagccattccctagagagctgctcttgtatcttcagcctttattcagagattatccccaaatgacgtccacatgagggtttcaactcagggatgttttgcgggtaggtacaatcttagaatcttaactctgtctctcccactttcccactctccttccctctcttcttctctcatttacacacatacacaatgtaggatgcaaaggagtgaacactatttgaatataatctaacttatattttaaaattattccaagtctttggaactataactattattaaaataaaattttgcattgcacttgataatttatgacaaagaatcattccctcagacaccaagattaagtggtgtcttaatcttggtgtctgatactctttggaagatttatccaactgatactctttggaagattccacaggcagcattcttgtatggatacgagtattaacttctttttaacttgtaaatagtttgtaaagaaaaattctcaaggcagtcaaaacaagccattatagcagattttattttatttcctgttgtcgtccagttccttttattgcaagggtgcacaaaaagttacctcaagtaaccttcaccctgccgaattaaataactcatatcttttgttagatcacgtttcaaataagaaagtctgttgcagcatatttgaagcctctgggatctgtccaggttttataagtgtgcatgacccatattcaaaaccattaaaagcaagacaactaaacaaaaatccccactattaaccaaataaaatgtatctgtttgccaactctcaaggtccattagtttgtcatgagtggaacaaaatattaaaagaggtataactaatttgcaacagatgtgtttaccacaaaagaagggattcaaagtataaatgcaggtgtaagtacaggtgtgtgtgtgcacgtgtgtgtacgtgtgcctgcgtgcacccagctatttcggtattcagggggatggcaacattggaggcgcatgtagagtacagcttaacctgtgctttcccttggaaaggtaatacccatgggtcactgtgctgggttcagaaaggcccacgtacatagcacttcttttgtttatccatctgaaaggtctgtgggctatgaggataccttcagtcccatcactacggattctcacagagggttaactgtggctccaggtgccctgaacatccattcattcttgctataacttatttatttattcaacaaatgtccaactgaattctagaaatatgttggcattgtgccaggcattagagatagaatgttggacagggtaacattcttgtcctcaaaaagcttatggccaaggggagaagctgtccagacaaatctggaatgatgatggctctgatggagggatgcatagggtgtcacaaaagcacagggggcaggcattaagtagatatggtcagggttgccatgtagatggggggattatggaatctggaaagtagccctcaagctgagttttaatcatggaaaagagctaattaagtggagaataaagtaataggcatttcaagaaaatgaaacagcatgtggcagcacaaaggcataattgggctcagtgtgtttgtggagcaagttgttcaatggagctcaggtgaaggaggaagttgtagagaggtgatgaaagaaccagacatgagctaagctcctttgtgttaaactagttcacacttgcaagctgtagggaatcagaataatgtgaacaatggcaattaatattactgaatgcgtattatgtaccacacataatccttaagcattttacctatctcactggactatgtcatgcaatactcacgataaccctgtgagataggtactgtatattatctcccgttttatagatgagaaaacaaagacactgaaaggataggttatttgtccaaggtcacacaactaatagatggcagagctgcactttgacccagacaggctgggtcctgcacaccctcacctctcccattgtgctgtctgcggagcagtgataagcatgggagtgtcggggctcagaggaggtgcattctggccacagggtgcagagcagaatggcagtaggggaggctgagggggcacagaagagacaggctgaactcagtgaagccatctccaggactgccagggaggcacatgaggtaggagccttctgttgagagtaggtgcctgggcccagaagttctagctgttcctgatcttatcatgggtcacagtatgaagaccatgttagttttctatttgatgatgattcctacttacaaacaggctggttttagattcttaaactctggccaagaaggtccaattttctttccctaccctcctgttttttagttccctgccatttcttcattgactttcaaacaataaaactcctgtgttttccccactttttgctcagttaacagaatagtcacacacacactttcctgggctagaaatcttccctttggccctcgtctgacaggtcactatatccagtagattttttcttgtgaatctctctcaagtgtactctttccacctgcactgctctctcaccatctctagtcttgattcctatgaaagcctcctcgctgaccttcctgcctcccatttctccctgtttcagggctttatcctatattgccacagagtaatcttgccagagttaccacatcactgctttatccccttccatggcaactgaaacctgtagggtaaagcaacccccccaaaaataacatataaagaaagtcctttacaacctgacccccgccagcctagctctctttggtttaagtatgaaagtaatactcacgaattaaataaaaactatgaatatggtatccgctatatgtgttgtgcttacttttatcataaaagtggataagaagccaacaattgaacacagcaactttgagtatccctcagcatctcgtgccgctgctgcctatccctatctgtctggtgctctgtccatctcacctgctattctgaaaacataaaatatacctcatgcatgcctgagtcatttatgctgtgcctggaacagagtagagaatcaatcttttctgacctgaaggaatcgtttatttgaaaatggagggaactatttgccagagatagcattcagcccttaaatctgatgtcttgtctgatgaccacaacaaccaacaagctaggtcgacactattacagctccttttcagatgaagaacctgtggcttagagagttccacacagcccatctcttctcctcacattcctgtcacatacagaagtatgcaccaccccagacatgctagattcatctctgcctctgtgtctactcacagtctccaccctgccctgtatcagttatctgttgccacaataatgctacatagcaaaccacgcctaaacttagtgggttcaaacaacaatcgtttatcatttctcaggggtccatagggtggctgggtaggctcacttgtgcacctgcagtcagtggcacgttgcctaggaacagctgggtgaggatgacttcagctggggtgactgggttgtcctctgcatggcctctgctcctgcaggaggctaacctggcctggcctcatgacggaggcagatgtctaagagagaaagcagaagtacacaaggtccctaggaacttagcctggtcactttaacactttggtgttccaagtctggctctgaagctcacccctctactatgacctctagttatacccatataaggcttttcatctcaatgctcatggaaacaggcagcaatcaagactgattttaaaatatgcaaatgtctacatgaaagcagtgagtcaggcattggtgtgattaacagttttgaggaagtatcaccaaagaaccagtgagaagtctgctgcaaagttcaggtccaggaagcaggccctagaccatcacatgttgagaaaggataaaaagaacaggatgaaatgagatgtacttcacaggaagaatccatggggaaacatcaaaatgactttgtgttttctaactatacacaggcaaatggcagtaccacagctagaaattgagagcatttccatccttttcagtttggaatattacaggaaaaaaaaaacactatgcaaaaaaccagctcagtctttaaatgagaaataaataaaaatgagaagttcgtaattataaccttggaatggttacaatgttgttgcagtcagataattggtggaaagtggaaaccgatcagaaattccccagagcagcctgggcaacaaagcaagacaccatctctataaaacataaaaaaaaattatctgggcatggtggcatgtgcctgtagtcccagctacactgtagctggaaggtctaggctgcagtgagccttgatcatgccattgtactccagcctgggtgatagagaaagaccctgtctcaaaaaaataaattccccagaggatggcccattttcatgctttacgtgagtgttgacgagcctggatgctctaggacagttctcaaactttcaggttcagaaaccctttacagtcataaaaattattcaggcctccaaataggttttgttgaggttggttataactattgatatttaccatgtacataattaaaatggagaaattgtaataatatgtaccagatgatattccaggataagacatgcatctgtgaaaaaaaacagataagacaaagcccctgcttttatttttctttcattttttagagctgacgttcttttgagggaggccaaacaataaatatgttagcagataaatgtataatatgcagacagaatataataagtactatagagggaaatgaactaagggaagggattatggagacctggcctcttccagaaggaggcactggaaggaagttgtctatgttgcctgtgttggactccagctgtagggaccccatcgtggagccaggctggactcacactcatacctcacacatcttcccagcttccacaccctccactgaagttctcaacttgatgtctttgggcaacatacatctatgcacgtgaaaagccatgtgtcaagtctgtttctttttcataatttattgctattatcaataaagttgttagggttcaggacagggtgccatggaatactctgaatttagtgctggaaagctagaaaaacctatgatacggatttaataaaggattatgtgtaattcactaaaaccaacatataaagcacttattgtatgccgggccctgtttaagccctaaccctgggttcatagcccttctgcaatgccaaattgccccatggctcactgaattttatacagttcctgttttcctgctacccatccactgaagcactcagcaaaatatcacctgctaatctatttgatttctaggttgacacagtatgaattgggatagcaagtttggaaactgacaaattctgcacaatctgaatctaattggtttctgagtttggagagtaagcagtaagttgactagtgagggcgatatatactgtgtcccaggcacttaggataaatagagtctaaagtgcttgcaaggaaacaaagtgaataatcaattctagttcagcataataactgccctagaaggggttgcacagaatgctttaggcagatgagaatgaccatctaactgctctgcaggagcagaggattttgttttgaataatgagcaggtgtatcccgagttagcaaaggagagctaaggaagtctgagcaaagtctaaaacttgcgggaagccatggcaggtttggtgactagtgactagtgtgatgaggaagcgacaagagaggaagttgatcaagcactctgcatgctatgctgagatatcggaaacttattccatgggcagtatcatgaaatacccctaatttttagaataagtccatgctgacaattttataataatagcatgatattttataactgactacaagtctgagagccatcatctttgtcatctcagtgcctaccgtcctacctatcatctgattagtattgataaatgtttatgaacatgaatacaatccagatggttgaaaaagtcaagttttataacaccatttcaggaagcagtcaaaatactcagggttttaagataattctcttctctttaatgaattcatcactcttcccaagccaacctgcttttccttctctgctgctatctcatgtaccctatcaccccatttttgagtctgatttggtatcagctggttccctcaattgaatcagttattaagacgtgacttctccttttctagctgcttatatccatcactatttggatagctctcatctggatcatacttacaaactcattacctggtttccctctgtccttccccatccccaagccattctccaccagcagccagaccaatgtttcggatccttaactcagattgagtgactcccatacaaaggaataagtctcaccagatttggagagtgttgctattaaatcaggggaaaagtatttaaaagattcaattaagtgatacttatgtatgaatttacaagttatatgaaaagattcaaataagtgatacttgtgtatgaatttactgtgaggccttgcgccaaattctatcctaattgcttgtctgcaattctgcctgagggggaaacccagattctcattctctggtttgccagggaaaccttgcatgtcattgcctctgttaaaaaaatttgcatcttggctggacccaaaggttttaaatttatttcccatccttcctcaaccttttcttcctgctaattatctcttctcaagagaagcacagcagggagttttaacttacccttttacttgaacactgtaaatatattatcctcaaactccaaaagaaaaggaatttataaaacttacagagtatcagccctgaaaactatgtagagagcatccaacctaaacctcttgttttacagctgggaaaaacaaggttgggttgacaaagggacttttggggagacacatagagccaaaggctgagtttagaccactcacatctctgactccaagtgctgggtttcatctacaaaggaaggaataggagaagcagaaggaacatggggggaattctgtttctttttttccagaactatgtttccctgaccaaaaccatatatccactcttgtgttatttctccaagggttctgcattagaaaagaagagtagagggagaaagaagcatgtctgtgttggtttctgctgtattttattttattgactgatttattgttttgttttgttttgctttgttgttgttgtttgttttgagacagggtctccctctgttgcccaggctagagtatagcgatgcactctcagcttactatagcctcaacctcccaggctcaagtgatcctcccaacctcagcctcccacgtagctgggactgcaggggatgtgccaccaagcccaactaatttttgtattttttgtggagacgaggtctcactatgttgcgcacattggtcttgaactcctgggctcaagggatcctcccacctcagccttccaaagtgctgggattacaggcatgagccgctgtgcccagccatttctgctgtattttaaatgaacattttcttacggatgagacattaatatgccttgctcttagacatagtccctctgtagctgggctgcaagcctgctggcttttcttcaggcaagaaggatgggcaggctgggggcttcctagtcaagtcccatagtctgtgactaggtcccagagagcccattgccctcatccacccttctgcacacccagatcctcttcattctttcccgccacacacatacatacacgtcaccatgcccttggggctggctggaggggtcctgactggctgcctcccagctcagactgagctcagaggaccccatccccacgctttatggctgtgtgacctttccaagtaacttatacaagccttaatgtttcctcatttggaaaatggggattaaaatatctaccacttaaacttattatgagttctacattttagaaatatattaaaatatcatagtatcccccaccaatatatataattatttatcaattaaaaataaaatgtttaagaaggtttttttttttttaaaaagaattatacggggctgggcatggtagctcacgcctgtaataacagcactttgggaggccaaggccaggaggattggttgaggccaggagtttgagaccagcctggtgaatggagcaagactctgtctctaaaataataaaataaaaaattttaaaaaaacttaaaaaaagaattatatgagttaatgtaaagtgcctagcccagtatgaagcatactatatgtcagatgtatctgtcagatatttattaacttctctagcccttgtgcttgttccttaatagaaatagcttctggccttttctcacagccaatggaccttccctcttaccccataaaagtcctctatggtcactcacaggcttaaacccttactcgtcctctatgatcagcatagaaccagggaagagcagaggcttcacaagagacaggttaggcttgggaaactgaagaaaggtctctcgggctcaggtggaggggtggccctggcaaacagggcagatcattccccatcctacactgcagcctatggcccccagtagctcagtatggcagggggtccttctgttagcggctcctgcaatgcataaggttccctgttgtcccagacttctccacattccccagggctttcgcttcctataaccgaggctgacccagaacaatgttgacccagaggccacaggaaagcaacccctcaggctgatgaagcatgtcagcaggggagcatgggggcagctgatggctgagagacttctacagcttgcctccaagtctggctctggccacagtgtgagacaggtaaggccactgtgtccctgggagcagccagtgatgtcatgaccactgaaaggactgacttgctgagactcagctcttcccagctagggttgctcccacccccacttctgccatgtgttcccttcatgaaaaccttgggtcagattttttaatggaataatgggtttgaaagtatcttaaaagctttaaagtactttacaagttattatttacttaagataggcctgcagtcagaactctggaagtgcagtaatatttagactttagaaaaatatctgcttaaatgagactatttttttaattcattcaacagatatttatgaacccccaactcactgagttaggcattgggacacaacactatccatgaagttgaaggagtagagactagaagcctaggagcgggagagaaggacgatgagctagtaaataaaacagatgaaataattaagaatatgataagtgatctcaaggaaataagaaaagggctagagtagataattttcgggtggacatatttacatagtgtggtcacaggaagcctcttcaagacataatattgaaagtgagacttgaaggctaaataggagctaactgtgggaagatcaagaaaaagagcactccaggcagaaaattacaagtgcaagagccccgaggcagaaacacacttgacatcctggcaggatctgaagacaaccaatgtaatcacaacacagtgaggaaggggagaaaggtagcagggaaagtcacagagaaaggcaggggccacattatgtagattccttaggccaagggtttaggattttattttaaatatgatagaaagggtttagccaggctagtcacataatttatgttttcaaacagatcactcataccgctttatggagaacatactaactataggtaagtaagaaaaaatcagggagacaaagtagagactattgcagtggtctgggcaaaaagtgatgatgaatggattccagggaaaaaagaggtagtaggttgaaagtgagatgtatatttgagcattttcatgtaacattataatttttctttttcttttttttgctttttttttttctgggacagagtctcgctctgtatccaggatggagtgcagtggcgcgatctcggcttactgcaacctctgcctcccagattcaagcaattctcctgccttagcctcccaagtagctgcgattacaggaatgcaccaccatgcctggctaatttttgtattttaagtagagatggggtttcaccatgttggccaggctggtcttgaacccctgaccttaggtgatctgcccaccttggcctcccaaagtgctaggattataggcgtgagccactgctcctggccttatgtaacattataatttaaagagaagttatactatcaggatttgctggtgttggagaatagaaagaaagaaggatttctaagtaagaaacttggtttatggatcttgcctgaaatgggaaaagtaggcagaaagagagtttggagggtaaaagtaagagttctgctttggacaggttaagtttgaagacatccaagtagggacattgagtaagcaggtagataaatgggtttgggactaagtagatatccagataggggctgaagatacaaagttggtagtcatcattatttagaacttccatggtctcagagatagaatgggatgattcagaaagtgattgtagacaaagaaaagaggaggcctgaggataagagtatttaaaagagggagatgaggagaaactggcaatggacaccaagaaaaaacaatccagaaagatgggaggacaaacgtgagggggatatcccagaatcaagaagagaaagagttttgagggaaagtactgatcaaataatcaaatttggctgtaaagttgataaggatgaatcctgagaattgacccttggatttgccaacatggaggctgccggtgaccttgacagaaactgattcagaaaaatgggcagtggagtttagaccagtggagaactgaagtctgattagaatggcttagaggatcactggaagtgaggaaatgcctctttcaaggagttttaatataaagtggaagagagaaatggggccctgctagtaggtttttccaggatggatgatttactgaatgatccaatagggaggaagagactactgaggtaggaaagggaagataatttcaggtgataagttcttgagtaggtgaaaggggaagaggtccactgcaaaagtaaaggacacgggaaggatggcagagaatgtagggttgggagcagtttgttgatggatttggttgttgaaaattcattattcattcagaaaatatggaactactatgtgccagatgctattctaggaacaaggcatacagtagtgaatgaaacagataagacaaagcttataccctcatggagtttatattttattgaggggaattaagcaataatatgctaataacaaatgtatgtcagacaaaagataataagcactatggagaaaaatgatctagggtaaaggagtccctggagagctggagaagagggttgccttttttatagggtgacgggaaaaggtctaaatgaccaaggaccatttgagaacaggcataaaggcagcaagggaggaagtcatgtagatatttgtttccaagcagagggaacgaaaagtgccaagtccccaaggcaggagtgtgtttggtacaatctgagaaatagcagaagtcagtgtgatagaacaaaacgaacaaggtggagaagttgtaggggacaaggagagggagaacaaagagagaagcagtaggagaacagcttatatgtggctttggaggtaaaggcctgagctttatccatttcactctgagtgaaatgagaagccaatggagggtttcaagcagacacaggacatgatgtgacttacattttaaaagcacgcctttggctgctgtgggaattggactatgggaggcaagtatggaggcatgaacaccatgtaggagactgctacagtagtccaggcaggagatgatgtagttctcctaggattgcttctactttctcacggagtaagtgggaagatctccatgcgagggtatgacagaggcttgcagggagatgagaaagtgtgatagtcatatggaaagcatgataggactgctgcccacacagctggcatatagcaaacagtttgctaacatgcttgcttacctccgaacctctggaacccatctcactatgcatctctcttcctcctgtccagtcttctttccttcatcctgtttcttgtcctctgactccagttgaccttcagtgggctttaagaacccaagcactgattaggaaaatgacaacctgctgctgacacatccagcattttttttttttttttagacagggtctggctctctcactcaggctggaaagcagtggcacaatctgagctcactgcaatctccacctcctgagtgcatgtgaccctcctacctcagcctcctgagtagctgggactacaggtacacgcccccacacctagctaattattgtattttttttttttttagagatggggtctcactctgttgcccaggctggtcttgaactcctgagatcaagtgatttgtctgccttggccttccacagtgctgggcttacaggtgtgagccacggtgcctggtccacatccagcttcttataccaaaccctttcaaaggatttgaaggagctcctcagagtgctcagttgtcctttaaagactctatctaactatcattccactacctcacacccagaagtcaatgagggaggcccagcattcctatgctcttattaagactactctttcctacccataatagaaacctcagcaggatttgaggtagacctgcaagtttcctcatgctcctagcaagaccaccactccctgcttccatgacactactcatctcacaacggatggcctgacaaggcagtcccaacaagaagtccacaactggattggagtggtgtctcatgcctataatcctagcactttgggaggccaaggcagtaggaccacttgagtcctagagtttgagactagcctgggcaacatagtagacctcatcattgcaaaaaataaacaaaattagctggacctggtggtatgcatctttagtaccagctactcaggaggagaaggtggggggattgcttgagctcgggaagttgaggctacagtgagccacgatcatgccactgcactctagcctgtctaatagagtaaaaacctgtctcacctgtcttaaaaaaaatgtccaaaattagaactgatgaccgacttatcttgaaatgaccagtagagctgatcttatcctgattcatatcaatcttcaaggaggaagaactgaccatgctccagaaagatcaagtaaaatatggacacaaaaggtctatttgagttttcagttataaggttcctggtaacattataaagaataatttctatggagttatggtgaagtaaaagaatgggaggtgaagatgtagatacagagtatagcctactctgtaggagaagctggctataaaatgatggaaagagaaatgaagcaactagaaaaaggtgcctagttgaaggtgaattgttgttgttgttttaatataggctagatgcttataagctaagaatctagtaacaaaggagaaattaaagataacagaaaagggataattcatcaaggaagtctagaagaagccaggaaaggatgagatcacagtacaagtgaatatattagtcttggacaggagaaatgacacagtttcttctaagatgtgtgtgagggtagcgacaggggaacaactaaagaaaagtttataagtgaggagaggaagtgaaaagagttcatgtctaatggtatttgttttttcaaaggagttaatctgctgttggtgaagggactggccagggcggggtgtgtggggcagtgtggggaagatataagatagctattgtgtgaagatggtgggctaaccatgaagaccagtatggtatttagggctcagctgacatcggagaccccttatgtgtagtggcaccaacatacaccactgtgagattttctcctccatcaacactcaactccgggacaaggcagatgtttgaactcatcctaggccagggacttgtgttgggtggatatggtggcataactaggggttgatgggtgagaatgctggtgagagagctattacagtggtttaggctgcataggaaagaaagcaagatgaagagagggctgatgacctgggagaaagtagaggccaagggactggaaggcatgagcaaaggagtgagcaatggaagaataactgtggtgagtgggatattggagttttcgatttcagatacggaatagttgtggggaatgggagattcagagtataacccctggaggaggatactaatatggtttaaaagtaagtttccatggaattgaagaggtgggcatgctccatgcatatagggtagtgtcctggagaattgccaatgatttagactgggaggagttgacagcacgagacacaaagcatgaatactaaaaaggaagagtttttgctgtaggtgggaagaatagtagcctgaagtggcactaaggagctagaaaactgtaactccttcgttttacttcatttttctcctttcttccagtttagatcctttatcatcccatttggattaaagaaatattctactaattgatttccctgattttggtctcactctaagtgtccatcatacacaggacttctagcttgaccttgtagaacagtcttgacagcctttacttcactcctgctcgcaaacttcagtatctctctgtggaataaaatccaaatttcttagcctggcccttaaggttccaggcatagagatggcttcaatctactacaattgacccttggataatacagttgctaaggttgctgacccttgtgcgttgaaaatttatgtgtaactttttttttttttttgagatggagtctcgttctgttgccaggctggagtgcagtggcatgatcttggctcactgcaatgtccgcctcctgggttcaagtgattctcctgcctcagcttgccgggtagctgggactaccggcatgtgctaccacacccagctaatttttgtatttttagcagagacagggtttcaccatgttggctaggatggtctcgatctcctgaccttgtgatacacctgccttggccacccaaagtgctgggattacaggtgtgagccaccacgcccagcctatgtgtaacttttaactcctccaaaacttaattactgatagtctgctgttgaccagaagactgactgataacttaaacatcaattaacacatattgtgaatgttatctggtcctttcttatttacaaatccagacaaagagaaagctgcctctgaagtaatgcattacagctggaagaaagagccctgtggctttgttcttaaaataaagtaagctaggaaaagaaaatgtcattaagaaaatcataaggaaaagaaaatagatatacggttcattaagtggaagtggatcatcataaaggtcttcatccgcatcatcctcttcacaatgagtaggctgagaaggaggaaaagaaggggttggccttgctatctcaggggtggcagaggcagaagagaatccacattttaataagaccggcacagttaaagctcatgttcaaaggtcaactgtactttgctttatatatctagtttgaagcaatatcaaacattagcttgtattggtctaaactctacacttctttacctaatcttagagtactttcctgaaagtggttttgtttgctgtctggaatgcttctccactcctctgaatattcaactccatttatccttcaaggaccaaatcaaatacagattcttccctgcatcaaaggacatttcctttccctattcttcttaaaattccactttactccctatattctagttagtcctgtacctaataagaaagaaccatgcccaatttatgctcataaccccagctcataatacttcgctcattatcttgctccttgtaggtatccagtgtctgctaactaaatgcattcatacattcatgaataaataaatagagctcttataacgttgcagtcgtgttaagggtcagaatccttcactagaagataatctcgaggtttagggttgatattatattttttatcctcaatacttagcaccattctggaaacattgtaacctaagtacacagtacaataaaatcttggtaaatggaattgaattagtgtcttcacacctaagtcattctcactgtgtcaatcccaagtgctctagagagtgaacacggtctctgaaacagcaaatagctgttaatatcctgaagtgagtaaaatgctgcctcttagaactggatagcaagtctcttaacagagactatttatttattctttcattcgttgagtcataccatgaattgcaattgatctatatccaataactattatagacactaaggagaaaacaatctgtgaaaataaggaggtgaaagaatgggcttggcttcttgctgggatttaaatgccctttttcttaaggaaacaaaatgcatgcctatgttgcattttcgctctaggattttccaagggaaacccttcttctaaggacggtcatgtcacagtagaactgaaaatattccccatcagtattagacctgaaaggaaacaagatttaccaagcatggggagccttccagaaagcagacagctcatgtttataaagtaatctctcctttttctcctgtttggccaggctgtgacaacatgctgatgggcataaagtctttgaaaatagtgaagaagatgatggacacacatggctcttggatgaaagatgctgtctataactctccaaaggtgtacttattaattggatccagaaacaacactgtttgggaatttgcaaacatacgggcattcatggaggataacaccaagccagctccccggaagcaaatcctaacactttcctggcagggaacaggccaagtgatctacaaaggttttctattttttcataaccaagcaacttctaatgagataatcaaatataacctgcagaagaggactgtggaagatcgaatgctgctcccaggaggggtaggccgagcattggtttaccagcactccccctcaacttacattgacctggctgtggatgagcatgggctctgggccatccactctgggccaggcacccatagccatttggttctcacaaagattgagccgggcacactgggagtggagcattcatgggataccccatgcagaagccaggatgctgaagcctcattcctcttgtgtggggttctctatgtggtctacagtactgggggccagggccctcatcgcatcacctgcatctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcatttaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatacgtatgtttgttcacctactcttatagtcaatgcgttcatcgtttcagcctaaaaataatagtctgtccctttagccagttttcatgtctgcacaagacctttcaataggcctttcaaatgataattcctccagaaaaccagtctaagggtgaggaccccaactctagcctcctcttgtcttgctgtcctctgtttctctctttctgctttaaattcaataaaagtgacactgagcaaataacctcatcaggttatatttgcccacataccctaagcacaaaagctttctgggagtgctgcttgtgttaggtttactgtgaatgattcccaacacactgaggccctggtaaatattctggaatctggacagaagccatacagcaggcaagcgactctgccacagcaggcatgccctgtggcaccgagggcagcatgcctcttgacaggggcttcctcagtgtttcccacgtgtttgtccaattcagctaagttcgagtcacaagtgcaggctgtggtgccagtctgtgtcacgtgctgaagcctctgtctttccaggttggtcacatgagaaggtttgctttgtgtgcttgcagctgttttcctgtctttgccaagcccaggctgggaccataggcagtgaagagaaaatgtttttttccatagcatttgagtagatatttggcagaagggaattactcaacccatggatacagtgtaattacccacagttctaacagaatggtacagagaggccaaatcctttgtggaatgagacaggtatgaataaataaatgtgatattacctgccctattacctacctatttcacagatagaaggaatgtgggctgcctcacagaggatagtggggtagatttatcaataggagtgagtcctgcaaccatagttcctttggaggcacagaggggaggttgcctgaaatgtgctgtctagattccacctgggatatgatttgattgacagctctgcagggcacatctgccccaaacaactcaccttggtacctaccttaaatccctgcagctcgaatcactcttttaggtcaagacattttctccaggaagcccctgttaagggaccactttgcttcttgtgagccagcgcaggtcagtatgcaggcctgggaatggggtttctttcaggtgaacgttttagctctggggtcttgttggatttaagtgaagactgacatcgacatggcctacatcagtggttcttaaactttgttgcacataagaatcacctgcggagttttaacagtcctcatgccgtggccatatccccaagaccattaaatcagaacctctggggatggatcgagatatcagtatttttaaagttccttcccgcaagttggttccaaagtgcaaagaagctccagagccggtgacttagaacatttaaaaaggtaactgtatcaatttaagaacaggctagcagtttctgggggcggaggtaaggggagtggctccgctagggcaataaagggtgggattcggaaacagccatgaccttgtgtgaactgtggcagcctgcgtctacaaaagtcgctctgctgctattttaaggaagtgaaagagaactgaagggtgtcctgttgtaacacaactcttgcgggccccagccttcccctgctggctgtgctttggtctgctgctggccaggttcccgcagtgaccacacgtctcatatttgccagggtgggttaggttctgttcacatgtaaaattctcctgggcctactggtcatttcagaccgcgagggtaaatttggtttgaaaaagttgtgtcctgtggagtttgtcgacactccagcctgtagagaactaaaggctagggctgtggtgactcctgccagagctggggactatgccgagtccctggtgtcgctgccatctgaggcctacagggattttaaacagcttaacagcagccagtccttggaggcctgggcagggccacaacatagcagtacaaccaaaacgggttcaggccacacgctggaggtaggggctggaccagatctccagcttcagtcctccccagttcgagaacccattcctgtggtcagacattgccaacgcttttcttggacctaaggtcccagaccttggcgctgggcacagggaaatgcttcctgacctcggctcttcataagacagaacttttgtttggtgccaaccactagagggacctccaccccaggttgcgagtgcagcgcggcgggacctgggatgattcgggggctttccgacctgcttagggagggcggctcagagacaacctcaattttgcctggattgcacgcgggccgaggaagtcgggatgctccgaagggtttctgctctgggagtgcctctaatgtgggttttctatgctttctctcttcgcaattctcgacaccgtttccttcttcctcgctttcattccctgtgaccggagaacggcgctgaaggactggagaagcccaggagactgggagccggagcgccgggtacccacccgggcctccccgcaaccggagctgtgcggaggaggaggcgcggcgaacggggcggggctcccggaagggggcgcggtccgccgagagaggcggggctggggcccggacgcgcggcccagggggtggggacgaggcaggttcgaaggggcggggctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggtcagtgggctctccccacaccccgggcttgccgcgcggtcggggttgggatccccgtcgggagcattacctagggagtggagcgcccccagagctacgaaccacggggacgtgtgggtcagtgtctctgtgagccccggagcgtgtcccaggctcgaggacggggacccttctccaactccactggccagaagcctgggaggagggcagaactcctgtgggttggctgcgaatctccacccaaccctgcctgggatccgcggacagtccgcactcctgcaggtgccagcgtggccctggagatgcgcagggaggtggggtccctgagttctgtgcggcgcgtcccagccctgctcagcccggggagcagcggcgtggactagggagcctaaggaggttgcggaagctttaggtctgtcagcccaggcaattctctggtggacacagcgtgtgtctagatgcagggcctcggctaaagccagttctgtagtgtaagtgcaaaaatacagcacactttttaaaatctaaagccgccgcgtcccagtagactgcaggatggggacggtcctatttaaaagtgggctccctcctcacctcatcacatcagattccagacccgcagtttttcctcggatgaaaataagattatgtaacaagagaacagaacttccagcgtttggataggattaagacaggcattcttgccagtgtttaatcttcttaaaaaacgaatctaattatatttttacttttagagcagccagatatttggtatagatccgtgtcccttttctatattttggtctacttcctgtctttctcttcgtctctctcctttctcaacccctccttaattgattgtaatacaaatctgaagtgttttcaaatttgtagtgtattatgtgaagttaaatggtcaactacagaaaagtagttggttttcgacataattcatcttcagcatattcagtctttcattattataggtgtatggaaagctgtaagtgttatctaatttagaaattatttctctttggcttaagagaggcaacccatttgtactttgcttaaattcatagctaaataaatttgaagtgggagatggggatgattgatgaggttttcactgattgcatttatccatgttttatttaacatatttcaattattagtaatactattttaagatttggtgatgtgacagttgttagcttattgctactggagagataagctgcttaccatgatgccttctttactgggtagctaagggagatgcgctttgactttaaaagagtaagtggaatgagatcaatgacatgaaggcggtaggaacaaagttatgggaattcctgtctttcatctgagcagggaaatctgggataattttaagaaagggtgatgtgatggacctcaaaggatccctcctggggtttttgaggcagagaagggtagagtgtggcctgggctgtgacaactgtgtgggcaggcaggcatggactcaccatgagaagtggccagtggtccagcttggctcttatgtcaagtgctagtcaggaaagctggtgacaaggctggaaaatagtcccagctgtccagtacagaagtctggacttggtctgaaggcacagcaggggactgactgatggttctgtgaacttctcaaagtcaaagaccttggtccttgaccctcccaattcctagcctgatacagagaaaatccagtaaatatttgtggagtgcatggtctgacaacactgtagagcagagcttctcaaagttgagaatcctgtggggatcttgttcaaatgcaaattatgattccataggtcaggggtgggacttgacattctgtgtttctaacagattcccaggagcttgctgatcatttccctatgtgtagcaaggatttagagtagcagtttgcaaacctggctatgcctcataatcgcctggggagttttgtaaaacgttcagattaagtagtctgggatgtttttaccaagttcccccaggtgattctgttgacaaacccgaaggcaactgctgcaatggcaaagttctgggagtgtggtgggaagcaaactccaagggaaaaagacagtgggggcggcgaggccggataggaaaccgggaggctgatccagggtcaaagggatgaggccttattttgggcctgagagagtgatgaggtggggacaggtagggagacttcggagagatagaatctgtaggacagaggactagggaatgggacagtctctagactgattagatgcaatgagaagtgaggagggagaaacaatgctgggaagattcagctttgggcctgaggaatggtatggcctttagactgtaatgtttaaggtaaagtttatgaaaggttcttgtattggttcgaaccccgagagcctgccaacagacaacatgaggcggtgtggggcaacgtgctgttttaacgagcgcctgggtgcaggtgggctgaggcctaaaatggcgtcagcaccaagtgaggacgaggcaggggttttatagtttcctgtaaacaagaagtgtctcagtctgatgtaacttctgcacagtacccagacggcccctctctctgtcttcaaggggtacgtgtcttccagccagggtaggtgtcttctggccggctgtcttcctgcttctgctgtcttgctgatgcacactgctggcgcaactggccttgcaccttgggactgggcctgagaagggaggagttactcatctcttcaagctttcagaccccggggagaatctttcattcctgtctatttggttatagtaaaaagggaaaaggggtgactttctcaataactacttcaggcgtgacttaggggtggtgtgggctccttggaaaaagaaaaacttaatttttagggtattcttgagagatgtgttggtatccatcgtgtcgttgtagcaggagcatagtctgaattgtctggtggctaactgtagtttcaataagagttttagtggcttttattattagtgggataacacaggggagaaaaagtgatgaagattactgtccctaccagggttttaaatcctcctaaattagagaactgttgtccggctgctagagtgagagctcgagtgagggtgatgagttcagctttttgggaggtggtgcctgggaggagcagattggcttcaatagtgtggggtctttaagggtaatgtggacaggggtgtggtgttttgcaactgagggtgtggaaatatccctaacagcggggttaactacagataggggtaaggaaaggttgcatgttttagggtgggaggttggaggagcagaagaaagctagaagcctcggaggggtctgggttgatgcgttgggtactacggggaatgtggaagtggagagtagtgtggagttttgaaaggatgtccctgcctaggagcagagttgggaatgagaccaggtttggggtgaaaaagtgagtgaaggaaaaggtgtgcaggaagcagaaaagtggaggggtggctcggggttaggagacttgtccatcaattcccacaacagagacttaggaggactgggtgggtcctgaaaaattaggtaaagcagagtaggtcacccatgttgattaaaaccatcagggttacccttggctcggatgaagtgatggtagttgccggggcatccattccagggcaccatcagtcttcagcggcaaggcaaatgagatccgagtaggaggttttggcctgctcatgaagggatggggggcggtccctgcaggggccgctcatagtccgacttccagtggggtcctccgcagagggggcacggcctggtgggcttacctgggtatgggcattgtctggaccagtggctttcattgccgtacttgaaacaggcgccaggtggaggtggattgctaggaggcttctgtgtggagctgtggccccgtgggcctgcagggcccctgatggcggaggcaggcatttgaaactctgcctgtttttgccttttactttcctcatcatgattgttaaagactttgaaggctaaattaagaaggtcttgttgtggggtttgagggccgtcgtcaagcttctgaagcttgcaccgaatatcgggaatggattgggagatgaaccgaaggtttaagatagtggttccttctgggttggctgggtctaggttggtatattttctcatggcttcagttacatgagagagaaaaagggctgggtttttgtcaggactttgggtgatttctggaagtttttcatagtttaccactttatgggcaccctttttgagttctgcaaggaaacacataatcgtgtggtctcgatggcagcatctagaggccctgtcttgataatctcagtgggagtcctggttggggactgcctctgcaccagtaggcttggcaggagcttgttgatgaattgtgtcagcatgcacctgagctagggtccagacacagtcctggtcttctggggtgagggtggaagaggggataacgtagaggtcatgccaagttagttcataagactgggtaaggtactgaaactccctgatataagaggtagggtcgtctggaaatgaaccgagtcttttgttaatttgagagagatcagtgagggagaagggaacatgaactcttaacaataccttcagctcttgctacttcccaaaggggacactctagcactggcgctgaagtgagggtggggcatgagccaaagatggcgctcgagcgagtatgggcgggagagaaggaagaagtcagaagtcgttcctgctgagggtttgaaggggaaagggggtttgagttgataagcagtggaggacagataggggcgtaaggtggcgggatgggtttacaggcttcaggagagggcagtgaggaaggagaatgagtacaggcagtgctagagttgtcctcaggagaggacagtgtaggaaaagaagtgggtactgctgactgggaagatggtggctgggaagatggcagctgagaagatggcgactgggaagatggcagctgagaagattgcggctgagaagataaagaggaggcttgcggggttaaagaagatggttgagagggagaggtagagtctgggaggaatggacagcagtctgctggatctaacggggaaaaagaggtatggtcgggaggagaaaggcgatcagggctgcgagaatggaggagaaggatttgaacaggtgagcaagaattgcagaggtcgggttgtgatctgagtgccaaaaggcctggaaataaggaatttcttcctatttcttcggtcgttggcaatacttgcttaaatcagttaaaactgtaaagtcgaatgtttcatttgccggccatttggaccgttatctaatttgtactgtggccagactgaattgcaaaaaaagaaaaggcgcttagggcggatatcttgcctgaggcctaaggtttgcaggttttttatgaggcagcctagagggctgttttttagaatggagggccgggagtttcccataatgaagggtaggcacaggagaacagggaaaaaggagacagtcctggacagccggacggagacgataaaaggagcgatcgtcaccactgcctttttcattcctggaacgggatcaaatggcttagaggtgtccccctaagaccagatgatcagcgagtgcctggcacacgctggagcctttttggaccaacgttggattttcggaccagagaaaccaaaagaggccgagcacgtttttccctgttaaccaggttcccggggaagcttaccagtaggtgagatcagtgactgatctgcatgcacagagaggcgactggaggctaaggagcttcctttgtccagctgctgtggcctgctttccagcatagaggggtaggtccacgggggacacagacccgagcctctcccaggtttcggcaccagatgaaaagttcttgtattggttcaaaccctgagagcgctccaacagacaacacgaggcggtatggcgcaacatgctgttttaatgagcgcctgggtgcaggcaggctgaggcctaaaatggcatcagcaccaaatgaggacagggcaggggttttacagtctcctgtaaacaagaagtgtctcagtttgaggtagctgctacgtggtacccagacggcctcccttttggttttcagggggtacgtgtcttccggttggggtgggtattttccggctggctcttttcctgcttttgctgttttgccgacgcacgctgctagcacaactggccttgcaccttgggactgggcctgagaagagaggagttactcatctcttcaacctttcagaccccagggagaatttttcagtttagaagtggttttttacttggccataagattttttttttttttttcctgaaatgcaaatctgttcatgatgctgtcgtgtttgaaatcctctggtggatatcctaatgcaaaatataagaaggaagcactaatataaacacaactgataacacttgttccattctacagcctgttcatccccattcaagatgtgacattcagtccccatttggtgtgggcacaactaggctgaaacttttggcagctttgtttattcctgagtcactattttccctgcgtccttcttcttcagaggagctccacctcccttggactttatgtttcttagtatcattttttggttccaatgcttgatggcacctatgtgtctctgtcttcatggaatctatgtagttctaggaaaggtgggctttatcctttatacacccttaaagccaagtcttgtttgactgtggatcttcacaagcttcattcttatctctcactcatctggtaaataagcctctaaaagaggctgtcctagaataatctgtttagctttaggcccagatctccttagtgcctcaagttccaggggactgctgactccgagctttgtcttcagcaaatgtatgatttctgtttgccttaaggtcgttggcttggttctccctggttattcttactttcacttcctctctctgtcatgttcatatgtacacatttatgcacactgaaagctgagcattcattgtgcttgatgcttttaatcaccctgttctatgttgcatagtaatcatgatccctaacatacctgtagatgggaggcctagacacagaaggaataggactgtctctctgataggataaaatacaccatccttgtatggcattcaaatctctacagtggtgggccctactttagctctccagctgcctctccactgttccccaaactgagaagctgagtaatttctattcttttgtgcctatctgcatttgcatacactattttatcttcctggaaagcccttttgtctctattctgcaagattattaatccttcaggatatagatcaaattcttaaagctcccttgcccctaagtcgtttttactcttctgttacatacatatcacatcaaacaaagatctgctatgctatttcatcactttatgtctatgtctctgtccatattcctccaaactctgagctgctttagggctgtatcagctcttgtgcgtggccccacacttagcagatgtccaggaggagtctgtggtagatatgggccttaagctggctggctttgcaatgtttacctcagtaaagagggaaaggggctggttatttcgtatggtagacgagagaaggaagaggagcagaagctgaaagactgggaggaaggacaggcccagtgaagagtgggcccatatggctagagtcagggggttgggtggacactgggagaggtgaagatggagtcccaggctgggaagagatcatggaaggccttgaaagttggagctatataatttaaattttattctgatgacattaaagtttccatactcaagtatggaaaagacgtggtaaaactgttcaggatgattgtggctgggaagggcaggttggagggacagggaggaacttcttatgagcacaggctgttagaataacccactgaggtagctcaggacctaaatcaaggcaatggcagtaggaatagagagaagggagcagaggcaagtgaccatgccaagaaatccggcaggatttggtgactgattgtatttgagggaaagagaaaagcgtcaaactggatactgacgtgtgttagtttgctgggagaagaatgaggcaactgttagtagcatgaaagcatggaggaacttagtggaagggggaagggaaatgaaagtggttgattcttttggaatcagaagggagcctcgggtagtttcttgcttgccctttatatgtttacccataagaggatggtgaagcccagagaaacctacccaagatcacttagctcttgattgtagaacccaggtctactggcattatggcctgggcttctatcttctgtagcacatgagtttagccagaggagagctgccagaaggtcgagatggagattccattaggcaatgaaaaatgggaatgagaccaggtttggggtgaattcagcctgcagaacagctaaggctggagtcttataggtcaagcacccagatgggaaatgtctgctagttgccaatgccatgggggcccgaaggctcatgaggcctcctttttgccctgtggcctagctgtatgtggggctgatgggagatatgaagtacttttagggtatcagcgctcttatacttattatgctcaatgtgggcacgtgtattaattttcttctgggaatgtaaccaccaatcaatttatcaattccatgggaagttgtattccaaggcccaaacacctcctctacccagacttcagggcacatccagccagttcatgagaagttgcctcttatagtgttggagtggggatgggggtacagggaacagctagctagggaaggcaaccagccatgaggacctcatccaagcagggtccggtgtagagtcaggatcggggactcagatggctggatgagggctacagctgtccgatgaggagtgaggatcttatctggaatctgcactgctgtcgggagactcagtggccctgaggctggagttcttcaatcctcctcacccctcccttccacacacctttgcccagccaggctcctcagcctccagcctcccaggatggagtcttgtctttgtcatggacgctgacacagtggtcacttctgtttcttgaggaagagccaggtttatgaatgtgaaacatttgaattattgtctgagttgtggtagttgccaaataaaaacatatacacaaagaatactgggagccaacgttgaaggaaaacttgtcaaacttccctttctcttttgagctttgtagtggggtcttgccagtttatacctcatcttgttctgaaggttttttgtttctgtttttcatattaaggccaaaatatgtgcacgagcctgctcacccatggtaaagtgtcagggacagccacaaattgcacagattacagacgtagatttgcacttcccatttcttaggaagtaggtgggtggaggaaccactaatgcatctccaggaagggatttgttagctcaagggaggctatggggactagatcctacattgcctcttcccaggcttatggtcgctgtggtgttcccaggtggctctgcttcaggtatgtctctttcctcctgggaatagggaaggaggtgatccagatctcaggatttctctgcctgcttagggatgccagtgaggtgtgtttagtggggatactcttgtccctgccctccagggtaaagttacacttccacagtaacttgtgtgcatggttgaaatgcagccatcacatgcagctgggcctctcactctgacctggagggccactcctgtgactgcactgattatcccaagaggccttcttagcaaacttctccaagttgcttctggcgaaaggttcagagaactctgccaaaaggaactacttggttgacaactctgtgtgtgtgtctgtgtgtgtctgtgcgtgtgtgtgtgtgagagagagagagagagttgtgtaggaatcaagaggtttgtaatagggacaagggggacagagagggggtagagccacagctcaagcttaggaagatcaaaaatgggttacctctttcttgcctgcttaggcaagaaagcctctatcttcaggggcaacagtttccttctcccaacacacaagtccatgttccctccaaatcaaagaggtttttacacaaataactagctcaatgctggactgcttcatggaggcagtggaggtgtagactggccccacagaaagtttcttccacaggaaaggatagagcagaacttccaactttggtggatttgacaaatggcttgtttcatgaggtcagggtagtgttattcccattttatgggaaacaggtgccagagaagtaaagacacttttgaaggttccagagtattagatttaatgtaatttattgtccgaactgaacacttttgaaagtgaaagtaggcacataaatgctaaactgggtggggactggggaagatcaggatcaggcacattgggatgtgtggtttcaaattcagtgttcaaaactccaaattctatgagcaatgggggcagaaaagggaaggggtggggtgggagagtggattggcctgagggggtggagatcgatttgggataggaatagcagattcttctaattcaacatttcaccaaggcagaggaatagttcttgactctgacacctgaccttgactggatgtcatgaaaaagtttcattacataagctcttcctgcgaccaaccagccaagacatctggttcttggatgcatgtgctcacctggtaacaacaacagccttgtgtgtctgtctgggttttcactgtgcctgctcactggtgcggcacaatgccccgggcagggattattgttctgcttgtggaaatgaggaagctgactcctcttgcctgtcctgccccctcattctatcatggcaggcaggaggttttctccagcatgaggacttggcctccctaactcctgtgggccctggtagctctagagtggagggtttgaatcagacagtcctcgattaaaatagctctacaccaattcgctattgctccgtacctctttgagctttacattcctcatctgtttaatgggaacaataataggccaattcatttggtggttgtgaaaattaaatgagatgaaatgttgactccagtgcttggcacatcataggtagtcagtaaatccttttattcccgtctcaggaagcttgagagaaatcatttatcaagagatatttagatcatccagagggcttatcctgaaatttcaggtgggaagttgcatgctctgggcttccaggtatgacacagaaagggcaaccatggtggcggtgagcagaaattccaggaggcagaagtccatgacaaggtagagaacagcccggaatcaggtggctggtcacccacgtacaggacaaaagcagcaaacagcgcagagtccaaaccagctggatgagatgtggcagggttaagtgcaaagtcctgcccttaggccctgaaaatcaattgtgtgagtgtcctacccatctatgtggaaaagcccaatacattggcttagcctggctacattaattgaagtcctgggtttagaccttggtagaggatcttttccctgcattggctgagactggccacacctggagtgtgcaaagccggtatccctgtcttacaagctttggaggggcccaaggacagtcaggaagatataggggaatgactgctattttcaggtgggcaaggtgggcagcatgttctttgttgctcagagggcagagatgaaggcctatggtagtgatgtcaaagaaaactaaagacggagcagattctactttgacataatgtaagaaattttaaagaactcaggcttgtctctagggccaaaccgctgttttagagcagatattggagtctacctgcaaagggtattgttcaagcagtattgactagagaggagtttatgaaataacagggaggaaggtatactgaaaggttatagatctaactaaagtgctgtaagattttggcaaagggaaggctttgtggatcaaccaactggggtgggatcctggggagctgggaagaaaaggctctctggggatccctggtcagtcaagtgagtaaaaggcatagaagcccaagtgagtgaagtgggatcgagaaataataaggaaaccagcttagctagactcttcccattattaaaagtcaaagaaagaagttgggactctaagggaaaaggaacttgaatgccaaactaagaagctggactttaccctgtcggtagtggggaataattggtggcttctgagcagaaatgacttgcagcagatgtaggctggagtgagggtgggaggctggggaaagagcagccttaaagctgtgcagaagcggccgggtgcggtggctcacgcctgtaatcccagcactttgggaggccgagggtgggcagatcacgaggtcaggagattgagaccatcctggctaacacggtgaaaccccatctctactaaaatacaaaaaattagcccggcgtgactatgcggaagcttctctatcccaagtcgcaggctgaacatcccacttagtgacaagggctgggagaggggaaaggctctgagcaaatgtctttgtgggctgaaaatgagactatgatcccaagaagtgactggactgtgtatattctttgctgatgcctaccttggcccaaccatctgaaagctgttttagactcacttgccaccccttgaagattttgagaacacaccatcctgagacctggagaaccagggtatgtggtgtgagacagctgggttcacagcatcctagagggcatagcaggtatagaagggagtgatccaggaggacactggtcacaagaatgtcctcctggatcactcccttctatacctaccataccctaggaagtctgactgtctgcaccttgggccatagagtgagcaaggttccatccctgggaggggaggcaaggaagggatgtgggtaccagggcctcattcaagtaggctgaggttttgggtggggtgtggtgtatgggaggagagagttgctgtggttaggcaacgtggatgtctgagcagtgtgatatcttggtctgggtggcagggaaggagtctggcaagaatggtaggaagagtggccatggaaccccaaggtcagaactggcccattggatctggggaaacctaccctttagcagcagaggtagagcatacttctcaggtactgtggaatcagtaggattgtgacagtatttattatttcagcctctaaataatttttgaaccattgtctatgctgagaatggtgatgatgggaccacaagatgaacagacatgtcccctgactgaatggaacttaagaaatgtacccccttactcaaacagatagtagtaactgctgagaaaatacagttaatattcagagaaagatgttgggggggcctggcttgctgaggaggtggcatttgaggtgtgtcctgaaggaaagacagggaccagagttgcccgtttctatggggctgaagggaattgctggcagagggaacagcagtgcacaaaggaaggcatgagtaatgccaattaaggggcacctgtggaaaacaactggcggcatgatttggctggaactgaagagtaaacgaagttaaatagggcaccagggattggaaattaccgtctatgaagtacccatcatgcatcaggcattgagcacagagtctgtgctcacttaaatttcaaagcagcctttcagggctttaactgaggaggaaatgggcttcaagaagatacctgatcatctcaagtttccctaggtggtgagtggccaaaataaaattgatgtccaggctgcctgaccccaaactctgttctttccacttaatcttgccactatgtttagagtccagattatgcagtcttaaatttacagtgaagacctgttcttaccgtatttaggcaggaagatggtcagatggcacatggcaaaccacattaacctttgagaggcacttagtggacatggccagatagtcacaaagcatatctgagttctaatacatatatatgcatgcatacacatatatatttaggaagttaatctctaacttcctaaatgcagttttcacattacaatagaaactgttactcccagaccactataggcaatttctgaattgctggctgaattccagtattttctcatcccttcaataaagtatattagaatggggcaagataagcctgaatcttctctaatttatacaaaaagcttctatcattagtaacaagttacctacaaccaaccttacctgtttaggataccaaggtgtcagccctaagagatgtttagcaagagtggtactccaagaggtttggaagcgtgggatgagggtaagagtcagagaaatgtgggcagtaacccaggtggggctgtaggggttgagaggagggaccgatacagttcagtaagcatttgctgagagcctgcccatgcaggggtgtagagtgggtgctgggatacctgcatgaaaggacaacattgttttcacagatcacatgttcaagctctgagcaggtgggtgttggtgaggactgcctgctcaagttggggttcttatgcgtatatctagtacagtcagccagtctttgttgctgagcaggtctgcccagggcccagttctccatccagtttggccttcctcctggagctcagaactcagatctagccctggtggccacgccttgcttctgtcctcagggtggacccagggtccttcagacttcctaatgggaggcttttcctcagcctggagagaaaagttgagaccacctgcgaggcaatagtaaccactgagaagacagaggaaatattcagaggaagaagttgggggagcatctgggctgcagtgacgcaggatttcatgttaacaggagacaatgtgggaggaagctctacctccttgtcctaccacttaataaggtacactgtgagaacccgttaaaggctcttccagggtcacaaatccagtcctcaaatgttatgatttatatttaaaagagaattttagataagccaagtgacagctgaatgggaaatggagttaatgagacagatcttatcggctccatgaaaaatgcatctcattacatcactgttacacatcgtatatggaaaccttccctcagtaattcctggagtgattgcctgtctggctatcggtgtccccaaagagtgtggtgtccactgagaataaccgggaggcctttctcagataccagtacggctcagccatcttctctcaaggccatctctagagttattatgggctctcttgatgccagtgcatggagccagggactgctgcaccgaggacaaagccagccagccatgaacgtggtcaagacttggcccttcccctccctaaccctacagagcccagttcagctttagcctccatgtttgaggcctcccaaaatccatttccccagcggtgtcttctctgtcaggtacctgcccctgggatggcccctgagcctcataactcggcctgttcactgttcctaagcaggtcaccttgtgaccctcgtggaatggctgaggaaggaaccgaggggctgtaagagtggccgtgtgatccctaggaaaccttcagctctggaaggccctgtggccctaaccttgccctgttttgtcaggtactgctagagagacgcagaaaacctggagcatgtgtgctgtttgagctgctgtatcccagggtctgccactttgggggctacctgcaagagatttggcaacttctcaaaggaactcaacatcatggttgttgtttttttaaccctgatcccaacatttaggccctgatgaagggtcttggccaaatccatcttctggaatagtacagttgggaacatgttctctgatgtggagaggcagagtgttacatacttactgggccaggcactgaggtgggtagtttattctgtcctctttcttaaccctctgactaaccctgtgtaaggcagatattatatccattacatagtaacctgagaggttaatgtccatattacccaaggcaaaaaacgaatccagctcataagtagtggagcaaggatttaagcccaaatctgtctgactttgctatggtctgaatgtttatgtctcctaaaaattcatatgttgcaatataatccccaaagtgatggtattaggaggtggggccttgggaggtgattaggtcatgagagtggagccctcatgcttgagattggttcctttataaagaggccccagagaactagctggtttcttccaccatgtgaggacatagctggaaggcaccatctgtgaaccaagaagcaatcctgctccagacactgactctgctggtgccttgatcctgggcttcccagcctccatagctgtgagaaatacatttccattgtttgtgagctaccttcccaatttatggtaattttgttaaaacagcctggacagactaagacaaagcttgggctctttctgctgcatgctgctcctctctttcttcaggggaagaagcacctcacttgggaagaaaggagcctcagaaggcttgaggctgggggtatggggacccagcgtctatactaccccttctgtggccatttggagtcacatagacctctgtaattttcactttttcctttgattctgaggaactgtttgggtatcttctataggggaataaagactctgctttatggaaaggaagagctgagaaagatgggagagaggtcccaggagatcattagaccttcccactcccctggagtccagctaacaaacttccaggagcaaaaccacttgggcctgcagggaaggggctacctagtacagtgtcattctccagcaggcctgtctttggcctgcaggaacacttgtgcaagtgggggattcctagatcacttttcttgggaaagtccctaaaccactttctggcctctgaactcttaggggagggaagtgatccaagtggcaaatatcttgtgactggcaagccaaggttagggaccaacccttcccctgcctccccacatgctggagcttttgaactgagttgaagatagctgggcccagggctcttggcccttgaatgcagcttgacatctggtcaggctgcaggatcttagggtttcctctttgtagcatcctaaaatctggcctcactaaatggtctcggtccagaggtgggattcgacttagagctgacttacaaagaatacagataaaggaatattgggaactgtgcttaccttgatgtggtttaaggtctgaggatgtgaagaaagtctctcctggattaagagggaaggggaacaccagtgggtcaggatagaggccgacagccctggagaggaggctgccttcttcccataactttcccagctgcgtgtgtaggatcaaatgggggtgtgtgttagtttgcttgggctgccataacaaagtactggggggcttacacaacagaaatttattttctcacaattatggaggccagaactctaagatcagggtgttggcagggttggtttcttttggggcctctccttgacttttatttattttttattaattttttttttctttttggagatggagtctcactgtgttgcccatgctggagcgcagtggcacgatcttggctcacagcatcctccacctcctgggttcaagtgaatctcctgcttcaacctcctgaggagctgggattataggcatgtactaccacacttggctagtttttgtgtgtgtgtttttagtagagatggggtttcaccatgttgtccaggctggtcttgaactcttggcctcaagtgatccactcacctcggcctcccaaagtgctgggattataggcattagccaccatgcccagcctctccttgacttttagatggctgtcttctccctttgtcttcacatggtctttcctctgtacccatgtgtcctaatctgctctgcttttaagtacaccacctattggattagggcccaccctaattatctcattggaatgtaattacctctttcaagaccttatttccaaatatagtcacattctgaggtactgggggttaggacttcaacataagaattttgagggtgtgggtacaattcagctcataacagggtgtttccaaaatcctcattgaacaaggctcagtgtcatggtgaagcatggagaggcacttactactgatcctgccaaccttgggaccaggagaggatggtggacccagctagctagtggaggaagcctgactggcctcgtccaaaggctcagctccaggccgagctgtttacttgtagtcaggctctctggcagcagtagtttctgtgcagtgtcttcatctggctcccgtgtggccctcggaactccagtgaacacagagctgctaataccctccagcccaggccttcgggggaagcctccttctcctctgatggaggcagaggccaggctgttgttgacagtgcacacaggcctgtctttaaagaaattctttggtcttctactgacttaactttttttattgcaaggggaaaagcattgcattgaatcaaaattaaactgttcaacaaatgttgaaatgaaggctcaaattacagaatacattttgattaattcaattagtgtttacctccagcctgccaaattctggggcctattcctcagcaggcagccagggaggctcgtaggagggagttggctataggcaaaagttacgcacgctccagctaatagagaaaacttaccaattcatatctgtttttttttgttgttgttgcttagcattctaaaataatggaatagggagaagtgcctggttttattatctattaggggaagtgacatccttttttctcattggtccttcaggaatacaattgcatccatcagttatgtctctcactcatgccaggcccaagcgtaagttccccttatggtagagacgctttcacctctgaatatctggctgtaagagagaagggaccccaggtgtggagaaagttcgatgagagaggctgtcatggatagcccccaatccttctttcagagtgctggccaaggttacatgcccagcctcccttcactttccactcaggtacacaaacacttaacattttgtgtcaacaaacatttactgaaggtcctgtgccaggttctttgctgggctctgaggatagaaaggtgaatggagcatactccttgctctctagcagttaatctagacagggaggcagacacattgagaaataatacaaattattatcatcttcataaataatatagacagctctgacgataaaggtgtgtaccagatatgacaggagcagagctgaggcatccagcaccttcagggatgaggggtaatggtgttaggaaaggttttctggcagtggtcatttggataaggccttagcatgggtgggatttgaaagtagagatggagaaaagcacccacgtagaggaagtacagaaaatggggtatttctgtatgcgagggtaggacgtggtccagtgaagctggaactcagagtggtgaggactatagcggggaaggttaactgtattagaggactttggcagagctgcaaaatgcagcttctctcctgaaagcactgtgaagccgaggaatgtttgagagcagaggagcatgtcatgagctccatggaacatgtcttgcctgcacagggaaagaaagacagattgcagggaagttggctagaggtagaaagcccagaggaagcagcttttgcaatctggctgagagatgatgaggttctaaactgtggtgaggtgagaggtaaggagagtttggtggaatgttaggacctattcagggagtttgaatggcactgtagaaagagcaccaaatgagtcatcaggaacttaggttcaaatctcagttctgctggaagggaaagtagaattctctgccccctgccctgaaaagtccacatccccaggtggtggtttggttttttgtgttagcctgttactataaaaagaattcaaatgtacacagaaatagaaatagtaaaatgcatcctcttacccatcatttagcttaacctcttgcttgtattattttttaggggggcaatttttgagatgaagctttttggaaatattcactttgaggttgcatttgaagcatttctctgaatctgtttatgatctggttgaggcaatgaaataatttcacgtccatttgttcctccctggaggtaaattgtgtgtatgcatgtgtgttctttgctgtaagaaggaaaatgagggtagcttcccttgaagggtaagttctggggctgaggaggcacattgccaaccgggtcctgtcaggggcatgaggctctctgtctgctgtgggggcaggtgtggtgtggacaggggagagaatggaggtaaggactaccacaggtcagacacccttatccattcactgggaggggcttgttgcccagagcttaattcacactgaccaacctgacaaggctggtccataagccagacaccaatttaatttactctggcaggcattgtgcagtggccacaacgcaaatgcctgctttcccagaccgccttcctggccttaccccacctggcaaaatgaattacagcatcatccgcaggttgctggggagccatgctctcaaatagaaggcaccatgtgcattgcaggtgcatcactacaggccctgatgggacctcataggctctttctggtgcaggccacttcctttgccaaggtggctctagggagaggggaggatgggctgagctgcacatgctcagttccttctttcatttccaccatcagatactgagctgtttcccaggggaggaaatcctggaaagagaggaagttagtatcctcccattgggtcttgcccatgacaacatgaagcagaaactaaatggaggtgggagcccatgtctcagccaagattcatttcaacaggcaggggtggggatgctgtcatagagaaaacttgcctgagcattgaaaaattagttttgatggacagagattggggaaggggcctttagttgaggaaacagcatgacaaaggcacagtggcataaggatgctctcttgcggctggggtatcaggaacccaggagcaggtcaggctcagtgaggaagtgcgtccagcgtagtggttaggaacataaccttggagttggactgcctgaattcaaatcttatctttactgcttcctggatgtgtgatttgaccaagtcacttaacctctccaagcttcagtttccttatctgtagaatcgggataataatagttataaatattgagatatgagataaacataagaacttagctcagtgtagaagtgagtgtttaataaatggcagccattataactaccatcatgagaacaggacattttcgggccggctccaatttggatgccagctcatgcgttcagactgctgtgggagaggccaggtgttactcaggtgagaggaggttctccagtgccctggttctgaatacctgaacacagtctgggcagtaggagtggaaaggatgagatggagaagagcatccctgcaaggggagaccacagagacctggtggctcacacgggaggggagtagggtggggaagcatgacaggtgaatgcaggctgcatagttcaatgagggacccggagagcgcttctcccaaatgccagaggaggagagtgtcaccactgatgagatgccaaagaaggcactagagcaaacgctgactgatggcgagtctaagcgctttactctgttaacatttaaccttcacaaccaccctttcaggtaggcagttttattattatcctcatcttaaagatgagaaacccgaggcacagaggttaagtgtcttgccctgggacatatagtttctgaatcagggctgtcaccgaggcagtccaaccccagcctgggcttttaaccccaccctagaccgcctcttaaggaaatgggaacacaagcggctggctggatgagagcatggcacgggtgcacacggatgagtgacgtcccaccactgggggtgtcagagagcacgggaggtaggcagtggggctctgaggcaaaggggaaacatggaataataacagtagggtgcagggtcaaaggacatgttctagaatagcagaggaaggagcagaagagggagagagtgcagattcagtttggagggggaataattgagaggttggatctcagtgatgatcgaagattaggggtcacagggaggaggggcaactcttagacagcatgtgaagagagggtaagagatgagagaaggggaatcaagtggttttgtttctcattaaagaaagatgcatggtagtttgcagagggagtctgacacgaagaaacatgagattagagatcccaggcgcatgaatgtctgatggagccgtatgtgttgtgtagcatcccgggagcagaaggaagaagagacatgtgaacctggttccccaggcagagggagagtgagcgtaagttgtgaccagagaggtagaatgagctgaggagcacgttcaagctggagagaggtgaggactctacactctgatgaacagagccagggagagagcctccacgttgtccagaatagggctatggtgaaagaggaaatggagtcaaggaagtgtgggaagggagggaataggtggggacctgaagtgggcaggtagaagggacaggctggcagaccatggttatacttggggaggggaatccagagagatccttgagctccttgagaaggatccttccttcaggtccccgcctcctcctcctacgttattgctgggaagagtgggtggcttctaggtggctccctcagtggttgtcattgcctaatggctacaggccatgttctaggggtgacaggtgagagacccttctcaagctggggcagcttcattcgctgtcactattcccctgctctctggccactgagctacatctttgtaaaacagggctgataattgtactatatccctcacaggacccccttgaagattaaatgagaaaacaaaaatgaggacactttttttcccccccacagaggcagcagcttctcaaaggagacaggaaacctgtgaactcccagagcaggtggtttttacacacaggtggatattgcacaggctcgaaataattcaccatcatcttgatctattgtgaatggctgtgtggccagggcaggcagccaaatcttagaacgtgtgagttatctgttgcctagtcctggctcttcacatcttagccttgaaagatagactctcatttacgtttacttcttagacccactctttctgagcggttcagaaggaagggaaagagcctcctctccgaaagttctctaagtggctacggtgggccctatccccatgagggcactgatatacttgtcttacagtattgaagggcacactgatggggtttggtgatgctctgctccctggatgctgtctggctccccatctcaattcttcccaaaggcacagatccctgcctcgcttccctgccctccccgctccccactccccaatccctctccttgttggagtacctgcactgtttgacctttggcatctccccaaaccattctctgacagacctggcattaaggcatggccttggttgtggctggtttaccctaatcagtgcttgagttgggaaaaggatcagcttggagagagaggggaacaaaggcagaatatcgagagcagaaataggtgagaagagtcagaggagggtgaagcgagcattcaacaacatcaagcaaatacggtgaaggaaacttgacatcagcttcttagtgttcctgaagcccagaaggtcagatgtgcttttgggtgtgagccatcagaacctcagactcacacccgtttcctggccagaccctgcgctcctccttgtgggctgggctcgtggtgtctcattctcatgtctttggggtggtgtttctcttaaaaagcttgccatttccagtaggaggaggatgtcgctgctgagactgtgggacagctaggctcagagggagtctgacttcggggcacccggaggtgaggtctcagtgcctgttgctgctctttgccttctttagaggacagtgtgcagctttctgactgaatgccctgctgttgtgatatgttgctggaaatgctgtttggggtcatggagccttgcttaaagggctgtggtttggtgagaagggctcgagctttttgggaatgcttaagtggaagcatctgggcttggctctgccaaaggaggctggtggtggagcagggacatgtgacaggacttgggctgtgtcttcagtggaaggaccagaaagcaaaaggaatccttccagtgggttcagcagaactaggctccagcacaaatgttcttaaggatatcctggacctcgcctgacagggagtggctgggaatacccggtgcataaaactcactaacctggtatagcgggaaaaagacgctaagcaagaaatattgcattcatcccctgccaccacccagcactgccagcctgtgtctagattcagggccctttctgcagttctgatagatctcagcccccactggcctgagcttaactgactaatcagaacagcctgatctaggatgtttaggttgaaacaaggaaccttgtatgcgccaaatatttttgttgctgtaaagctttgaacaaatgtttgctcttaggagttactgatactatgattagatggggaccagttaagcatgcttgttcaccttcagtggcattcttctattttctcctcttcagcttcttttaggctacttaagcttctattcattgacaaaacaaaacaaagctctgcctcttcacttttattagactccgatattcactgaaggcattcagcaactctgatagcaacgttctcagcagcctggcccctctgtcctgctatggctcctctttgtcctgacaggatatctcgctgtgttgggctcctctgtcctgagggaaatttagcacaatggccttgtccctcattgtgatataaagccagtgtctgtgggctctgccattgctctgaggagctgtcttcgcaggccaggtgtgcggcttctcctctccactgtcagatctgatcctgtgggggtcgtgacctctggatgttataggacctgtggaggacaggtacagcttgtggccctgggcagaaggtggggacaacttgaactgctacgctgagagccttgccagtgtagaccggtgacctctttatttcctttcattttctcccttttagaatgggagctgagctccggggtcagagatatggccctgcctgtgagggccttaccacttagacaaaagtgccctggagaagtctgtcctgggagtggcgagggggacccagtcagaagtagtcacttccatctgggggatggatgggagaggatccttggagataatgatgatggaatttggcctcaaaacaggagtgggagttgagcaggtagaacgaaggacttcagctaaaacactgaagaagccccaaaagcagaagcaagctggggacaatagcttggctgttgctcagggcaggagccagatatggccaggagaattaaaactgctggggttgtgaactcccacccagttttgaatctctacagtcccacaatgtgtctcttttcacctgaattttataaataggtaaaatgaggttcattaatgttaaagagcttgtcggggcacagctcatgaaggaaagaacttggatctacatgcaggtctgactacagaacccactctcctaactgctctgtgggtccttaacttcgtctccaggtccccaagcacccctttgttgcctgagtgatagaaagctggtgaagcgttgtgaatgctgggaagccttggtaagatttgtgaaatagacccaccctcctggcagcagtgtggaggatgaggggtgtgggggggcggtgaggctggaggcagagaaactggttaggaagccagtgcagccactctgatgggagatgacggcagggcaggtgaagatgaggggacagatctgaaagagagggaggagattttaccggatctggtgcccagttggatgtgggtaacaaaagggaaggtccaaggctgactcccaggtttttatcttggtgaccatgggggcatcaccaaggtgggatgggaagcatttgggtcccacccattgtgagaatatagagagggaggtgggtgctcaggatgggaagagtttggggctgttgtaggggaacatgctgcaacctcactccagtccccactatctcccaggctttagcttcccatggacaatgaattggttattttatcaataaatctgtaaacacttatccagtgcttacagaatgggggaccccacagggacccagacacgtggcacagttttcagggagatggctgtgcacagctgctgtcattcctttccttcaggatgaaaaaagatgatcagggagatcccatttaggtagtcagaattaagtatgattacctggaagagctggcttgatgggaatttagcagggacagctgtaggcatgggcataaaagctggaaagcagtgcagacagccaattaactaacaattaggatcagatgccttagtgataaggcatctggtgaggatggggcagaggtctgccaaaaggtatgtatggtaaaagttaaagccgtgaccaagtaggttgagtccatatgatgatagaccatgatttctactgtgtggctggtggccagcccctgaggctgtctaagcaaaagggtgcctggtgcagggctgtgtttgcattccatcagttcctcaactttggtcagaatcagaatcacccgaatggctagatcagccataaaggtcaggctctctacttacaggaggctgggcctcttgcttgattagttctcagggtggttctgattaacagcaaagtttgaggaccacgagataggtgaatcttcagtgcagagtgaatggggagggctgttcggaggagggtaaccggttaggaggctattgtagtcatctagggtgaggtaatacagggacaggtgaggctgtgtgagcagatgagatcaccagtagcgtgagtttggagagaagtgctctggtcttattcagcagcatttggtgcacctgactgcgccctctatccagaaaccctttggttcgcttatgggtgccactctcacttctggctgctcctcctgtctcctttgtccattcctcttctccccggtggctgcatggtggagtgtttcagggagtcctggggcttcctctgtttttataccacttcttaagtcacttcatgcaattgcttaaatacatctttatgaagatgcctcccaaattgacatctccatcccagacttctctgtaaacatcagactcctatttccaaatggctactcagcgtaacttcctaggtgtctataggcctcttaagctgaacatttctaaaaccaatctcctgatttcacccccagacaccccacattgttgctcctgcaggcctccacattctctaggtactcagggcaaaaaccgtgtaggcacacttgactctgctctctcatgcccatgtccagtttatcagtaaatcttatgggctttgtccccaaggtatatcaggaattagaacatctaattcattacggtctgagtcacttcatctcttgccgggtttcctgtgttcactgctgcgtcccctgcagtctattttccaagaagcagccagagtaatccttttaaaaggttaagtcagatcatgtcaactctatcctcagaaccctccaaatgggtttctgtctcaggaaagtggaagaacaggaggaaaaatggtgtgcatcctcaggcaaattgcctaatctgttttctcatctgtaacagggggagaataattcctaactggtatggggattaagtgagataatgttggataaacccttagcaaatagctaacagttatctgcccaatatatggtaactaaagaggagacagatgccgcattaatttaatcttggcactgtgcctgccatgccacatgtattatttcttttaatcttttttatttcttttaatcttaatcaccactatatatccacacaatttaaagactcaaataattgtatgtaatttgttaaaacagccacctcttcacctccccaccccattgttcttcctcagatgcagctgcttaatttttttagtcatgtatttttatccgtatctctagaaaaatgcttgttctgctgctttattattttccccccatttgtcattatctgttcttattgaattaaacaaagtcttcaccaattatgtaagtctgttaagatgttcagatgcaccaggtgttctgtcaatttcatatgactgaggaagtctctcccagagcttttgaactggctgaccttgcaggcttgctacagaactgtaccctagcatctcccttatggccatgaccttgtgtccttttgagtttatgtctctcttgttaaatgagcagttaaattaaatgtttaggttcagcctgcaatgtttacctgagttctgtcttgtttacatttgcccaaaacaatgaaattgattttatactgattttacagatgagacaattgaggctaaaagaggttaaaagactcacagccattatgcagcagagcccatgttttcactcaagtctgtctgtatataaaagctgtactctctctcctttgccctttaggaagaaagtagttgttggttaatatgggatgtgattgagaatttagcgctgccatcaaattccttcatatctgtctttgtcctttttatttttggatgctccaaatggcttcttgctccactctaccaaagaggtttcttagatcctttaaagaggctttctcttaagcttagggatagcaaaaggtatttcttaaaataaccatttaagagcagctatggcttatgggaggcctgtaaattattgggaaaagactccaatttcttgtaatatagtgacacttctttatcatctgtttgccacttggggaagggagaggtaggaaaggagttaggttctgtggttgtggtggggttcttggctgaggcctccttccccaggccttgatttccaggcagagacactggcccctgtctagtggcagctgctaaggagtcaggtcttggctctggctcaactgtgtccaaggctcagaatatcctggaggcacagggaatagcagtgacttccagatctgttcctagttcatttcagcatccagggctatgtgagcctgctccaaacatcaattacaacctaaccatttttattgagagaaaagaagcttagaaatggaattcagcgtgggtggagtaaacaaaggtttacttgcttccgacttaccttcatcagtggttgctgcctacttcaaattttcttttgccaaacatgaaaggagttaacacagtatataaatcactgtttgcctcagaacataccagatgatggggttcaattgtgactcactttctaaattttagaacacatacagatcttgctccctaatcaacttccaggtgccaaactggcctttgtgtggtgcagttcatgtggctgtggcatgtcatcataccttgccattctaaaacatggcttttcctcactggctgcatttacagctaaggggtgtgggatcgttttctccctcactggtagcgaagagaagggttaagtcctgtaatgagcaggacccccagcctcagatgctgtcccagataggaagatgacagcacacacataggcctgtgagtgaaggaaggatgaattgtggatggactgcattttttcttaaacaacataccctgccttatctttatggccagggatgagacagtgtctcagtatcagaagccagcctgctcattagggtcaaaatgccagctatgttaagtgtccagagagaatgaaaagtgctttggtcccatgtaacaactgtctctgtattgtgtgtgctaagagcaatatccttctctgtgtccacttctttctttcctgggcggttgggtgcccctcgtacagtccccatggcacattgttgattcctctgttgtccatgctgtgtaaggcccttgggtagctgctgtagctctcctctcattgctggggagcatgatttaaattctacatcccggttcacgcctgtattcccagcactttgggaggccaaggtgggtggatcacgaggtcaggagatcgagaccatcctggctaacacggtgaaaccccatctctactaaaaatacagaaaattagccaggcgtggtggcgggcacctgtagtcctagctactcgggaggctgagtgaggagaatggcatgaacccgggaggcggaggttgcagtgagctgagattgcaccactgcactccagcctgggcaacagggtgagactccatctaaaaaaaaaaaaaaaaaaaaaaaaaatctacttcccaccatctgcttagctgtcaccctgatttttcacatgtcgcttgggattttggcttgggttctggctctctctgtcttctccctggtgtgttgcttctggagcttggtgcacttaagccccatatccctgaggagccctggctccctaggagatgctgtgtccctgtgggaggaaccgatgtggaagacactgaacgcactgcatgtcatcagacagcatgtttacctctgagacctgtgatactatgatatacagtagccccctcttacccatggttttgctttcctgggattcagttacccaaggtaccgtccagtaaggtattttgaaagagacagggccaggcatggtggctcacgcctgtaatcccagcactttgggaggccgaggtgggtagatcacttgaggccaggagttcaagaccagcctggccaacatggtgaaatcctgtcttctacccaaaatacaaaaattagctgggcgtggtggtacacacccataatcccagctgcttaggaggatgaggcacaagaatcgcttgagcctggaaggtgcaggttgcagtgagccgagatcatgccactgtactctagcctaggtgacagagtgagaccctgtctcaaacaaaaacaaaaacaaaacaaaacaaaaaatcacattcacataatgtttttacagtgtattataattgttctatgttattactaattattgttaatctcttactgtgccgtgcctaatttataaattaaacttcatcagaggtctgtagatacaggaaacatcgtattctatatatagggcttggtaccatccactgtttcaggcattcactggggctcttggagcgtgtcctccaaggataaggggggactactataataaaaaaagtatatatttggtctccttccagtttgctagcacagaaaaggggcaacttttgttattcataataagcgcctttcaaccttactcagctttatgctaatgaggccactcctgcaggatgggctggttaccagagaaaccaacctggtgattagagggttagaactttcagccccactcccaatcctcccgactcctaccttggggaggagagtggggctgaagcttgagttcaatcaccaaggactgagcgacccatgattggattaatcatatctatggaatggaacttctataagaaaccctaaatgaaggaaggggtttggagaacttccaggttggtgaacgcgtggaagtgctgctgggtagcagccctggagaggctatggaagctccatgcatccctccccactcctcagtcccttgccctatgtatctcttccatttggctgcttctgtgttgtcagaaactacacatcagctcctaggattcttatgaaagcacattgtatgataatggatttaagtggttttgtggtcttgtatgcatatgtggaaccctctgtaatgtttccttgttttgtatttgaattttcaggaagaggaaaataggctggcaaaaagagtcatggcttctgatgctagtcatgcactgtgaataggatacaccttgaatcatgtttcacttcaggccagctcccacaggtccacccagcttgctgtttgccaagtacaaactcatcgctgggcagagggcccatgggtcttgttttatggcccttctgttgcgggggcacatagcctgggccctctgggtttgacaccctgtcatgtttacatctgaggccacctgatttgttaggcattggcatccaggcccctgatgctgtgggtgtgattcccaggctcctctcatgcattgcccttgtactgcatatgtgaattccatggaaggctttgactcatcttgagcagctgggtgctcctgcgtaatctcatcaaccattttggcctttgccaactacatcctgcccttacatgcttccctggctttcctgtgcaccacactctctgcctggaacagcattctcctcctcatcttctgagaaagcttctatcatccttcaagacccagggaacttgcacacctgcctctatcaacataccttgcactgtgtcataattatttgttcatacttccgtctcttccactagattgtgtggttcatgggggcagatactaggtctgatttatcagtatccttctagggcctagcacaatgctggctgcatggatctgtccatttattcataagtatctatctgttacacagtgggaacctgggagtaaacaaggcagacagggtccctctgcctctgtgggaaggtggccagttagcaaggaaacaaatacatagaacaagatactgtggatttgttgtgctttgaaggggctgctttacgtggtgccggggggcggtgtggggaagccctctctgatactttggatctgagacctgaaggatgagaataaatcagctgtgcagacaactaggaagtgagctcagggtagggggatggcaggcgtattgcagaggagggaaggtcttggagggctcgggagcagacaggagaccagtgctgctgaagcatgagccatgtggggagagatgtgagcatggcctggcctgatcctgaaacctgcttcataggccacagtaaggagtttggaattttccccttagagaaagagcagtgggaaggatttggagggattatttcaaacttttaatatcccttatgctgaacaggtgagagtctgcagattgtttccttcctcctgcttccccccttttccctgctacctcttcttttatcctggccaaagctggcctccattcaggccccaggatttccacaccgtattcgctctgtagcggcctggctgctcctctcacctcggagcagctctgttccttgttgcagccttttctggctcctgccagggccctgaggtgccactgaagttccccgacaccctgtgagctcccattctcattccctctaagctaactgtgcagtggttcttgacccccgaggctgaatgcctgcttctgaaccttccttggccttagcacctgtaaatccctgccctctccccctccacaagcatggttgcttatcttccttccccatgcctgccgcctccaaacgaaccagcctcctgagtttatctggttctccctccctgcacctacctatttttgtttaaagtttcctctgagctggcaaaaatatgtcctgatgttatatcctcacttaaaaaaaaagctaacatattgaacactttgtgcaaaggaatgtgcttagtgctctctacataattttaatcatgacatctatgagttagatgctgttatccccattttacagatgaggaaactgaggctcagagatcacacagtacatagcagagctgggtctgaactcaagctatctgactttggagcctgtggatttaactattatttcctagtgcagtccggtgtggttccttggtcttgagatccttatccacaccatctctgaagccattcctgggtggtgcccattttcctgtcttcactctaaatgtcccacttcacaggaaaaactggcggagagcctcagaaccacctgtttcctctgctgcaccatgcttgagtgtggaagccgtgcccctgttctccacagcgtgtatggccattcggcacatgtgtagatttgctgaatgagcaaacagcaactcctccagtttacagacgtgagctaattctcttgggattacaagtgctattgtaaatccctccttgctacccagggagagggtggggaacaagaaaaatgagaggaggctgcaggaagagggtttaaactaaagaccttccttgaggtagagttgtccagagatggaagcaattgcctgagggacaggggaggggcattgggcagttcccctttgctatagctaggggatacagcattaaggtagtggccggactgtgtatccttggaggtgttcatctgccctgaaaagatgggattctgaacctcaaatcgtgctgggtagagtggatctaagatggtcagttatggtgctcctgggtgctgtctctacatccttgtggcctgtagacttcctaggcagtgcaccctttcccaattggaggagtggaagtggcatttgagccctctcagcctggctcacacccacccaaggaaagcactgcaggcctagggcaaatgcagatgtaagacagttaaatgcctgcagggattgtcccaggccctgcccttgtgctgcattgccttgtacgccctgacagtgtccctgttaggtgtgctgctctcctacgccacttagtggcgcctttcacagtggggtcggagcttctggaacctgggactccaattgttacacctggtgaggtgttaacaattgccgtcttgctgccacaggtgactctggagagccctggtggtttttcattacagaagtgaatgggattgtgtgctaaagattcatggaaaaagcactcatgccaagagggaaaaggccatggagatgcagaaactacatgtcggctactatgattcttatgaaaacacgttgtgtgatgatggaatgaaagatttttgcgatcttgtgtgcgtaacatggaactctctgtaatttttcctttgttctgtatttgaattttcagtaagaagaggaggaggccaggcaggcaaaaggagtcatggcttctgatgctagtcatgcgctggaagctgccctggagcaaatggacgggatcattgcaggtacgcccagggaaccccagcaaccaaggtctcatcctccacattccaggaactgcttctctccttttacttttttttttttttttggcatagagaaaatccccttttgttatatttatttttcagtggtgttattgtgtatgtaatctcttttttttctttgatacgaacttatacaactctctgatgtctggtgtgatcgttctggtctctgctgagacagtgtggatgtacctaccatctaccgtctcagtttggattctggctgtgaggcagtttgggttcagtgagactgattctaatgtaaaattttcagagcttttcatggcttattatagctgatctgaaacttgaaatctagcagactttgccacctaatgcaggtgtcagcgtcctcagatggtctccagtgtgtttcagagatgaaaggcagttttgtattgattcaattaatgattcaaattttctttatgccatattgttttttatccctctcaactgtttggttttaatatttgcattagccagtaggggactttttcttagaaaagatctagcaaagctgtggttaatttgaaaggactatcaattagctgttccagctgattcctttcttcatgggagcaaccagaagcctatattgattagaccaaacgttttgttggaaatctttccagaaggtcctaagtcttctgactttacctgatacacttcagtggcctcattggtagattggatgtgcttctttggaactttgctcttcattgtttgagctgtggctggaagagagcgtggaggaaggtattgggccaagtgtggctagaccccaggaagtacacagagtacctgacactgccctttctcaggcatttgcttttccttcccattggagggtttcatctgacttacagagggctcttggtgtttgagcctgaagtgggagagtatgcctgtgtcttgcagcttcttcaggttattgttggtaatgtgatgtattctagctatcatctgtctgcttctcaatttctcagttgatagagggcccttgagaagccatgactaatgtcctgcttttcagagaatccatagactgggatgtcgtgatgtttaatactgagtgtcaacttgattgaattgaaggatgcagcaaagtattgatcccgggtgtgtctgtgagagtgttgccaaaggagattaacatttgagtcagtggactggggaaggcagactcacccttaatctgggtaggcaccatctaataagctgccaactaatataaaacaggcagaaaaacatgaaaagtctagactagcttagcctcccagcctacatccttctcccgtgctggatgcttcctgcccccaaacatcagacttcaagttcttcagctttaggactcagactggcttccctgctcctcagtttgcagacggcctattgtgggaccttgtggtcgtgtgagttaatagtacttaataaactcccctttatatctatatctatagatatagatatctatagatatctatctcctattagttctgtccctctggaatacagatgtcctgttctaggttagggtctctgatgccttattgaggagaaagagtcaagaaagtggatttcctagcaatccttttagagatactgacctgtgagctcctcggggtctcacgtgcattgggataatagctacaggatcattccctgagaatgcctgaggcagtcatcacttcagagccttcagccaaagagcaaaggggagactgagcgagtccctggcagacctctttgatggttgtcagggagggatgaaaatactatcttttctctacgtattatctctgctgctttgtcaaaggtcatttgattatatttttgtgatatatattcaggtctatttctgaactctgtattctgtttcatggatttattttttctttcaccaataccacactgtgttgattactgtagctttagtaagtcttgaagttgggtactgtcagtcctccaactttgttcttcagtgttgtgttggctaccttttgcctcttcgtataaaatttagagtcagttttttgatcacaaagtaactttctgggattttgattgcaattgcatttaacttagatcatgttgggaagaactgacactttcacaatattgaatttttgagagatgaatcagacttctaaagaaaagtagccttgtgtggggtcagtacctctttctgactcctgatttctccatacaggcattcctgaaatgacagagcctctggcaaaattcattttgtctctgagagacattatgtggctggatccttaaggccttgccttgacccaggatctgcagttgagaatctgggatgtgtgtggagagaggggccctaagtgtgggttgtgtgaaacccaggagacctaatcttctgatcttccagtacaaactgctctatccttccatttccttagtcctccatcttggaaggttctatctagaagggctcctgggcttttctgtctggaacaggtatgagagttttgtagagagaaggcattctttgcaaattggttctttgcagattggtagggaggaatacctgtagccagactacttgtttgaaaacctagctctacaacaagttacttacatggtctgtgcctcagtttcctcatattagaaatgagaatagtaatacccatcttagagagttgcctgtgttgacatgcgtaaggtgcttagaacagtgcctggcacatagtaagcactataaaatgttagctcttgatagattaatgagggactaaaaataatcttcatcatgttgaatcttttctggggacggggtagtattctatttattaaagctcttatttctcccatctgagttttgtggttttcattgtataaggcttgtgcatccattgctggatttgcccagggtctgcagatttaatacgtggtcttctgattgctctctgcatctgttcttgctcccttatagactgtttcccacagagctgtagagtaaacctgaaaatgtaaattaagtcatatcactcctctctccaaaactcctcaatggcttcccatctcaggataaagtttaaagcccttaccacggccagcaaggtcttagcatggcttggctttcgtggccctttatgcatcccttttacgttcccagggtgtatctcactttaaccatgagcttgcccccccctctcctggaatgccctcctccagatctaggcttatgctgaaatgttaccgtaccggaaggccttccctgactgtgtctatcatgcattcccacataactctgttcttgtatcttgtttatacttctttatagcacttatcacctgacctatcacattcatatttgcctctttgtttattgtctgcctcctgcaccagcatgtaagtttcttaaggacagaggctctgccactgtatctccagtgccataattggtggttttaggcattttagttaataagcatttaatacatgctagatgtttttttttcatttgcttttgtgactaggatctccttttcattggttaggaggtatacatataggtttctgtatacatcttctatctggctgcatactgaacttcatttattttctctattttcacccttgtttcactgattcttttggaataacaaattattattattttttttgaagactagtagtttgtatgtcccatgaaccatccctgaagtagtaactggctcacacagatatttgacaggagctatttgacagattattcaacactgaggttactagtgagtatctggagggcatgttttctatgctattcttgataaaaagaatgatcattcttttgaatgccttgttcaggttactttttctcaagattgctgaggacacttttcctcatttttatgatggcattaggatggctgaaccaaattgggccaaagaggttaagaatttttgtggttattaacatggactacagagttggactgtaggggtttgaatcccagctcagccatttagtgctggctgtgggatctttggacaaattgcttaattcttctgagcctcaatttacttatcgataaaatagcagtaataatagtacctgtctcatattattgtgagggttgaattaatgcagataaggcacctagaaagtgcttaattgatgtaagttatttgttttattgatattagtattaaattatttttaccccccaagatcatagtgctgagatttgattccagggccatctgagtctcttccaggctccttttattcctgggctggtttttatgttgatgcatggggctgtctgtaggagaaaagaattaactgagggaaggatacttttctgctcttgctcacaatccctaagccagagtggttttgttcttgtctctcttacgttatttcttctaagcaagggttcctttgcttaagggtggcacagctaaagaagtttgaaaactggcaccacaccacagatcttgcagaaatgacatttttgtgtgaacatttaaatcttcctctctttatttatgttctcttattaattttagattgcatgatgtcaagtagtgccaccaccactgccaaaacacaactgcttttccatcaaagtactcaagtacccaaagaatgtattttctcacagttaccacgtatttcaacggaaaaaacctttatgggcttcctggacctcccaaatagtaaccacttacacagaaacaacacagattcctactaaaatggatgtactgtattcagtgatcactagtaatcatatactatgtaacaaggaattgcctcttactaattacagtaggctgggttactgtttactttccaaaactccttctaaaaagagtgcactttgggcatgtgatatcaatgtttatgtaattaagcttttagtgcaaaaaaaagtctgtctcctcctgcatcaactaaaacagtgcaaacagtgcgggatgattatcactcctgtaaacaatcagaccaggagtactctgagaggacatcctaatgcgcaagtggtaaatatgcccctccagagccacggtgcgatggcctttgtctcaggtggtcaatgttgggaggtgtgagagagagaaattggttcttgtaaatgcaaaaagaaatgccttgtaagcaggactattaaatgaaactccttgtaaagttgaattcttgaaatctgaatggctgaatcccaggtgactagactagactagactagactagactagattgggtctatactagattgggacctcagtattttatatcagaaagttgggaaagggtggctgttaaagactctaggatctttgtcaataatgacttggttctaatatgaaagaccattattatagtttccagtaggatgttaacctttgatctagtcttcctcctgattagtccctgtgattctgcttgcaaattcactgtaattgaattacactgttgacaattgaaattgaactctatattgcttaattacctccctctggatggcctagagcaactgccacagacactaattttgcatggagcttaatttgtgaactgacaggttcagtggctactttgtcaggccacttctggcaggggaccagagagccacgtggtcaggacacagaaggccacttactcctcttggctctgcatgaggttactcatgcagttatgtacaagcagtactcactgaggaggaatagttaagaggagtctgttttatgacagttaaagaagttgccctgtcagctggggcctttctgccaactctgattagcgtctgggtttgtaaaaagaaaacaacaaaagattgtgcaggggcagagaaagttctgatcaagaccgagattgttcacgttggcttgtgaatgaagtcagctgtggtgctgaggactgttgagtccatactctgaacagtccttgactgatcttgtccccggcttctctgaggtgcagcagcatatagcattcatcagtatcggactcgctgtttcccattgcaggttgtgagagccctgctaggactttgttcagaagagttggagtgggggtcttaggagtgtctaaggggcagagctatcaaagactgccctttgtatgaagaggtcaaaacagctactggggcacccgctgtttgacagccctcattccatttttccctcactggtagaccccatctcccagtcctttatggaactgtgcctcgttttccattctctgaaagagtttggataaggctggaactatgtgttccttaaatatttactatagttgtaggtataggaactgagctgcaaaactgtgtgggcctcgtgtattcttgtttgaagatttttttcttttaatggtgtggacaggttttaattttttaattgagtcttggcaagttaagtttttctagaaatgtgtccattttactgaggctttccattttgttatcatcaagttggccattatattttatctaaagtactttgttagattagaattattctttaatgtttgatagaattaacatataaaagcatttggcctggtgtgttctgtgtggaaaaaaatttaaactacgattaaatttctttataagacggccaggtgcagtggctaacgcttgtaatcccagcactttgggaggccgaggcgggcgaatcacgaggtcaggagattgagaccatcctggctaacacagtgaaaccccgtctctactaaaagtacaaaaaattagccgggtgtggtggcgggcacttgtagtcccagctactcgggaggctgaggcaggagaatggcatgaacccaggaggtggagcttgcaatgatcgtgccactgcactccagcctgggtgacagagccagactctgtctcaaaaaataaaataaataatacttgactcttagaatgctttaattctcatcactgccccatcttccacattattttcgttcagtattctagtatctttgtattctccaaattattgttttttcagttgatagcattttgtttaacagttttaacaacctctccagtcatagttgattctttcatcctgctttttttgcatgatagttttcttccttaaaatttgatagtctgtcagtaatagattgtattagtcgtcatttgaaaaatgtccttaaatgttcataatcttgaatgatagtttatcttgtacaggcttgtaggttggtcactatccataggtattattttgtggtcacagggatttattgctaatgagaagtctggcaatctgtatctgtcttctgtctctggttgtttttaaacttcttatttatctttggtgttcttcagtttcactgtgttgtttcttgggtggatttgttttgatgtatcattcttgggactcagtgagtgtctttaagctgagaggactcaagttttccattctgaaaaattcatagccattttctttgttgtctctgcttcatcctctgtattcttctggaattcctgaagaattgtgttggaccttgtcctccttttttaattccatgcttcctaactcctcttttatatttttcacttgtgtctctgtttgcagcattcttcaaatctatcttcctctccaataattctctcatctgctatttaacctgttcacttaattaatttgcttggctgcattctttattttggtttgtattttttttttcagattttcctattttttaaaatcatgctttccttttctttaaggtttttatttcttccttttctcctttaattatgtaaaacatatgacatatgcccaaatattcccaaatagacaaaatatttactcatattagtgtattgatttagttacgtgtttaagcactaagtaaaaggctttcaataattcaaaataatatgttaatttatgaacttcttgtctcattggcacttttttttttttttttttttgagacagagtcttgctctgttgcccaggctggagtacagtggcataatcttggctcactgaaacctccatctcctgggttcaagcaattctcagcctcctgagtaattgggattacaggtgcccaccaccattcccatcactggcacatctgatgaaataattttattcaagctttttatatttatctttgtttctatcattttgagcgctctttttgaataatcctagcattctagagcagttgtagagcatttggggatgcagattcatatttgtaggtctgggatgggatccgagactgtatttctaatgaactctcaggttttgctattgctactcctgtggacccctcttttaagtggcaaggttttagaacatgccatccttacttggaatttgttttaaatacaacactttaaaaattcacatatgatgctgtcatcagctatttcatctcatgccaaagaactccatttacgtggtaaaaggttagactttaaaagtttatcttgtctatatgtcttaattgtacaaaatatatattttgcatgaatgaagataggctaagttatattgcagtgagaaactactcaaatgtcagtagtttgaaacacaaaggtttatttcttgtacacattgcaagttccctgagatctgccaagagctctggtccttgtcatcttcacttgaacacagactgattgagtctccactattgccagaagtcagggcaggtggaagagatatgaggaattgtgtactggctcttagactttctcccacagtgatacacatggtttctgtttattggccaaaggaagttatgtgaccatgagtgacttcaagggacagaactgtgagcctactatgaatgcaagtagaggagaacaaaatatctgaacaaccccagtcactaccacagacatccctatgtgctttcgaaagcgatcattaaaaggctttcagctggctgcggtggctcacgcctatatcccagcactttgggaggctgaggcaggcagatcacgaggtcaggagttcgagaccagcctgggcaatatggcaaaaccccgtctctactaaaaaaatacaaaaattagccaggcgtggtggcgcgtgcctgtactcccacctactcgggaggctgaggcaggagaattgctggaacctgggaggcggaggttgcagtgagctgagatcacgccactgcactccagcctgggtaacagagcaactctgtctcaaaaaaaaaaaaagaaagaaaaaaaggctttcaatgaaatcctataacacttgcattgtatgtggtcttatcctcaaaaataattattaaatcttcattaaattttggttttgctccttaaaataaaaattctcaggtgacctctataaccatcaaagctagacttcattgaggtgatctgctagtgccatggtttcagcttaagcatcattttagtatcacctgggaaactttttattaccccaggtcacacctcagaccaattaaattagaatccctggaggagggcccaggcatctggagtttgtaaaaccgctcaggtgacttcaatgtgcattgaaagttgaaaatatttgtgctactctaaatactgctttgttgctcaaaatgaaataaatagaattccccaaagagaaactttaggcttgactgtaagttgaattacccttttctgagaaatctggggggcaaatcttgccttatatttaggcatatccagcattagtggtttatggtgtcttctaaattttcctgttaattccaggttttagggcacacattttttttatttgttttctattttgatttgtttcccactgtggttgtaatttttttacaggaggtaattgtgggaaatgtgtgtggagtgtggaaatgagcctcctgggagattttgcaattgctaatgctgggctttaggtgttgcactattctggaccattttgtgtgcatgtgtgttgatttctggtttgggatttcggtagtcagtgcatagtagaaatttggcactataccagtggtatgcagaggcctgtaggcttgatgtctcactggggggtgagggagggtgtatatgtgtggtattataaacacctagggggttacttagcatactgcaagcttccctgccgttgggtgaattttctcagatccatttatgaaataggcaatactttggggtactttctttctataggggtctcactttcaacttactgctttcactggaggcattaaaacctcaagccccaatctcggttcctccctatatctgggtattttgcccctgggctactctagagtcagcttgaattaatttcactgttgagttcactctttgtttctggtacccaaggtttttactgtctttcaagcttggctccatgttaaaaaataaaataaaataagagtgttatctttttcagcttttctgtttgttcattgtgggtaagggggactcctggcagttgagtatgtcctgtttccagaaggttcccccttaagcagcacatggctagcttaccaagaggcctgctctgagattttctgaaatgattgttctgtgaaaatactaccaggtttttccccctttcactaatgcaattatagagcgagggaaagctaatcaacagcacaaggaagaaacctgtctgggtttactcacttaatttcctgcccaaataaaggcctgaattcttccatattgtctagcatcctgtggggactttgaaagaacaagagaacctagagtccctgtgcaaactaaatgtcaaacttgaatctctcacttagagtcaacaaatttaaagtttaaaacaaattgttataaaagtaatgaaaattaatattgtcaacatttgggtatttctctgtatatatatataccatatacatataattgttttactgaataaggcaagtatttccccatgttactgagtctttagataattgttttttatacagctatatgaatcatattctttctttcagaagttatttaaacattcaccaatttggggggatttttcccctactttttgaaaattaagatgctgctgagattattcttatatattaatctttgactacgtgtctggttatatttccttagcttaactttctagaattggacttgctaggtcaaaaggcatgaatatttttcctgtatcttgccaaattgcttttcagaaagattaggccagtctttgtgtctattaacagtgtatgagggtacccttatgaacagcatatgagcttgccaacattaattatcattgcatttgcattttcaacaatttacgtaggtgaaaattgaatatcatttttaaatgttctatttaccaatgcaaaaacattttctttccatatttttaaattttacttctgttttttaattccagaactgcccatataagaaccttgtgcctattttgtgtgtgagaagtggcttggggactttttcttattgatagataaggtctctttttgtatgaaggctatactgagcttttgttgtaattgatacgagtaggtttgtttgtttgttttgagacagagttttgttcttgttgcccaggctggagtgcaatggcacaatctcagctcactgcaacctctgcctcccaggttcaagcgatttttctgcctcagccttaagtagctggggttacaggggcctgccaccatgcttggctaatttttgtatttttagtagagaaggggttttgccatgttggccaggccggtctcgaactcctgacctcgggtggtctgcctgcctcggcctcccaaagtactaggattacaggcgtgagccaccatgcctggcctacaagtaggtttttcaggctataatttgtcttttaattttgtttttaatattccagaagttaattttatgtagtcaggtttattgttcttttatgtcttgctcaattgctcttgtgcctataaaatcttcctctcactcagttttgacctatcttctctttgtatttctagttcagttttttaagtgtgtaatctttgtctgtctaaattttatttttgtgtatggtgtataataaagatcttatttttttctgtgagggtaattctagccacatattttagcagtgtatggcaagtgcctcttgattgtacttctcagaatattctcagctatttttattggttagttattttactgtgtaacataaattaccccaaacataacatcatacaataataaacatttatcatctgtttctatctgccaggaattcaggagcggtttagttgggtggttctggcttaggtctcttaaagagttatagttaagatattagctggggctacagtcatctgaaggcttttctggggctggagcagcagtccctaacctttttggcaccagggaacagttttgtcgaagacagtttttccatggacctggggagtcgggggaaagtttcaggatgaaactgttctacctcagatcaccaggcatttgttagattctgataaggagtgagcaacctagatccctcgcatgcacagttcacaatagggttcacacacctatgagaatctaacgccaccagtgatctgacaggaggcggagctcaggcgtaatgctcattggcccactgctcacctcctgctgtgcagcccagttcctaacaggccatggactggtaccagtctgtggctagggctgggaacacctgggctggaggatcccttccacagtggctcactcatatggccattggtagaagggcttagttccttgatgtctgctgacaggtagccatatttcctcactatatggacttttccatagggatgattgagtgtccttataacatggcagcagccttcccccagagtgagtggcctgatacaataaagcagaaggagtcacagtgctctttataacctagccttggaagtgacattcctgtcatatcctatcatttctgtcatattctactggtgacacagagcaaccgtgatataatatccacaaattacgaatattaagaggaatgggtcactgacggcttcttggaggctggttatcaaactcttcctctgagaggaaatttagaattgtatctccctttgtatagatgtttattcaatatcattttgtcatttacatcccaaagccccatggtggcatctggaagtttcttcttcccttagttttctgccctgtaaccttatctgattcttaaatttaaagtcaagtggcgtttgtcatctgaggcttttctgtcactgtcattacaactagctcagggacaaaatatttatcttttcacttccctcatctagtatttattgactattggttttgttaaagtaataaaagaaatataagtttcaaagaaatagaaattaaagttttatatatatatatatatatatatatatatatatatatatatatatatacacgcacacacacatatgcctgtaaaacttggcacagatatacatgtactcacatacatgtacacacgcatactctgaatagtaggaaagaatcccaaagctttagggcagagagggtcacagagaaaggaagagacttttccaaggccacacagtgatataaagttaatgaaaacccagatcttccatccaccttttagcctgactcactcttcccacatttatgaaatacttaaactggatggctacgtgtttaaaattcatgtgtacagaatggagagggattacttagcaatggtttggagattggaggtcttgctctgcttctgtccgttttcttccctgaagtttggctgtggctgttctaagtccactcttaattggatttgtaggagccagaaagtgctgagcacacatcacagtggtgggtaattgggcagtttcctggctccccagagcctctgacttgtttgtggatggtgatccatgattccctgtatcatgcattttcagaaagcaaactggcaatcaaatggtaattgtttccatctgtgtggatttctgcctggcaaggaggaggttggctctgagaagagtaaagggacctggaattggatgtcaggcctgcagcataccatggatgcggtggccccaagctcacattttccagtagagtcctaatttcaaatctttcatctggttggccttataaataatgcaaatgccctagaaattccaccacctaaaccatattttctaaagtgtttcttactgctgaaaggagcacagacttcctttgttagactgttgccccagttttgatttgaaaaatgtatcactgaacttacggaaaggagacttttgctgctgctgctgttgttaaataggtgtaagaatggtggaacaggccaggcgcagtggctcacgcctgtaatcccagcactttggtaggccaatttgggtggatcatgaggtcaggagattgagaccatcctggctaacacagtgaaaccccatctctactaaaaaatacaaaaaattagccaggcgtggtggcgggcacctgcagtcccagctactcgggaggctgaggcaggagaatggcatgaacctgggaggcggagcttgcagtgagccgagattgcaccactgcactccagcctgggtgacagagcaagactccgtctcaaaaaaaaaaaaagaatagtggaacagttgaatttggggcatatcaaattagaaagagctgacccaatataccagatctctgaggacattgaagcactctctctctagatactcattcaggtatatgtgcgggcattttgtcagattccttttcagtgtctactgggtagagtgcatgatgctgggaactcagttaaatgtaatatggactctctctcagactccacagcccacaataaggagatgaggtatggatatacataataataatgcaaatttaagagcatatagagatatataggggatataaagatcttctaactgggaagatccagaaagattccagttcactaaaccctcaccaaaatgaatacagtaattgtcatctagtgctgtgggataagccaacccaaacatagtggcttaaaactaccatcgtttctttgtaatttcatgatttgagtagcactctgcaggtgtgtctcctccctgttccacttggtgtcagtcggggtggctcatgggggcttggaagatcccagatggcttcattcacatgtctgtcaccacagctgggagggccaagaaaggtggggctgtctttctagccaggtaactgggctttgttacatggcagtttagggtcaaagagagaaagagtggaacctgttagacctcttaaggcccaggcccagagctggtacagagtcacttccactgctttctgttgatcagagaaagtcaccaggccagcccagagtcaagatccatccctttatcagaggagtggaatgcacacacaggaatggaagaatctctggtggccaactgtgtaatctatgactttaatataaagaaaaaaattctaaaagctgaagaatgagatcttactgtctaaacgtagtttatggtccctagtgaggactggctgtgctttcccagttgtctaagtgtgtgagcttcatacatcagtcccaaagggtacagtcatccacctctgtatgcctatttttacactgtccagcccgagattagataaagatgatttctggaaagtttacattgtgagtgattcagctggggtccaggtggccttccaggtttctttatttaaagatggggtctcactctgttgcccaggctggagagtagtgactattcgcaagccagatattgtgcactacagcctggaactcctagactcaagtgatcctcccgcttcagcctcccaagtagctgagactacaggcgtgcaccgccatgcccagctcacccccagcttcttatctgtccctttcaccgtttcttcaccacctttgctctttactagtaccttgctcagggtgtccacccttcttactgagttttcacctctctctcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttggtgagtagtcccgtggcctgattgggaaccactggggaatgtaatggtgcagcccatggagtgccactgctgactggggctgttgagtcatctgtataccttccagccttttcttccatcccactttggccaacgctgcagggtggcccttcttatcaaggagtatagagcccagtcaagcgacttaagctatgccctctgcccttccatggtccacagttggcctctcctgaggaaatccagggccagagaagggcaaacatttaagatttcacacacacacacacacaccctcgaattacatgtactgcttattgagttctaatccctggctggtgtctctaccctcggctagatcccactaccccttgtttcttaccacaaacaaaagactggttacctcattgatttaaaaaaaagcttgacaaatttcttaggaggcaatgttttcttatttttgcatttctttggtaaaaaggctaaacttttgaaaattagtttattcgtattcctctgtatggtctctaaacttttgattctatatcctgtatctggacaaagaatgcatttcccatatacatattcacatgcagcattttatttttgagacagggtcttgctctgtcacccaggctggagtgcagtgtggcttgatcatggctcactgcagcctcgacctcccaggctcaagggaattctcccaactcttgctcccagaagtgtaccacctctgcagaagtgcgagccacacctggctaattaaaaaaaaaattttgtgtgtgtggagatggggtttccctatgttgtccaggttggtcttgaaatcttggctcaaacaatccacccacctcggcctcccaaaagtgctaggattataagcgtgagccactgcacctggccagtatttcactaatatacctaaattataaaaataccacaaaacagaattttaaagttttttatttgtacaaattgtggggtacatgtgaaatttccttacatgtatataacacatagtgatcaagtcagtcagggtatttagggtatccactgttcaccaaaatagagttttaaaggataggttaaaaaatagttcccatatttttccctgtacacccagaaatcaccttgagcctcttggatgcacctctcccactctagtctattcgtagtctatgctgttgttttctattaggattttagtgtttttcttatctatttgaatgaccttttattagccgtttgctttatttgtagcatatattttcctcactctgtttttaaataacgtttaggtgctttctgagacacagaattttaaacaactgtacttgactctatcagtctttcctattttggtttcttgttttccttttggccctagcaacgcctttcccaacctcagaacagataactgttcacctgtatcttcctctagtaagtttatggtttgatttttattttatggttaactccaatccatcaacaatattttttagcatttggtataaacaatgaatctaacttttaaaacagtttttggaaatttattaaaaatatttttgatccaaaggcagttgacattgttgttggttttttcaagatgcattggtagaaaacagcttgcattcagatttgcagttttgtcttggggttatttacaatggtttagggaatgccttcctttgaagagatttccctaaaagtgattgcattcataaatcttctagagtaattatggccatcactaacctatgcatggcgaagcaagtacttttagggggtcagaagttcatataaacattccaagttgtaagggctgcatgttaaggtttttattctggacagagatagcctgtctgtgttttagatcttgcagacctaaagtcattttatgatcagcacatccacattccacacaaggtcttaatctgtatgggaatagaattcagactggtgagcaaactcatcaagtgctttagattgacacttttagttagaagttgttgctgctcaaattttggtctgtggctcagcagctttcttatcccctcgtagcttgtgaaaaatgcagactatgggctcccatctcacacttgctgaaccatctccaggtgactcgtaagcacattaaagtttaagaagcgctgcgttcaaccctggagactcagttgaattatttttttaaagtcccatgtgggttaggattggagttggaactagtaagatggtttgaaggattaggcagcactgcccagcgccttctcatgcatgatgtctgtgcatcccttgcatatttgctcccttctcctctgtagacacattggcattgttcacacctagaattcctgcttggccatgacactggcctgacatggtccaactctgcctcgtgacacctatatcagttgggatactttttccagtaaaatgatgtaaacaataacaagatagaccactaacaagatgtccagaagacagacagtcccagggttaaataagtggctctgagtgacctcatgggtactggttcttcccatcttttttctttgccatcctcaaggggtggtttttgctcaggcacatcccataacagttgcaagatggccactagaactgcaggcaacatgtccttacaagacacaactatacaactgtgtgcagaggtagagaatcatttctttagtatgtttttgttgtttttaatcaggagggaaactctctgcaaccccctagcagacttcccatttagctgcagtggccagaatttgttcacctgtgcataccctagctgcaagggaggctgggaaagcaagtattggcacttccacctgccatagagggaggtggcctctgtcagaaaagaatgatgatagagtgggggaaagtggccctcaggaagacagctcagagtgactgccacagacttctgttaggtttgagtttactcttgttggctgacaaattctttccatgttttctcaatatgttttctttttaaactcaagtttctaaggaaaaggatctgattgacccagttaattatttttgagcgaagtcctccagatcaatgaagaagcgttaagtgtaaaagaaatagacattaaagacttttaatttattcacaagctatggatgcacaccttaggtccagtgtctaccccagagtgaatcaactgttagcagaggggagggattacatagtgggaaatgtatcttgtactgctgctgctcatctgggactgcagatcttctggcactggagcatctgtggtccatcagaagaatgggctgctgagaagcaggggtagatgtggaggagtggtccatagttagaataggacaaatagcagactagtcctgggctctctatgtcttacatgaaaagggcactcctagtcctagtgcctcctattgggtagctgtttctttgtggtagggctggttcctcttcttctgggtcctggcagagctaaagcacagctgggccagcacagttggcagaagtaggagtgctgttggccaggactttgcctggagatgggtataaaacagaggcgactagttctaaagcccaagtggagcagacctgcccaggagtcagtggcactgggttaagtgagtttcccatgctctggagtctaaactagcatcctgctccttggtaagtataatgaggagaagtgggctctgggcctagaagggcatgtgcaaggctttcttaatggggataccctctggggcctcagtggggcaaggaacaaagggcttggattcccttggtctaggagcagtatttcctctggaaagttggtgaatgaggaccttgtatagagggtgtcttggggtctaagatgggctgggacctggcctgcagaggaagcatcagggaggctgtcctgcctgtggtgcagcagagcagtgttaccctcaggagatgggaaggtagtcctttacaactggaagacacagccaagctcagggtcagtgctcatggaggatgaagctgaggccctggctggaaggctgaggcagctcttttgtgatgggaacagagctgagttctagaaaaggggcagcctcctccttctctgtttactatggtgaaatgtaggatgatgccctcgggagggtgtggttatttcagttcaggagccccagaaccccacaggtggtcctgaagcccagaaagggaagcagtgctcatcagtggccctggcatatgctggcatgtaatcatcagtggccctggcatgtggtacctggcccaggcaagaaggacccggtacaactgtgaccacttccaggattttggctgtgccttgagtggggctttcccatggtctgaaaggggtgtctctacccctccacacctgcttggcttggctggtggttagtggcatagatctttggctaggttgggtggtggaaaccttagacaggatagccagtcagattcagatgggctctacagggctggggatagccagttagctgggaggagtagacctaggctgatacacagtgttgattcgtgtcccaggtctttgggtgacgcccagaagataccagagccagcagagtctccatatgaagtagccatgggtgcttctctaacagtatgttatgtacacccttcatctcctaccagccagccagtctgttctgctgtttaatacattgggtatgggccaaggagattcttggtgaagtttcaagatgaagccagagaaagggcaggcaaacccagcagcaaagtgaaggcaagtcaaggaagagctcaggctccagggtgaggggtggtgcttggcagagaacccacagaagggctgtatgtactctaggccctgtttggaactggggtacatggagtaggcttggccatccaataggaacccaggcttttctttgcaaggtctcaagagtcctggtcagtgtgcttgagcaggtgaaagcagattgaaccagggtgagggagtatggaaggtaggaaggagttaaaaggccagggttctaccctggctctaccactcatgagcctcttcttcacttctgtgggactcagtttccctactggaaatgacagctgagtttgaaagtgtctgcaagatctggccaagcattccaattctgcagtttgttctgggggctatatggagtggtctctttgtaagcaccagcctttgcctccctcagtcttgacctcttgggttccaaagtgtggagacaggttaggaacctctcagtttactgctgcccttatgttagagcttgatggaggcccacatctcaacagtggagaggcaaatctgtttaccatattgaaaaacctgaagagttgctctcctgaatgagcagcctctgctggccccagctgggataagtgctcacctctgatagcccagcagtcagttcaggtgccctcagttacctttttaactagtttcccaagaaacaaagaaacccagacccaggctggggagcacagccacccccccttctcagctccaaaccaccttgtcacagatggcggtttcttcagctcccagctcctcaaacaaagcccatacattcctgccagattcagcttgcaatctttcattctgtccaagaagcaaatctgtttaccatattgaaaagctagaggagttgcaaaaaaaaaagtggagagaaaaagctgttttatgaattataaaatgtgagcttgaatttttttaccatgggattcatttctgtatctccagaatggaaaacaaaagatagtcaggatacgtgtgtgttgaacatttcaattttgaaaagttacagaaggagttttgtaggtaaaccttttcctctggatcttagaggagggaaaatttggtgcttatttttcaagaaaaaaagtagagcctgtgtgagccgatttccagcatgttttcttacctcccctgtgacaggtgtgaacttgagtgagagatgagaaaggagtaggtgtgtccgtgctttctttctgcgctcagctcccaaggggctcctgggccgggctcaggtggcatcagtggtggttctttgtccctgtgcagtgctggaagaagccactaggtgggagtcagggacaaatgctgggaagtgaaatcccaaagaatgaggtcagcatgggcttcatatgagaaaacagcttttaatttttctttttcagacaaagataacataagcacctctcattattgaaactgcttaactgcacctgggtcagctggcaaagataattctttgccattttccttagaaacagtggacaaagggcagtcaagagagggctccactgtttagggtgggggagaagagacagggctggtcctgggatcatagacctgaccttcccctgtggatgtggggagacctctccagacttcttgactgcagtgccttctgctggggtgctagtaggttggccccttccattcctgcaggcatttcctagcccacagtttatgtcacgccctgccctagagaagcttcctgtcccctgggggattttgaatgcccttttcctgacacagcagccaagactgggggccttcagccactgcaaatttagcagtttcaattttcctggatcttgatccctgccccccaaagtaaatttaccctactaaattctagcaatccggctcctttcagacctgacctaaagagactatttcagcctctaagaaccaatgtttataaatgaccaagaatgtgcaaacactggtgaaagagcaaataaatccttccccactatatttcctgcttcaggcccaggggccgtggtggacagtgttgccaggttagcataacttgaggtctgagcacgtagacacccacttaccctccacctacaaaagaaaatcctgccagagatacactaccaagagccttctgccctttcagatacctgctagtgggcaggcaggctccagggaatttatgcttctaggcaagtttgtttagtaatctatgtttcgaagaatgttttgtttgttttgttttgttttgttttttgagacggagttttactcttattgcccaggctggagtgcaatagtgtgatattggctcactgcaatctccacctcccaggttcaagcaattctcctgccccagcctcccgattagctgggattgcagttgtgcaccaccacacccggctaatttttgtatttttcgtagagacggtgtttcaccaggttgacgaggctgatcttgaactcctgacctcaggtgatctgcccacctcagcctccgaaagtgctgggaatacaggcatgagccaccatacctggccttgaggaacttttgaaagcggtttcctaacttcttactcctccaagtgttgtcctgggaccagtagtacgagcatcacctgggagcttgtcagcagtgcacaacagcaggccccatacccaatctactgaaccagaatctgcatttttactagaaccccctcaggtccaggcagttcattctggatggggaagcactgtcctaacccagggattagcaaaccatggcccacagttagcccactgcatatttcttacactcatcagctaagaatgatttttacatttttcaagactgaagaaaaatcacaagaatgttttgagatgggaaaataatataaaattcacattttggtgtccataaataaagttttactagtacacagccacacactggtttaggtattggctgtggctgcttttgcactgcaaataggagagttgagtatgagatagactacatggcccaccaaacccaaatatttgccatctggcgctttacaggaaaagtctgccgacctttgtactgatctattttggaggtgcattctccatgcatgtgttctgtggaggcttgagctgcagtggccaggacttcctccacagcactcttcactcccttcccccgcctccccttctcagcgggcccactgtgcaccatgtctgttgaaggacacaagtttacatctgacttatgaggatttatgagggagtgtcctggcagctgccacctatggcccagaggtgaaggctcagggctgagcggagcccaggatgcctgtaggtgataggtcagtggaacagcacgtgaccatgagattcctctcagtttacagttctgcctgataagatgctgctgatttctggtaggcagcaggagtaacacctcagggggcctcagctcctttttcagccattccctcaagtacttggaattccagccaggtaggtggcaatcctggggttctcttctagaccctaggacaggggtggagcaagctacagtgactttccccggcaaacctgaccaccctggcctcttagctgtgtttttactcccagaatgctcagcctcacagtctcctgcccttttcccacagctggctgctgcatgttgcaggcagtaatgaatctgtttgtagatgagcaaagtacttccaggaaggccttcgggactgttaggtcactgtagtgacccgtatttgtgtaccctttgtgcttcctgaggacttctgtcttcagagaggggtccagtgagtctgagacaccacctcacaggagcagtataatgggagcagcaagcccaggcccccgagctcccaataacaaggggagcctagacctttgggagtaactacctcggccaattaaaagctgggcttctagccttttgggagtcatggactgttctgataatctgacaactctttttcagataaagatttatgaatacaaatagtagtactttctatatatttgacgaacatatttaggggctcatctgatccctggaatcccatctgtaaatcaagtgaggtgccctggacaggatggacttctagggcagtggtgcagccatgggtttgccttgccaggccagtgtgatgagggagccacgacagggacccagctgcccctgggggtggggtgagtgagcgaggaggtgccttagcttctgaatccatcccatttcactcagcccttcccctttccctcctgccaacctgctcctaggtcttttggggtgttaatttgtgatttttgagttgaattacaacgtaagtaaaatgtacttggtgtttaaggaaaaacaaggctgagataagacttgctacttgagaatgccataaaaatgtcaagaatttagctgcagtttatctggattcttccctcccttcctcccttttctgtccctttctctcccctaccctgcaccccccacctttgttcatcacacattgagttgagctaacagaggaaatgggccccgtcttttcctttttgtgtcgaacatctttaccctggagaaacggaccttcaagtctctttccttcacatagaattttagtcttactttaccagtcttatcatttgagccttattctttcatccaaaaaatgtttaaattcgtactgtgtgctaagaattgtaggcatggaagtaggagaagtgagttggaaatcagacacacttctgacagtctggtgcaataggagtggtccagtgtgacaaggtcagtgatgaagtagagaggggaatttaggtgctcaggaagggatagaagagggacacctgagccacagctctatgtaagctgggagtgagcaaggctgatgagagcagccacattggccacctttctcttttctcttttctcctctcttgtaccagaacctaaggaagagcactgcactcctcccaggagaggggagaattttccaccatcctgtagaggctggaaccttgcgccacctctccctgtccagctcccaaatcagcttgtctacctcctcttccttggagtcccagatatacctttattgcataccatatgataattcttaacccagggcatgaagtttttcatttgccttggatgcggggaaaatgtgtattgactggatgaatttcttcatttgacttgttcaggcttttagacagagaaaaaccaacctactgacccctgtacctttagagatgttcttccttggcaacatcctgccatagcacgggcagggaacctgggctgggtgggtcacactgtgctgtggagcagggccagaggtgaggagcaaggggctagagctcagcgcatgggcagcaaagcctgcttttcctttctggcctctgtctgggtgtgtctccaggaatttactcctccccttatgccagctgctggctagagctctcctccttgccgcctctgtgatctctgtgggctggcccagcctgccggggactgtgctgccaggcattgtttctccccttttgggccctgcttctggccctggtggacattgaagccatgctgaggggcatgcggcatgaggggcatgaaggactgctcttcagactgggagttccaggaaaccccggaggtgacccccaagggaactgggaaggcccaggcagtcacaagctgtgcatctgcaagtcctttgccacagcagagctcggggccttgcgtgtaaccacagttcccaccgtgtaaccacagttcccaccgcacccacatcaaaggtcactttgataatcagccatagccaaaggccacacattaagggctggggaagggagaaaagctgtttttagtggggagctctcaaaggagatgggaataggaggaggtggggggtggcatctagggagtgctggaggggccacctggagagcctgcatgtgacctgccctgaaaggaggaaaacagctgcagctccaggtctccgccagcctttccaaggcccctgtctacccagcactgctccctgagtctcatggaaatgcacgtgaagcagcctcaacctttccacctccttggtttgtaaagcaggtagcccagagtgggggacagccagagaggcaggaccctccagccctggcccctgttcagaatgtggcccccagggtgccctggctggtggccaacagtccagggccagactcccctgagtttgcggcagttggtctctaatggatggtaccaccagtgccaaggacagcaaacgctctgtgctgggcccgtcgcacagcaggaccaagaacccagactggagctgcttttttttggaaacaacaggctttcctcagggcacagcccgtcactcgcctggaaaatgggtgggcgtgggcttcagggcgggggtcaggctgtgtgtgggaaccagtgagctcctccaagagcagcacttatttttagtcttctccccagtcccaaataaactgagagcagctgggagccctgggtaaatgcagagtgaagcagagacaggaaatcggggctctcagtaatgagttccagccactccagaagggggaagccagacaaggaattttcttcaggactgtttccctctggcaggctccggtattatcactgagaatggtcccgtgtgtgtgtgcgtgtgtgtcatgtttacaacttctgtccaagtcttctttcttttttctctacctttgtgtgacatttgatttctccgcagggctctgaatcccagtcctggtgcgtgtgcgtgcatgtatgtgcgtgtgtgtgtgtgtgtgtgtgtgtgtgtgtgtttgttggggtggtcggggaggacactgaagcagcacggtctgctctgtgtcgctgtgtgtctgaaactgtctagggagaggctgaaggacgcaggccagggaagtggggaaatttgaacacagcttggagttcttgaggggggagggggcagaggcaaggaagaggagagaactggtctccagccaggaaaagggctttttccaccaaggcatctaactgctgacatgggtgcccagcatggatggggacattgatgtttacaagcatttctcgtggctgaagagggtaagtgactggctgctttgtctgggtctccgtggagataagtgagggggagacgctttggggtgttttggggtgtgtgtgcctgtgtgtggtagggggaggtattgtccagcaaagccctgctgtggccaagttcttcatgagaatctaattatagacaccagggagaaaacagtcagctgtctttgtttctccactgacattctagtgaatgagcctctgtacagaaaggcaagaatggagtgaggaaagttggttattttaactttggcacctaaacagtcagaggctccaaacaccgtgaccagaagaatgtgcccaccgcttttcagtttgaggacacagggaggaagctgctgcctttttaaatgcattggattcggaagttgtttaactcgttctcactctgatgttatccggtggagcacacatctgctgtcagcagaatgagcttctgcatttccggaggaaagctttcagggagttctctttgaatgctctgaagctgagggtttatgttgcaagttgttcatgccctttctttagaggataaacctgagtgtgtggtatgagcaaggaatgaacggacgttgggggctggagtagcatcatactcctagaattcaggctgtttcctcttttgtggctgcctttaaattggctaagataggtatgaatttattttcacacgaagggattttaggctgagtgtttttcagaggcaggaagggcaaaagcagctgacaggttagagatttgacattgtaactgcagaaggacagaagaaccaggaagtgtccagcttggaaggggcatgcagatgcccggaccccgactcccggacactgagctggctggcttttgtgtgagtgcagcagcactcattcagcaaatctgtactgagtttgggtactgggtgtatagtagtgagcaaaatagaaccagcctcttgtggatcttctacctaatactggagatgtaggtgaaacagtcccaggaaataaacctcagattacaaacaataagtgtgcctggaggaagaacagaagacacgggactgctgttttgatggagaagggggttggggcggtcagggagtttgaggaaattatacttcgctgaaaactgaaagagcagtaagaatgagtcaggtgaagaatggggtgaagaacattccaggcaaatggggcataggggatgatgtatatacaaaggtcctaaagcaagatggagtctgctgattgtccagattgagagagagcccatgtggctgagcacagtgatggcagacagaggcgggcagaggctgggatcacgcaggacagtgaaggccacggtaaggcttttgggcaacctggtttgtgtgctgggggacttgtagcagggaagtgacatgggatacattggggggggtctagtttgtattttaagaaaattactctagctgtgatgtggtatatggtaagctatgttgggaaaagtgaggcaactgaacacaattatagggctggagggcttggagggatgggatagtacaaacccctcatttaacaaagcccaagaggggctaagaacctcatggtattagtgtcatagctattagtggtgcagcctggtcttgaaccctgttctctatctcccagtctagttctctttattcattttctctgccaaatatgtataaaattattgctttagaacccagcagaaatcctgtctgtgcccagcccctagggcatcacagtcaccagaaagcatgctgagatgaccagacgttttggcaaaggtttgcatcatcttaggttttttttttaagccccactggggagatactgaaaggaaatatgtaagaaatgcactgaccatcacttggtccttctttccctgtatcccaaatgaagcttttaatcaagaaatcctttcagccaacatgtgcctgggattgtcagagccttgtcccagcccctggggcagatactgtaactctgcctgctacaggagaagttatgtgtgtggaggaactaattttgcatgtgatgcaatgtaagaaggcccttcttgtcccaagacccagggtatgctggctcctgtggacagttggaagtttgcttagggaaactttaagcaaggagactttagaaacccccaggatgactcatagcaaaacagatatttttcttctacttttagaattttaaagagcattttacaaaagcaaaactcaaagtgtagacatgtcattggcagtgtgataagagtattttcactattctctaccctaaacactactgccagatttttaaaatcttcttaaaaaaaaaaacaaaaaaaacaaattccctttcgtcctgtgaccccagtgatgagcccccctggactcacccttaatctggaagaaaaatcaggcccttcggcttgcttggcctttgagaccattagcagcccaacctcaacttacctttttagttttatcttttatatctaccctgatgagctcccaagtgtatttcttcccttttctgagcttttaccacagatgaccacctcctctctaactctcatccacttcaactgactccatccaggctgtcttttcccaggaaacctctgctggccctccctccccacctcctgtagcccaggtctgcagcacttcccatctgcatggctcacccaccctttctcctgtgcttcagctgaggtggtgtggagagctggtttctctgaactcatgcttttgaaggtagaaacactatcgtcttcattctcctttacagagggcatagattctggaagaagaggttcctggtgccagagcaggagcccttgccctttgagcagtccaaggtggtggtgtctcagggcaaaggggagatacttatgttcagagaggcatggagctggaggggaaatatttgctcagaaaagaaatcttgctccagggcctgtgtgggatgggatagtatatactattaatattacagttaagaacatggagtctggagtgaggcctgaattagaatcctggcattgccacgtttaccagctgtgtgatccaaggtaaattatctcaaaagtctggatttctttaactataaaataagggagataatagtacctaccacatacaggctttatgaggactcagtaagatagtacgattagtgcagtatcatgcatgtaggaaatactcaataacatgcttgctattaactgctattggtgattatcaggaagggagaagttgaaagaggaacagatggaaccaggttctctcctagaattgcctctcaggccattcagtgcttcagctttatgacccttcccatactccagatcaaggtctcaaaccaagcatattgaagacctagaaaaggcagctgcaacctgggccaccataggtgaccagaggcctcattggctgctggatctggccagcttggctgtggttgctgagtgaaggctgatcagggctgatgctctagttcattctcctaacagacaaagcctagggataaggtagtctcttgccacaagtatccagagggactcagtcacaaacagctcacacctgttctacattgagtccagtggatccaacccacacaaccatgaacacacctctaaaaatagctccgagcagggtctgtgggacccacccactgctctttcggcaagagttcattttcccaggaacagaaatcccagactgtcagcatcttcacactgcttcctggcttccagcactctcagtgcttaagcaaattccaactgtaggtcacaaagaaaatggaatcactacaggtcccccatgcagttggctcaggttctgcagtaaaaagtggaattaactcaagctgctaatgtgagactttattctgtgtcatctggtgctcaaatggttgatctagtagcctggccacttgggccagaagagctgcaaaggcagacacggaggtctcctcactccagacactgacttgccttgcattcatgttggactgcagtgaaagttacagaaataggcagcagcttctgtgaaggctgttcctactagttaagagcatggatcctggatctagattccttgggctcatatctcacctctgtgtagacttgggcaatttatttaaccttcctagaattcaatttccttgattatatatatggataaacaattctatagatagatagatagatagatttttttttttttgagacagagtctaggtctgtcacccaggctggagtgcagtggcacaatcttggctcacttcaacctccttctcctagcttcaagcgattctcctgcctcagcctcccgagtagctgggattacaggcatacaccgccatgcccagctaattttttgtatttttagtagagatggggttttgccatgttagccagtctggtctcgaactcctgatctcagatgatgcgcccgcctcagcctcccaaagtgctgggattacaggcgtgagccaccgtgcccagccaattcaatgtatgttaagtgcttaggaagcactttataagtgttagagttatggggaggatgacatcgatcagaactgacaacctctggttactcgggagccaggtacccaaccttgattctgaaaagagaggtttttcaatcctatgggaaaggcaacagtggatatggtcacccaagggcactagcttcctcaatttcctatgatacctcctatttctggccaacacacccgagatgcctgtacattatgtttcctggtataatttagaagctagaattctgccatctctgacatccagcacctgtaactcctgccagctccttgaagagaggcctcttttacccagtgggatttaacaaactggcatcacaccagggtcatttgctgaacaacttgtgggcactacagagcagcacagccattgttggttttgtggactggcagcagcacttagggatcctttgactcatccctgcttttctctgtcccttcctccatagcagctctttcacacttttccattagtcttcaaccttatactcccctttcaactgatgtcactaccaatgtcataggaaaaaaaaaaaaaaaccagccaaactgagatgagtctcttcaccctccctccctttcaccgcaaaatgtaactgtatttcagcatcctgtttcatgggccaggagtcccttctctcagccaaggctatcccagtatcctgtccttgacccaatcctgttccagctcctcttgttgctctgattgtttcttctctcagctcctccctgcctatctgtcccttgcccttggtggaaaatgcttctcctcaattctcagggaaaaaacaaatcaaaactatctttgaccctgtgcttgtctcttcatgctgccttataacttaccttcctttcactgttaagattcttggtgagttgttagcctgctcgttcatctctactccctcctggtcactcctgaagccagtgagcactaactttgttcctatagtcatcttttaaattccttctgtaatgttatttttgctgcctctagttcccaggcaatcttccccatacattttcctttgtattcatttccatttggaaatcttgtaggattaatggcattcttgtgacccgaggagcagctccttactttggctcttgcctaattctgtgttctcaaactttggatctttcatgccgaagagacaccaggctctaaagcctccaggggagctaagacagtcacagcgcccactccaccctaactgtagcacccagtcctgctgcactgtctctgaaggtgttttcagtaataatgactcagtgcatctattggagttggcaaggtgaggacagtcttcaaagagtcttctctttttactctcctcctggctttcacatcctctcattacaggataccagcacacatacaaatgctatttctgcagcccagtgctgtaagctttttatgtgtccagctaccagataaagagaatttagcagtgaccaagctcagccaaggttataattttggggaaaaaaaaaatcttggtaaatgtgtttctctacaaatctagctccccaggaagatcagttaggagcttcatcccagccccttggttggagagctgatggccagtttatcttcagggtgtcctgtgtttgctatgttagttctggaagaccagaatatctgaagggtagtgattgtcatagcttcatgggtagcatgtctgtattgggaaggctatttccaaagctgctgttctcacattctcctaggggtattcctttaaagccttcagactcaatcattcaaatggtgcctccactgtaaagcctcttctctcttttgaaggtgaaatgtttttgtctctcctctatgcccctgccattcatgtgcatacaactctttatgatagtacttattacatcctgctgcaaaggttgatttcttttttccttctgtccttattccctgtaatactacagagctttttaagggcagggactaaatcattgtttagcacagaaagtggcacctagtgggtgctcaggattattcaagtcatttcataaatacattcatgacgtgtgatgatgtgaacattggtcaaccaagaagctatttatttgctgtttatgaactctgctttgttcttccttaaaagaggacatttagatcattggatgatagcctcatcagcaatacttaacctccccttatatataattgaggggaggagggaataagggtcaaggtcaggataggctttctcttgttggactcctggtagccgaggatctgactgcactctattcacattgcatttggaagaaatttctttaacactgtgacaaagatggtagattggcttgaccgttcttcacctagaaaaagcagaactggtcctgggaatactcaggtttataataaatgccagaaagccctaaaactccttaataaaaaaatctaggggaagttttcttttttataagaacctgcctacactcatactactgggttcccttggtgttgggtaaccagagtcctgtaacaggaattgactgtagcttttgtgatccaatcatttttgtttatttatttattttggtccccttacttttaaggtttatgtcttctaagtttctaaaaggggttgcatgtgagtggtgcttctgagcttaagatatagccttagtaactttgatatctcccctgatgccctgtgcctggcagctatggttcacttgtaactagttttctggattttgataagatcctcttgactaggcagcctggaaacactacacattttcttttgttttcttattcagctaaaaatacatgtcatctaaatggctaaataaggaagaaccattttaaggcttatccaggacaaggcttacccaacgtgctgtgttcaaaatctcagcgtatttacaggcaaagagccatcatataatttaacatgctctgaccagttgggacagtgtatgtactgtggccaagatcctgaaggcactggaatttatagcttattagaagcactgaaggaaatgtaactctttacctggccaagatgacaactattgatatcaaaaaaaggaaggcagatgcattttgaggatcccaaggcaagagctctgagaagcaactgttggcttcaaaaaccaacatgatgctagagctgtcacactggggagccgactgttttaggttttcccacactccttacttgtataccaatgacacccctgttgtgatctagcccttgccccatttgactactctggaaccaactccttcccctagttcaatgaagtacagtgccagcaggaagtctcctgggtcatgccagttggggagtgctacagaactgccctcatccagcatccctgaggtgtaccagagcacatgtgaagagtgtgttctccttgcaaatggccagccaggccataaagcagtcatgctgcccaccacaaatctgcaggaccccagccatggcatcaagcactcaccctgtctagagctccaaggagagactaacatggctatcccttggccaagctacagtggaagggctaggccaggagagagcattgtcatagatctgaacagccactgcagtcagagggtgatgtctttgaggaggccgctgggggttaacttggctgaaaagttcatgtttaacccaaatttgaactaacctctagattggaacagaaataaaaacccaagtgtttatgattggttattactagctataaaaattcccagtgtactcattataaacatgtatgtagcacataatacttagagtacacaataaaacacttgtacgaaagaaaaatatgtggccatgaatgtatgactcaaaaatgtgagcacttgttcagggatagtggagaagtgaactcatctttggcaatgtggcccaaagacatgatcccagggctattagctaatggtgggttctgcgttgtcactgtcacagaggctttctttttgttttgttttttcatttcaagcctgaaagtattttggttattgttcccttgggttgtttgtacagatcttcatagatatttcttaggcatcctgatcagaaatattgcccctgttgttctcttacacaaaaagagtgaattaattaaaactttttgtagaaggcattaaatgatgccttctaactcatgcttctaactgaatgttggtcttttagattaaacaaagctaaatcatttataagttagctaaattcatttgttaaattataatttaaaaatcatttccatattcctatgattattcaaaaactgtttatatcacacaggaatttttagagcaccctactataaagagcactctgtagttttagtgccacacgttttcaggtatgctgacctaacttgaccctttctgttgctccgtgaagcatgattttttctattgaaaggatggaaagcctgagatgaggtaacctacttgagattacacatggttaggtgcagccccagcctcctaattattcttggtttgtcctctttctgcagagaaggtggtcccttggggaggaggatgcaataggaattctgtaaatgaatatggaagcaccacaagaaagtccccagggatcccctgacttgaagttcagctgggccaaatgaggggaacagggaacccagagctctcagcctcccagcgcccagacctggcatttgtacagctgtgtctgacatgtaattctttcgacataacttcttaaacagttgttagatctatttctgttatttacccttcatttattcattttctgattcattttctgataatatcttttagactttagctcctgtttatttcttgttttgtttgaacttactttttcatatcacacatcctgctccccacctccaccaaccccggttgatgcccatgggcctgttgcatcttgtattcattccctgtcttaacctttttgctctacatgggaaataagaatggaagcaaacaggtggtggatagaaagccatctattccacacacaaaggacactgagtgccctttttatcctagtacatcccacacagacactccctgtgccacaaagtagatctcaattagcccctgatgataatcctggtttgaactatagttggcttaggactgacagccctgtcttaaaaattgccactttaagcaaatcaagcaatagtggcagaattcctttgcaattcagaactatatccaaatagcaggaattctttcctacaagtctgtttccaaaggagtaaattttagtcagttgatcaccttttgagacaaatgtattaaccagaacttttggttgcaaataacagaaactcagtttgaactaggccaagagggaaccaacaggaagggctggaatatatctctgcctttaggcagcgtgcaccggggatgagaatgcctccagtctttttcttggcttttgtttgcttttctgtgcacactgggttcatagctgtctcttgctgcaaaccagctttttccacgtggagcaggacatggccactgacaacctcagaactgtggcaccaccactaccatgctctgttcccaagtttaaaaattcagaggaaggatttcaacaagtcaagcctggatcaagtggcagggagatgaggatctttctaagaagatggcagccctcatttataccacataattacagtaaaggcgatgatctcagcctagtctacacaaacaatagattccattaaagcagggtgctgattctctgccaagactgatacaagtcttctctgtttcttttccttagcaagaaaacaaggggaacaatttggctgatctagggttcgccacaattcatggtgaagtttcttttttggacctgacatatcccctgaaaaatctcatccctaaaatgcaatgttctccaaggtgcagaaatcttgatttctttgagtatgccagcaaccagctctctgtgcatgaggaacttatcaagagtaaatttcttactcagtgaccaaggggagggatgggagaggtagggacaggacctggtttaggttaggctagtatcattgtacggtccaaactgccccttatgtggggacttaactatccctgctggaatcttgctggtcagtcagtcctctccctcctggctactcacagttctctctctgtcctctccctgctgaggctgattgactatcatgatcaactccaggatcccaaccatagaataccctgcacagctgatacattttcctgaggcccctctcagttagggatggcttagaaaatacccacaccttaggctgttaattgctcaagctgcacattaggcttgcccagccacggcagtggtagcagtttgggtcttacagaaacagaccctaggataacctgtaagaatcaaggaggtgtgttgtcactgtttctgaagacactctggaatattactcccaaggcctagggaagaccttgatatgacaactctgtgctgtgttttatatttgcctccgcgaggtctgaattttagaggatgaattccttgtgtccaagacttttttcagcctcttgagagcaacacttgatagacacaaaggtggcttggcttcaatgatcttgactaagggtgctgagttcttaaaaatatccattcgagaagcccttgtcttgattcagttccgtgatataggagaggtagtatgtttcactgtggcattctttagtcaaaattgaagaggatgtggaaatgtctggagttaacagttctccacagggcacacagatcacatggttctcactatatttttaggtaactaacctgaattacagtatcagaaatagctctgaccatttgaatgaatggtctgaaaatttgaatgagaagattgacttttccctgtcacatttgtagcaataaccatcagaacagagggggaggaagtttgatcaaatatatgtaacacagcttaccattggcaggtctagcctagtggctaatgtcattggttgagtaaaaattagctctttcttatattcatctgtggattgagcatccttaacaagtataacgggggtggatgatactctcctttatagtcacttgccatcccacagtggggaacaatagaaaattagcatgtaggccaggcacggtggctcatgcctgtaatctcagcactttgggaggccaaggtgggcagatcacaaggtcaagagattgagactatcctggccaacgtggtgaaaccccatctctaccaaaaatacaaaaaattagctgggcatggtggtgcatgcctgtagacccagctactcaagaggctgaggcaggaggatcgcttgaacccaggaggcagaggttgcagtgagcctagatcgcaccactgcactccagcctggtgacagaacaagactctgtctcaaaaagaacaaccccctcccaaaaaaaaaaaaacctcagaaaattagcacgtagcatccttcagaatttgattggactttcttctctgtgaaatgtgggcatggtttttgcaacctgacttcatgcgtggagagctgggcaactgctctatcgctgacttacctaatcaggaacatggacaagacttttcagagacacctcaaacctggaatcatgcagggatccactatccatccaagccttctatttgcaattccactattaaagaagcaggtatacttgttgaccaagcaagctgtctttaaagtagagcaaaacagagatgtgtcctaactcagtcttttaaaatatttttctcaataaattggaatcccattttgataaccacaaagcttattatgccttgatgatgtagtcattttataatgcaagaatgataccagaacgtgattgaacctgttgccaggttataagaatacagaatatacagattcacccaaaggcaaatccttaccttaggctgatgagtattagcattcagcaagacaatcctcttcttggccctgttctcagatgctttccaagtttttctccaggcagaggtggcatttgatcctggcctatgcccttctgaagaacgcagttttttttaacatcctagtcctatatagatcatgaaaacacatggctctgacttcatcaaaagcaaaggatagtgatactgtgggtttccatctggaacattatctttcactgctgtttacctttaaaaagcttgctggagaacggtgattttgaaggacctgtagaagaggaagatgcactgttcctctagaacagtgattggggtgggggagggacctgtctgccatgcacaccactgctgtatggaccagtatgcctgctaggaaaggagttggctcctcgaatctgttataggaggggcaaatatgaggaaccactgttctaggtcctctaacagtgcttctagattttcaaatatattttaattactcaatagaaacattttgtaagaaactcaaacattatgtcaaagtgctctgaacagtgcctggcacatgttgagcacaaggtgcttgctgtgtatttacagcactgtgcctggaccatattatattagtctccatggaattgctttcacctttggcccatattgtccactagcctctgaactattctgagaacatcacacaaaagtaatgagttctactgggctctgtttactataagggtgtcatggatattgctgatcccatcacacaaaatctgtctatgaaaacgtgaagtttctcccttgctccggaataattatgcttctcctaggcaattgatttgattttaccatactgatctgcggatcctgttaactgattgtgcctctctttttttactggctgctagcgtggatctagatttttgatcccccttctagcatgtgctatagaatctaggtcatacattttattaactgaatttatgatttcaactttcttactcttttttttgtcaactagtaaaaatagttacctctctgggtgattgtatgggtagaccttttattataatgaagaatatactgcacaccatttgaataaggcatagttggtacagtggcttgctggagtctctggaagaagtcttgcctttggtcttctctccttcatttcctgccagagaatgggcggctgccagtgctaggtggctccgtgtccatgtggacttcggcactggggttctacctgcagagcttcacttggacacctgggtcctgtttaattctctgtccactggaaatcaccatcatgtgagttctttgacagagaagaagttgacctgctattaagaattattctcctaccttttcttctctggttctgagaaaatatagattataatatattcttggattctagtcagagaatttgatcatgtgagaaccggaatattaatttaacaacaataaactgccattaacaaagaagtcagttgtgattgttaaggttctttgtctgtggcatgaaagagcttccataacaatgaacaagacataggctccagaggggctggagcagaagacagtggtgtggcagcaggtgctgcctggcacagctggcctggggagtggcccctgggcctgtcctctggctgcaccttcaacaaacaatcaatgaatctttcactagtgcgcatccagggtttgaatgcggtatgcttggtccacatttctgttctaggactgggcatggctctgttgcctccctcacctatgcagtgcattgggaaggggtgggatgaggggaggaaggaggtgccttttctcatggagggtggtgggagagcccatgctaaaagttgaaatgtggggaaatggcctaggacaaggtggcccaactctgggtctctcacatctgcctctttgcacaattaagactttcctctagggtggtagacacctccctcgtgaatattgaagtgctgatttcactggaccagctcagattgtataatactcagttccacatttagcaatcagatctactttttcaaactgccaagcctctgggtggcctattgcagaccagtctgatttcagtcttccatttgcatggaggaaggaggtgttggggccagcttggtgacattagctccttctctcctgtctgcccacaaccaggtcagacacacccaagaaagtgacacctcctttctctgcttgggacatttgtaagattctgcctctcctctgacatttcacatcctctccctttcctctcttttctatagtttctggctacctgtaatttccttagcttttgctctggcatccctctggctattatttaagttcttctcaagatgttttgtcttagcttgcttctctcagctctagcactggggaaatgtgatctgccagcctggctaccaaagctcttattggagggtgggattggggtgggaagggacgtgtgaatgaagggccttgtagttgacatcctccatccttcatgctcactgtgatgttcaggatgggcctccatgcagcaaggtgtgccttggcttcaggggaccctggcatgagaattaggagataccaagatctgtgcagaagctgttcccatgtagtcccttggagaacggtgccagctctccaatctcctcaaagagcagaccctcattgtcgccatgcctctggaggctgtgcctctggctaacccagacccagcatgtcaagtcaagcactgctgggcctagagtttcacagaggccctcctggccaggagtgaggtcatccaggaggtggttgtgccaacttccagggcgcacttttcagtggcatgtgatctggttctcctcatggtagttttgaaatcttgtggtttcctgttttgatgattggttttgtacatataatcagtgaaactatcctcacaaattacatgcatcccttatttcatttagaagttggtaagatgtttttccaaccttttaagtgtattcttttttttctgtcctctttagtcccaggtaaaccaccacagtgctgctagtaatgaaacctaccaggaacgcttggcacgtctagaaggggataaggagtccctcatattgcaggtgggtactttttggtgagaatcggcttatcctgttacctcctactatgtagcttcccctaagtggaagggaagcccaagagattttctctgttggaatttttctccttccaatgcctatgtttttagaaaagacttttcctgaaataaaacattaagtaactgaggggacaatttaactctagacttggcttaggggggctgtgaattcagtcattcatttatcatgcactcccaagcacccgcttctatacactggcagccccatgaccaggctgatttccaggtgctaagaatgaacaaaatgggccctgtcccccagaagctcctgagtcttgcgagggaggggagatatatcctcatgccactaataaaacagagctgtgggtgatacaggcctaagggtgaatgctaatgaatcaagtccaaattgtctgaagctggatctagactgatccctttaatgccaaatcccctggagctggtaacaggggctaagcctttgatagctgtcttgcttgaaagagaggagctccaaaaccttttacggagaaagatcatcaagggagctttttcgctgttgaaagtttgtgtgccttggtaggacatagagttaggtattctcataagaaggctgttgaagaagcaggcccagcactttgctgtgttagctcttgaaaatataaattgattaagcaagcatttactcaaggtctggtatgcatcagatattaattagtgatttggaaaatataaaggctagtatcctaatcccagctccttaaaagcttaaagggtgatgagttagactggtggtagaatgaagggaggggttgagcggggcctggaacccaccccaggctatgggctttagcttggagcactaaggttatgaggtggcagtgtgtttgttttttctctttttaccttacttattttactctttcattgtattttatgaacataagggtaatgaatgattttaaaaacctttaaaattctaaaaatgtgaagaagcaggttaacacttcggccttttttccagtgttgttggttttttttcttttgcctctattgtaaataactgagctcataccaaatatatagttttacattccagttttgtatttttcttcacttcattgatttcttcattataaaataattgggtatctacaacttgtgagatgctggttttagatgctgggataaagcagtgaaagaagcagactaaattcccattcttgtggatcttccatttgaaagagagagagtgggccaggtgcagtggctcatgcctgtaatcccagcactttgggaggctgaggcaggtgaatcacctgaggttaggagttggagaccagcttgaccagcatggtgaaaccctgtctctactgaaaatacaaaaataagccaggcatggtgatgggtgcctgtaatcccagcactttgggaggctgaggcaggtgaatcacctgaggttaggagttggagaccagcttgaccagcatggtgaaaccctgtctctactgaaaatacaaaaataagccaggcatggtgatgggtgcctgtaatcccagctactcggaaggctgacgtaggagaattgattgaacccaggaggtggaggttgcagtgagccaacatcgcatcactgtgctccagcctgggcaacagagcgagactccatctcaaaaaaaaaaaaaaaaaaaaagaaaaaggagagtgtgaattgacaataagccaatacattaactatttcaggtgctggtaagaacgctggaaaaaagtaaagcaggatgaggattgtgtagtaaaaggaagatctcctttacaggaggaagccaaggagggagccatgcagatacctggagaagtgcattccaggcagagcaggcagtcagtccagcccacacactgaggcaagagtgtgcttggggtgtgggaagaacagcaagtggccattgtgcctgcagtctgtgctcaaaagggtggtgcgagctgcctttagaaaggtagcaagggccagattgaatagcacattgtagcacagatgtttgagggatgtgtaatttgaaactcttatcccaatgacatgattaatgaaagagtatccaatgtaagattttgcagcaaacagtatgaaattgcaaacttttgaaccaggacccttcatgattgaaatagcacattcctatttacagaggattacaatttaatttttcaaagtcctgtgtaataatgctccctttcacattcatagttttctaaaattccaaattcttgaataatccccatttaaataatcctaacacaattgggaagctgcttgccagtaaagtcagaagttgaccctagtagtttctactctactgggagcttatgggcagactccaggagtgtctgttaagtgatcactgctgttctgcagtggagctggttaggcagattctcagcagggtagagcctcttgcttaatgcacacagcagcttagccagactgaattaatttagagtccttggcccagaaagttttcctggttctactcatagaacaaggcaaatcacacataacaaaatactttgtttctaggattagttaaaaacaaaaccagaatctcttgtatcttcattataatgtaactccttaggaaaaggatttttatcctttttttttttttttaacttctgtatcctccagtacctaaaattatgcctagcatctattagggtctcaaaaatagttgtttttagtgaacaaaggtcacattttatgacctttatgtattttgtctggatttcctacatcccttcatttgtaatacttagaatcagcgttgaggttcagaaagcccctggagctgaacaattagctatagaatgctagagatcctatgattccttgagtatcaccaacacatggcctcaaggcatggtatagaccatagaaatgtttaaccctcataataagattaaccagaaaacatccttcacaaacagaaactctggattccagtgagcaaagcccacccccagagtcctgcccttttgaaagtagagttagttcaggatggctgagagtgttgggccacagggattaataaacacccacccacaaaggtttgcgtgtaaggtggaccaagttgatagaaagagcccgttcttgtttttttttttttttttaacattttttttggttaaaagtggaatgttaaccatgtgtcaactccaggaatatgtttcaataattcattaatcatttgggaaaataaaaatggagatcttaaagtaggcatattaatttagattagttcctttttaaacaggcgctttataattcagaaagtttatctaaacactcataaatgaattcacatcaactcatgcaccatctattattccatttcagactgagaaataattctggataatctatatgtaaatggcaacaactctaaccaaaaaggtctaaaggatctcagtttatcaactgctaatttcttcactttggggaggacactcattctctctcttcttgctttgaaccatctcttaataaagaaaaaggatcctggggccgtttgctaatagagaaggctatgaaaaccattgttaatatatagttagtgcataatttgaatgacttcctgtaaatgagtttttactaattaatatttttaatagggattctcagcgttcttcagaaagatgactttttttctgccaccgtatgtgtaatgtggcttctctatatttatgacttagagtcatgttttggcctgtgaagcacaataacctttctggagccaagttttgtcagtgctaatacatgccctttacagcccacattccttaattgcatcaaaacactcacctgataggtgagcagtcctcacacccttatgagagaggtaaggtcattggttagtttccatgaagtttggaccgctcttccacacgaggttgcagaagtgctggcaagccagctgagatgtgccttgaggtcggggctgttctggaagaggaataaggagcaggagtccagcccagaggcagctcctgtggctgttgggtgttttactcttgagtctatcaagagcagtaaacgtgacccatgtcatcagagcagtggccgagactccctggtaaggtaagaatctaactgcagctgccttcgttcaggacacttcctccacctgccactcagcaaaaatcaaaatcgttcactgtgtgtaagagtcagtggtgagatttaacggctcccctgaggtggggaggctttcctgcaccatgtcaaatccctggtcctccaccattgctttatttcctggaacaggtgagtgtcctcacagaccaagtagaagcccagggagaaaagattcgagacctggaagtgtgtctggaaggacaccaggtgaaactcaatgctgctgaagagatgcttcaacaggtaagggcgggtgcactgaaggcccttgggtgccgaagcagctcatgtgctgaagcccctttgtgtgcccaggctacagccctcgctgtctgctttcccatcctgcctgggggcgggattggctgctcagttgtacggtgtttatacagcaggtgaaaccaacctgaacgttgagagtggcagagggggtagggaagggaagggctgccctgagatgaataacctgctgagctggttagacagattcccagacagcactttctccagacctggtgcagtgagggagcgctcggctgggggcctcaccctcatcctgtgggtgccatctggagttttagaaagtcaattctcagctgattctatgcccctttcccatctcgctctgcctcttcctactgtatatagtttttaaaataaaaatattatataaataaccttttagtataatttaatagatatcaaaatggaaaaagatatttaactgttccctaccattcaaataatgtcttctccttgttttctttttgtccttgttatgtgtacatgtactttccaaatctgtaatcacaagagatatgcaatttagtcctcagattttgtatgcttaatattatatttttcccatttaaaatttttgctgtattgtcatctttactatcacctataatagattttcttagtaaaagtatcagaattgacttaactttttttcaattcctaaatatttttactgtattataaataatgagctacaattttttaggaaggggtgttgaatttttattgtatcaaaacttcagaatttgttgagaagcgaattaggtttttaaatgaaatgtattaatatatctaatcttaaattttccttaagtcattcttacattttaagttatcttgaaaattaaacaatgactgaagtttatgtgtgtatgccttataactcctggcatagtacttggcacataaaaggtactcacaattacttaaagaacaaaagtttgttccttaaaatgagtggattcaattagaggactacttataatctttcctccaaaagcgctagcattttttttttaattgtcatgatcagcataagactcagattgtttcttgacagcatactggtgaacacaggctttgcattttacctttggtctcatgacaaatgtcatgagaattaatctggtgtttgttagttttgtttgagtgcctttgaagaactttatacaaatgtaagtcagtgtttttatatatatgtcttcataaaaacccgtttcaatgattcaggaacttttgtttgttatcttttcattgctgattaataaattaccacattcttggcgccatttgattttctacttaggttgtgtgccatttctcttgttcataatatttcctaaaaatctgactagcaaaaggaattgaggctttttttttttaattgaatctttcttttgaagacccaggaaagaaaatagcctgatggaaaaaaatctcaaatgatgaaagtattttcacaaagagtgcagaaaacaacctactagattgtgttttcaagtctgcacaaggtgtgtttttgaggtgagaaggataagggaagaagatgatggaatggtgtaaacaatccagaaagagagcaagaacatttgaatacggaagggaacgtgtcagaaggttgatgtttcaggaaggctatgctgggagagtaaccacataatcagaggtcaacagaatgctgcattgtagtgcctgagttatctgactgcctgtgctggcttctctgagccttctctacatagctctctatgacagtgtttctgctccattgtcaaagtctctgtgtcaaggagtctgattgtgatgcccagcaccacctggggagaggctgtctagttcctctaaacatcatcccatggatggcattttagacttttttaaagtcataaactcaattactttttttttttttttttttgagacggagtctttctcagttgcccaggctggagtgcggtggcgcgatctcggctcactgcaacctccgcctcctgggttcacgccattctcctgccttagcctcccaagtagctgggactacaggtgcctgccaccacgcccggctaattttttttttttttttttttgtagttttagtagagacggggtttcaccatgttagccaggatggtctcaatctcctgacctcatgatccacccgccttggcctcccaaagtgctgggattacaggtgtgagccactgcgcccggcctcaattaccttttttagcccgtttattctaaaccctctttcctgtgtgctgtgggtttggtattgggcgtgtggtaccatgtgccatagagggtagatgtcttaacctggcatattttggagtatggtagccacttctgagtttcaaagattcctgaacttgaccaagttatttttctgcccataagctttcattgtattctctcaaactgtcaagggtcaaatgatagcagtgtgcagtgctcctttcttaacaaattgagttcaagccataggacacatctgagcctcatcttccactcatgtgttcgctgggctgggtggcaccagagcttgagatcttttgagttcccagatctaaatccaaagttgaatgttcggccgcacatgctattgctttcctgaagtctgtttgatgctgtttgtgaagacacttgattcttgcaccacagtgctgatgcaatatctctggcttggagtatgtgtgtattctctgagctagggacaggcaaacacttgcctgatttgactgagatatcctgggctgcagggcccttggcttctggtggtaggagcaagaatgactcatggcctagaggcagagaatggaggcaaacaattgcctctttctgccagcctcagaaaccattcctgcctggagccaaggcgagcctgctgctcaaagcctctgaaggaaatcctttcactgtctcagtgtgcgcccttctaactgcctgtagataaggtgcttcctcggggtttgctgctcctgataaccctgcatgctggagacatcctgtctgaaggcagcagctgctgttctactccagttgactgcccatgtaggcctggtaatgctagatattctcatttttcacaagagactcaaaatccagatctaaagagttaaggatctctgcttttaaaatattagcagctaatttaagttttttaaaatgctgtgtgaatcatacagtacatacctataggtcaagcctggcctgcaggcctccaatctgcaacctctgctctagacttggccccttctacaggctggaataactccagggggacttggggaaagccaaatcaatgaggatagcccaaaccttgtgcttaaaggggctccaagaaccccattgagctgtctctctccatgctgctctcctgaccaatgtcaaccttcctccaggagcacaagaggtgaggagttagttccttacctagttcatgaacaatatactcactgtatccccaaccacaacatcctcagtctgtcgctgctcagggctgacctcccaactcccatctgtttttgtctacacatgaactcatccagcctccagaaagagcaagaagacctctcttggggttagacaggcaaatcagaaccaaccagagccagcaaaggggcaggtccacatgagcccacctagattatgaacacttttcagggcaaaataatgtttctgttttgcagcccacggcaggatgtgggatgggaagggaacatgatagctacaagcatctctcaggactgctacaagcagacagctacaagcatctcatagctgtcgacatacacatatagacataccttgtagctgtctacatagacagctacaagcatctctcaggactgcctatggaagcacctagtcagatgtggtcttagactcactgagcatgtctggattgcccaggaaactttccccattaagaagagttatttctcggccaggcgctgtggctcatgcctgtaatcccagcactttgggaggccgaggtggacggataacctgaggtcaggagttcgagaacagcctgaccaacatggtgaaaccccgtctctactaaaaatacaaaattagacaggtgtggtggtacataactgtaatcccagcactttgggaggccgaggtggatggataacccgaggtcaggagttcgagaacagcctgaccaacatggtgaaaccccgtctctactaaaaatacaaaattagacaggtgtggtggtacatacctgtaatcccagctacttgggaggctgagtcaggagaatcgctggaacccgagagacggaggttgcagtgagccaagatcacgccattgcactccagcctgggcaacaagaatgaaactcaaaaaaaaaaaaaaaaaaaaaaaagaagagtcatttctcaaaaggatctttaagggagggacagtctgagtcagttttcactggtctggtattgtctgagcctgaaaatagaactcacagtgctgggctctgcctctttggtccttaagcagatcaaggcattgctcagctgcacagtgaggctatcagaggccagggcccagaattgtacactagggtttccggcatggaccagcgatgttcttgtgactgcctcaaactatgctggcaacaaaaatctctgtatcatggggagggtttccctggtctgtgatataatcgaggcctgtggtggcattttctaaagtagccactgtgagctcactggggtctagtaggttcctgcacaataagctcctctgcctctgatcactgacccttctctagaggaggaagaagctgatgctactcggtggataagaggttttacatggagctggtggtcaaatggagcattttccagagactggccatttacagatataatcaatgtaaacagaaacaatgttcaatgtcaaaacaacacagggaaagggaggactgtggggagcaagtaagggcataatcctgcttttgggaaaccttggacaacaccagcctctatttctatcctccctaccgacccagagcttcagggtttaggcaacttcattttttttacttttaggtgaggttggggagtgacaaatataggggattaagagttcatggatatgggtttctatagatttgctatttgctattgatctgggaaagtcagtgtacctgtttccttattagtagagaatgaggatgacaatatggactctgtattgcctacctcttacttctcagagttatagtaaagttattccactgttattaagcatgagctatcacacagtgagtcaagacactgagcctaagacacaggcctagtagatggctggtaaacttcccaggagagcctttaagcaggtatttctatctcaaagagaatattaaacagagctgtgtacatgttccggtgggaacacaaatctgtctgaggtgggtaagacagtgattcagaagtgaagaaaacaggaatttttcaaatattccccaaaattccctctggggatctatgagctaatgagtttcttcatgcttatcccatgtgatgttgggaatccagactacagggcaaagtagatactttaactccattttacagataagagtgaggttcagagagatgattgagttagtgaggactgagcctggcctcaaactcgagttgactacaagcacctcttctctgcacagtgttactcatgaaagagacttccctgcaagacctgggccttttacttcaaagggcaaagagacttatttttcctttcatgcctttccatggcccactctttcattctggtttcaggttgccagtctggctgcagtcctctgtcattggtcggtaacaccctgggtcatattccacacttaaagatggaggtaattgcttcaagatgtggccctttaaggagagaataggttgaaaggcaaattctttttttcagctttagtcagagcctgagttttggaaaaaggaaatgatgagttgctccgagatataaactttctttcatctcttagaagaagtatttgtccttctgaaaaggttagtggcagttttgtccattgattttttttctaaacctttattacccagtttcatggtccatcacagtaagtaaaacaaaccaccctcccccagaccacctccctccttatttgcacagggaaccttcaaacaattgggagcagaagcagaatgatgcctgtgaagcctttgccccttatcctcagctcgctgcctcccctcaactccctccccatatactgcggtagctgcatgactccagcaggattccaccatgaaggtcaggaagccttcagcagggggcaagcattgcctggcgaggatgtgggtgctccagacagcctggatcagagttgactccagtcttgggtgagaatgagattaagggctccaagaatgttttccttacaggattgacagaataaaggcagccagcaaagaaaatggagaagaaaaaagaaaggtcaggaaaaccgagagcaaggaagattggggtggctaggagtaccttacattgagtggataaagggcgagacagttaagatctgagaaatgcaagctgcatctcaaagtttgtacattggttccaggactatttctgtgccctagttggtgaaggcagaagccaggttcaggcaggcagaaatcttgttgaggagtgacacacacatacacacacatgcacccacacacacccacctactcacccacccatacacgcacacacacccccccatacctactcacccacccatacacacagacacaccctccacacacctactcacccagccatacacacacacaccccacacacacacctactcacccacccatccacacacacacacccccacacccatgcatttgtccagcaagaggacatgggagttgacggtgttagctttgagggcaaggtcaagacggaagtttctttagaatgtcagaaatttgatcatgtttatagcctgaggattgggagctgatggtgagggagagattaaatgcctgccagagtagatgattgatggccctaacctagagtagcacagagcttggtgggaacttactcaaaggcagtacagaagtgagggagagtccaggaccatgtgagcaggagccattctgagttaccagctggagggagaaacaggaccagaactcagagaacagagccaaaggctgctggttgaccaggaagttaccgtaaggtttatcaagttgtatgggaatgtatgaagagtcaggagactgagaaatagccagaaatgggaaggtcagtcaggggcaattcaggagcaaattctggaagcattgtatcctttgatgggtactttttatgtgcacctggaagtattctgaactagggaacagttttcaaaggtgaaagaaccctgcagaaaagatggcaatgtacaattgtcgcagtttatccttggaaaggaactatgggcttgctgtttctaagacagggatttaagatatatgaatgagagatgatgctaggaaactttgaaatagaacttacattcagtgaacagatgcattttatcttttcagcaaatacgaggagagattatttgaggagaagagggagacatggtaggggtttagggcttgagcagaacagaaaagacttggaacagttcctgaaaggagtcagccagagacaaacacaagttttgccaggcagtattggaagatcagctgtaattagatagcacaaatttgtacagaaaccaactggcatcattaattgcctttcactagcaatttttaagctgtggagagtggaatcacgacaaaagactaacaaatgcacatgaggcctgttacagggatgagatcccatgaggattttctgctgtggtatgaatacaattggaatgactcacctcaaggtacagagttgataaggagaacaatgttgcttcaaggaagttgataaaccaggaaaatagagttactaagtaactagtggccgcagaagaaattagaggttgagtgagcaagtgggacagatgaaaggtcagaagattgtggccagaggagagaatttcagagctgaagattttagaagcaaagcaaacacattctggatacacgtgagatccaagtggtgactgtgctactgagaagctgaacgaaatggaaagcaaagcctgttggagctgaggtcaaagaatgtgaagccagagtggatactgaatgggaaagttaataacaaggatgtggaagctattgaggagacggagtgcgcctaaagtaggtagaaaagctgttgatcaagtcaaaagcctgaaggaagtaggttggttccttcggtttggggagaatgtggtataagtgaagagcactgtcttagaatagcaggatagatgcagatggtcggggggcaaaatactggcttggaagcagccctggaatagggagcacagtgttctataagttgggttggtggaagctgagtggtctccaattgaaatgacggggaagaatgtgtaatattgttgaaaaaacatgattcactttatgttggaagtagaaggagcaattgaggatgtaggataagttaactcctattaaagcacacattttagagatcacagttcataatagtggctacgggccttgctggatctggagatggggaagtagagctggactgggataagtttgttgaaggctgattttgagtttagggaccaaaacagtaatcatgacaggggcaaggggaagatgatcatgaaaggtagaagcacatgctaatagatataagctagaagagaataagtaaatgttctgttattagtgaactatatgaaattaagcaacctcaggtttctaattaaaatgttagtgtgtccaattgtgaatgtctgtttggaatgttagtgtggctaattcaaacactggcatgaccaattggaatggctgttggaactagtgaaaatattgtcttcatcagctggaaccattggtatgactaatcacaacctggtagttaaaatagggattttggcaatgatggaagcagagtagactcttagctttcaaaagagatacattatgaaactttaaaaaatcacatcaaagcagtattttgaatgctgatcagaagacaaaactgcatgaattttttttttttttttttttttttttttttttttttttttttgagacagagtctcactgtgtcgcccaggctggagtgcagtggcacgatctcggctaactgcaagctctgcctcccaggttcacgccattctcctgcctcagcctccccagtagctgggactacaggtgcccaccaccacacctggctaattttttgtatttttagtagagacggggtttcaccatgttcgtcaggatggtctcaatctcctgacctcgtgatccgcccgcctcggcctcccaaagtgctgggattacaggcgtgagccaccgcgcccggccttttttttttttttttttaagacagggtctcactgtcgcctaggctggagcactgtggcatgatcacagctcactgcagcctcaacctcccaggttcaatcaatcctcccacctcagcctctcaagtagctggaactacttgaggcccatgccaccacgggtgctaattttttttttgcgtatgtattttttgtagaggcagggttccactatgttgtctaggctgatctcaaactcctggggctcaaatgatccacccacctcagcctcccaaagtgctaggcatgagccactgtgcccaggctgagcatcaccttaaggtgttcaagtactcaatagtggctttgttttattagtaattgtcatgtatctaggcactggcatctggtaggtatttaaaaacatatttgttgaataaaagaatgaagtctcttgggggatttttttttttccctgagatctcagtagtctgaagacattttcttgtggaccttgacctgtgcacttgttccttttcccctttgcattggcagctgggaagctcacatgtacattatagtccatctctagctgtttatagaagtttatggcatagattttctactaactctgactttaacttattttcctacctgctttaatttttatgatttattttttaatttgaaatatctattttgcaaactgcctaaacacattttgggaataaggtaggtaggcagaaggatggagaactagagaatgaggtaataaagaaagagagggaggtagggaaaggaaagaagggtaagagagtaggtggtgtgggggatgattacatcttaagatactcacgtactcaagactcagagactcagataacttattttatgtgccctcacactcagggaagaactgcttaaggccctttgtggcctgcatagccttagcactgggtcctgataggtagtatgtgctcaatgaaatcttggcaatttgagtgggcatttcctgggctcattgaatatttgttgattgcctattttagcatgtttttttaaatgtctcttaaaatgcttggacttctttctctgtttgggaaactgtgatacaatagactaaaatgagttctggagtcaaacagacttttgtttgaacactaactctgcttgctgggtgtggtggttgacgcctataatcccagcactttgggagactgaggtgggtgaattactggagatcaggagttcaagaccagcctggccaacatggtgaaaccccgtctctactaaaaatacaaaatccgctgggcgtggtggcatgcgcctgtaatcccggctactcgggaggctgaggcaggagaatcgcttgaacctgggaggtggaggttgtggtgagccgagatcgtgccattgcactccagcctgggcaaaaagagcgaaacgctgtctcaaaaaaacaaacaaacaaacaaacaaaaataactctgctgctgattggcttgtgtccttggccaaaagatttatgtactctctcttggcctgtttcctcatctgtcaaattgggataatatttattgccaactcatttggagggtttattaagaagatgtatacaaaagcaccagcagtctctggtacagaggaggcactcaacaaatttcagttctccattgcattggacgcactcatctggctgactcctagtggccaagtagcctgtgctctggctgcagtgctccacctctgccttgtgagccagcttccagtctggctggcccaggaagagctggcctccttaccccagagctcggggagctcattatgctgagttgctgggcttcaagagagatacccatcccctcagactagcagatgaacagtttgttgcctacctttcccaggtaggctgttgcccagcctgttggcctggggaatcatgtattccaagtcaaaaatttctgtcccgtgtggtttgattcataatctgaggacggttccaaatctgtgacctcatagtgtttgagtcagagtgttgagattgccattcttgtgctgagcttgggttgcccaagatgatacaaaatgttcagaccatggcaggatatcgtatattttccttctgttcatttggcccattgctttcctggttgctgtgtctattctccttgccacaacctttgtagccagtgtctaccatgtgccgggattttggacctcataggacattgccctttgccaatggaaaaatatgtttccctggactttaggaaatgctcctgatttttgaggtcctttataattcatattacttctaagtgggtgtcttgcctatcatctttattttttaccttgtttatgcttatgaagtgtttttattagtgacaggtttgttgtcaaagccctgggttatttggttatagtctgctactgttctagtgatggcaggactagtaataacctccctggtctgtcttcacaattgggaaagaacaatcttcttatttacattccagagtggccagattgtaattttggaacagcccaggaaagatccatctcacataagattcctatgtaatcattcaacactctttgcacatctactttgtgttctagctcctgtctaggttcattgcagtgaagtcttgtattggaacatgttgaaaactgggctgagcattggttgagcccagaaagtgatctagaaattttggctttgaaaaaaatatattgttaacttaagcgaggacctactgctttgtcttttaaaaaattgagaaatttcgttctttgaaagtatccattcacttttctctacatggaaataatgaataatggtctctatgggcaaacacatttgagaaatgtagctcaccttgtctatcaaagcacagtgggtggtattgggggtgcgctatccctgagtagcccagcatcagcccaggcccatccataataggcctgtgactctcatgtagcagtctcaattctgtgttgttgaacacacaacttaggtgttgccttatgtgctgtaaatgaagccagagctgttcttattgccatagtggtttctgatttcgagatctgtttttgcttgcaggagctgctaagccgcacatctcttgagacccagaagctcgatctgatgactgaagtgtctgagctgaagctcaagctggttggcatggagaaggagcagagagagcaggaggagaagcagagaaaagcagaggtaagggtgagtgtgtactgtcctaagctcagacctgggaaggctgtcataatgtgaatttaggccatctggtcaactcccagcctggaagctattgggtgccagaaatatctatacactagagatgcagtgatctgttaataccaagttatcaggttttgctgtggctgcaaatttcagcaatatccaaaccagccagttttggctctaaggctttatctgccctcaaactgctgacaaggatggaaagagaagcaatagttggggaagaataagacaaaatgtggagggacacaagatgtcttctgtgagaaccaaggaaatgacgacgtaccggaatgaagtcagcctcccaataggccattgacactggatccaaggagtctggaaacgtttcttgacgtgcgtttcactgacccagatggaacctcgggtgatgtgtttctcttttcctgatgggtcttatggagcatgccatgtgcaggccttctcttagagaatgttttcctaattttgtttttcagtctttgtatgccattggctggaacatgccagactcttttttaaataaatgtttagagaattttacactcagagctcctttgagagcaggcagcctgttttaaccttagataaccgtcttcctgtgcctctacctttaagttcttcttatattcacacctagcaatgagagatatgaaagaagataggttttaggtttagaaacacctcgctcatttactgacctaactgcttaatagttctatgaacttcaagctggctacttaatctttctgaacttcaatttctttatctggttaaaatggataactgtgtggtaaagtccaaataaaatcgtgaaagttaagtacctgtcatagtatttggcattttgtgagcacctggtatgtcttcatctccttccttcatttaggctaaagatggatattgttcccttctgataagtgccagcattagtgcatactgacatctgccatgtttgctgagtaaacacactggtgattagaatatttctaatgtgtgagcatgttccttgcattgcttttgagaacatgttcattaattagaagtacagttgccaaaagaagatatccccaataagctgagaacagtagcttgtattgactaagagtccaggctgatgaatcagatctcctggctttaaactgagctcagtggctttgtgaccttggtcacgtaatttaacttcccagacctgtttcttctgtaagatggaggtagtaatacttccaatttctttggttattctgaggagtgaatgagacaatgtatgtggaacccttagcatagtaatagttagcttttattgatcacttactgatagtattgttaagcatgttggaaatgaaaatgtagacatagatacattatttacatattgcaaagtttatacagcctgaaagctaatctgtgtgaagtgctagttgaattaaatgttgagggagaagtaactgaattttcttctggtttgaagtattttaccaatgtttcaacctgcacaattgtatgtgaacatacattaggactttgggggcagaattccataaactctgtgagaaggcttaaagtggcagacactcaactcaaagtcacttaagagaaaaagggaggagagagacctatgtcacataacttgaaaagtctagtgtttgaaagaatacaatatgactagatccgggtaatctcacagtgtcactagaaattagtctcagttgtatcacctggttctgctttagccttattctcaagaaggttctccccaggtggtgacagagatagccatcagtagctccggaatgatatcctgccagccaggcaacttctgcagtcaaagaggtgctttctcaaaggttccagcaaaagcctcaagattgcatctcattgggccactttgggtcatatacctggttctacaccagtcaccgcagggatctgtgcatgaggggtgggaggtgcgaatatgaaagtcagcccgtgtgtggaagtatacagagttagcaccaagctaggataatgcagtccctttacagggacatcagaaaggaaggagagctcccacttctgggacaagaagcactaatgcagtcattttactgtttgcttttttctttcttttctgaaggactatttttaaatctgaattttttgtttttgtttttcatcagtctgttcatacataaggcgacgtagaccctgagtgtctggcctcagtcctaccagataacagcccttcccagttgctagtacaaatattaggtttccacgtggaggaattctgtaggctgttcaaacctgtgataatcagtgagcagccacatggcctgaaacaaattcctcgttcttgtaattgcacataatctttgctggtatgcacagaacttctacctctatttgtgagtgtctggagcaaccaggggtttaaaaccacagggtactgcttaagctgcactattgtcatgtgcatggagatgtttattttgagtgagacattttgctaaggtcaccagaggttgtaattgcatgaataaagggaacgctgcttcccatactatactgctgctgttttttccagtgagtgtatttagcctaagggctcattgtgtgtggtttggaacaggcaggattcttttttttttccccctcaggtgtgagatagccagatctgaaatacagtttctcagcttagctcaggctttatcctcaaattctgttttatgttttaatgaaaagaagagaatgcttgtggcaagagcattgccaccacaatgtcactagaaattagtctcagttgtatcacttggttttagttctagttctaattttagttcacactgctccttctctgattctgatcatagcccaagccagcatcttgctgcttgttttaagttgtggaaatgattaccgacagtcattctgtaagacctagggacttgcaggcgcaggttccttgatggccagccttgctcaagagtgagtagtggcccagatgagatgtgggtgaatactaggtttcctgtttaccttttctcatcagccttttgcaatgattcagggtcatatgagggtactgaagattgggtgaattagacgtattcctgaaaagtaggactacagaagagtgattgacgtggaaagtaaataccaaaatcaagaggatgaagcatgaaagaaagagatccagaggtaaaggaaaacctctgtgtggacacagatcaaagcattgcaaaggcgtgttgctcagatgggccttccccaagaaagaaatctggcttctccatgctgtggaggtgccagcaacctgcagttggaccccactgtggcaactagagggttctgtgaatagctatcagagcagcctgttaagaagggagcagggaccccagatatgctaggaaggggagtcagcccaactgatcaggggtacacgtgagcaagaagagaacagggaagaatctttaggatttcctgcagaaaatggaaacatctcacagcacaagtgatgatgccatcatttcttcttccttgtggttaggaccctgggagaaagggattctgatttctgaactgaggcaacagagtgatggacttggaacacagagtgagatctgggaagattgtgtttgctcagagatgagctggcctaataggagagtttttttattcttgtttttattttctttatttactcatttgcatcagtgtaggaaatatactcccacaattcaaaaatcaagtgttcaaaagggtatatagcaaaaggtctctttcaacacctgtcctccagtcagcagtcaggaagcagtgccatcagtttgtatccgtccagagttatattatgtgtggacaagtacattcatgtggatacacacagacacacacactttccctcatttttatacaaatgtacactattctagacctttctttttaaatttagcagtcttggagttctttttacaccaagtatgttttttaaaacttcctcattcatatctatgtctgcatattgttctaccatccaacaatagcctaatttatttaatcagtcgtctctcagtggacatttaggtggtttccaagtttctgctattacaaataatgctgtagtgaataatcttgtatatatgtaaagatattgatgtggaatttatgggtcaaggagtacatgaacttgaaattttgacagatatttccaaattgccctctctagaacatagaggttatattcccatgagcaatgtaatgtatataaactgagcctgaaaaaagaaagaactaagtaaaattgtgtacaagattaacaggtaagatggaattggaaacaactgtgattatgggaggtgcccagtagtttcacatagaaaagaaccataaagaagaactttaatggttggcaaagtgtgattaaaaaacaaagtgagctgaggttaaaacacaggacagcaattataacctcataaatgccacctagacatcatgatgtggaacccagaatggaacagagctacaaaagggtctgctttatgggagggaaacagacctgttaggaggtgggccagccctggagataaagaattatgaagctaggccaggtgtggtggctcatgcctgtaatcccagtactttgggaggctgaggagactggatcacttgaggtcaggagtttgaggtcagcctggccaacatagtgaaaccccatctctactaaaacatacaaaaattagccaggcatggtggtacacacttgtagtccagctacttgggagactgagacatgagaattgcttgaacctgggaggtggaggttgcagtgagccgagatcgtgccactgcactccagcctgggagacagagtgagactccgtctcaaaaaaaaaaaaaaaaaagaattataaagctaagttgaaatgccaagcctgtggacagacataccagaaaacaatgacaacacatggctcaggagaattaaggcagagtagcccagaagttttgggtacaccacacactgagcagagggatgaaaatagatgtgttcctgatgcaggtctccaaactgactgatgcacacaaggggcagtaatggagggaggggagtagcaacctatttgttagctcctaaatatctcccagctgaattctgaagcatttgaatgtttacttgtttgtttttctcacttgctttcactctactcagagggtagaagacaaaactaggaaaactgcctttctagctccaacattgaagcaaaaggagaaactggtttatgaagtaaaagtgataggtaccttgagagaaagtggtcattgttatttgaatgttcacgagagtgagcatggaaaaactaggcataaacagacatgcactgtagacttgggtaaatcataactctgacaatttaaaaataaaatggatggggaactgtcgaatagaggaagacccaagaatattgaactacttaaatataattctgactgtgcaatctcacagataataccaataaaaaggaagagtttagaggtctcttgaaaggaagtagttttcagaggggcttctacaaaaggcagaaaggacatatgctaaagacaaaagtgcacctgcatgaccagtgtcaggaaggggacatccgaaactaaaggacaatgctgaggacaacacaaagccatacacacacatacacacgcacacacaaacacccacacacagttatgttcttaaaaagaaaaaatggacttgattccatggatgcctctgacagatacaaaaaatttaggacaatagtcccccaaagtgcttgctataagttaattttaaggaatcaggaaaatcaaatgagttgctagaaaactggaaatgaaccatttccttcttgattttcaaaatggcaaaagtttgatagattcagtaaattttagtctgttgagtttggggccaactctatgatggtttgcaagaagggaggagacaaagtagggatccgtgtcctcaaggagtgagtctcgtcagattggccttatcggtttggccgggaatgtgtcgtgtggtagaccaggtaaatccacatttcagtgaagtgttgcaaaaacgttgcttgagataatcttgtagacaggatggaggaatagaagatgaatatactgaaataggcatattgatgcctgagttcagggtttgggtacatattgtcatggataagtgtgatgtgtgccatatgtcccctgtgcataggtgctgacacgttgggtgtttgggtaaggggagtcggtgtgtgtatcatgcatatgtggagagaggacgtgtttgtgtgtgtgccccagtgtgcacccatctctgctattgcttctgcttggatgaagagtttcttctagactccatgcctcggtgttgacacaacaatatggcacaaaggagctgttggggatttgttcgaactgcaagacaggcatctggatggggcaggcctgaggaaaaatgccatgtcttttggttctgttgtggaaagtggagggccgtcgacagtgaccactgagtgccacctgctccctgccccatgcacacttcctctgtgctgttctcttaaggagttctgcgtctgagagctgtctgacctggagtgcttttctcttctttcttttccttcctacagtcggttctgaatgtgatcagtgagctgcaggagcagatgtgtaggctgcagctggacatccacaggcagattcaagagcgcctgttactcagtagggaccaccctgaggaggtggcggccagcgacggtgtggccgagccccagccctgcagccaggactgtgcctgttgggaggggtcacctgtaggaaccacacttaagtatatcagagcatgcgtgtgtggggcatttcactggtggaggggctggggtttctcctaaccagaacagagtgcagtggcttggcatggatctgttgttacctctgggcagagcttggactcactcaatcctcttgggatgtgaggtgagctcagtgaccctcactgagcagggtctgagcaggtgaggccaaccctcaaacaggtggcactcatctcctttagggctgggaatgaggtgcaccaggtgctccgagtgatggggcatttgtgccacaggaagcctcatgattccccttctcaggtatgtgactcagatactgattcctcttcccaggctgggagattaaacaaacttttgtttcacatgattttttttttaaggaaaagaagtattatgaaaaagaatcctttcaagtttatgttcaaagaggtttacccccagtgaaaaaataaaatacaagttttcatatgctgtgaataattaagtcatcatctgaatttccaggaaaaatcccccccacataatcacatcagggtgattttataacaacagggccatgtggggctctatctgactgggattctggacttggctctccacacgggggtaacctggtcctctgtgactttgctgatggcaggtgatggcagcttcagcagagataaccctatgcctcgaaggaggcctcctgttgaagaggacttggaagccccccaagaaaagaccgaggtcacagcagccatgagtactacagaggataccctggctctgtaggaagttactatggtccatactcaattagggagcctgttgaaaatctagacataggtgttgcgggaagggatttggttggaaagatttcctgctgcattaaaggacagcggggaaataggaaagtcaagatgtaaatgtagacttggatagagaagccttgagagggtgttggcgcatgacctatgttgagtaggttactccagcaagacttttaaaggaaggaaaaacgtgtgtgtactaatgttggtagtcaatgatggacaacaagtaacatagaaggaagaggatgttccagaggtcacggagcctggagaggatgatttctgtatacccacagtggcagcccctcaggcagtaggaacctgtacacttctgattctgatatcagctggcctgacaccctctccaacaaactgagtaacctggctaggatacaaggctgagcagaagaaccctcaacttgtgggcattggagcctctcaggcagggccaataatgtcctcagagaatgattctgggtctgctgcaagtcaaagcaggtatctgaggccttgacatccagtgatgcagatcatggatgcaataaccttagctgagaagttttctttttcttttttttttagctgggattacaggcacttgccaccacgcccggctaacttttgtatttttagtagagatagggtttcaccatgttagccaggctggtttcgaactcctcatctcaagtgatccacccacctcggcttcccaaagtgctgggattacaggcgtgagccaccatgccatccagaagtttttttttttttttttttgtcttgtttttaacgggcatcagcatatgctcacctcaactagaaggcaatcttaaaaaatgaccctacaaaattcaagggtaagcaatgtcaactttgtggtggattatctcagaaggccaagacctccaggccagttaaataatgacttaagtttcatgtgtgcattcattgacaaatagtatacacctactatgtgccaggcactgcaggataatcagaggttagcaaatacctcatggagtttacagtttagtaggagagctagctattagctgtcatacaaataaatatttaattgcaaattatgtaggaggtacacagagtacaacaagagaatatagcagaggggcctgatatagtagggaggtcaggatagctttactcagggagacctgaaggatgggcaggagttaacctggcagaaaattccagacagagggaatgttgtctgcgaagacctaagttggagagaggaactgaaaattatccatgtggctagagcataactagggagaaagagtgatccaagaggcaggcagggagctgtcaggtcacgggttgaagtttatgagctttgagaagcatgggagtgccatgatctgatgtatggtttgatcatatcactcccccagatgccatggggtcagttgctttgagaggagcaagacaacagaggagcaaccaatgaattgactgtccaggctgtcagtgctaattgctagaccagagtggtggtgcctgagtgggaaagaaatgagacattcaagttgttttcctggaagtagaattaataaagcttggggacgaattgcatacatagaggaggaaggacagggagatgcagaggatagatcctatgtttctggataggccgttagatagatggatatggcatttagtgagatgagagtaactaggaggggagttgagcattccacttggcacctgacagtccggaggtgcctatgcagcatccatgtgatgttaagtaggaagtttgttgtgtgagactgcagttcagaaagcctatggaagtaattatctttatgccagttcttctgatgggagctagtcagcaggaccaattgtctgttaaggaaatcttggttcaagataacagtgcttagtggagtcatctttatagaaggagtagtttcacaaacaagggtcctagagtcagaatatatgggcttgaattccagctccaccacttactagctaaatgagtaagagaaaattgtttgtgtcacttccccactcagcaaccttcagtgactccctactgcccaaagaatggcatcggaactcatcatgtgtattctcatcctcaagcctttaccttagggcctcaccttaacttcccagcctcatcttccactgtgtgcctacaccctcagctctagccgcatgagttatctccctttctgtctcctatctttactcctccctggatgccttctccctcccttctttcttcaaatcaatctcttcctctgaactggaacacccattttggcatctatatttggcccttaacatttgttcccttagggttcctctatgaggcctttcaggatcacaggccccctcttctatcttccttcactcccagcacagagagatgctcccaattagcctgctttctactactttgcatcacagggaagaagctgcctcatttcagcatctctattcttcccactccgaagcctcgcctgcctgcctatactcatgtgtgtgatgttggcataccccacagaggacatagatgtcagagaaaggggcaggcagaacaggttctaaaactaaaaggaaagttttcactttcttatgtctggaactccctggcctttgttttttaacggccatacagctttcctgaaacaagggacgtgtttaaagattaaagctgttatgtggagcttgatgtggttgctgcaccccatatgcatgagcttaaccaggttggtaaatcaagagcacatcttttaaccatcagaactttgtctttctccctcatcccctaggagttactgcaagagctcaggcacctcaaaatcaaagtggaagagttggaaaatgaaaggaatcagtatgaatggaagctaaaggccactaaggtaaacggcactcctgatgcttatggagagagtatgagggccttgtggggagggtctgcattccaacttgggggtttccagtagcctaagtttgaaaatgcaaatcaaccctccagtgtggacacacagcagtgcccagatggtgcagtagacagacttgatccaggaaagatcctcatggagaatgcccgtgagattatgaattggtcaattgtagtaacccagtctgcttcctctccctgcaccccatagcacctggctgaagctgggccaagaaggggctaggagtggggagagcaggtgagtggcaggcagtgaatcatgcgtcctaaagcagatcttggatgcatcattttaaattcagtagtcccttctagaatcagtttttcaaaaaaataggcatgctttatatttggcacaaaatatattcctaaaaatggcataaacttcgaattatttcttcaatcaaatcatgtttctcttaaactagggagcctgcaatttaaaggacaccaataataaattctattgtgaaataaatttcttccctgtcccctttgtttcttccttcttttcctatactaaagtgcagagatcaaaactagtgggttacattcagcccatgaatttttttggcctgcacattggattttaaaacgttaaattgttatttaaatttcaggaagtttacattaggctacagttaggtttcctttgggagtatggggaggtgggaggctcacacctgccttcccctactgtgtctgcagtgccacccaagggcattactggatgtttttattagagttttcttaacttctagtttgtatttttattttttgtgcaagttagttgctaattattataaaaacaataacacacactatagagaattttcaaaccataaaaaattaaaggaataaaaagcactcataccacccaggcactaccattgctaatatttccttccgtgtattattctcttctgttttaggtctgtgttaggccattcttgcattgctacaggtaaatagcttagactaggtaatttataaagaagaggtttaattggctcagggtactgcaggttttacaggaagcatggtggtcacatctgctcagcttctagtgaagcctcagggagttttcaatcatggcagaaggaaaaagcaggagcaagtgagagaaaggagaggaggtgccacaaacttttaaaccaccagatctcgtgagaactcactcacagttgcgaggacagcaccaagagggtggtgccaccattcatgagaaatctatccccatgatccattcacctcctaccagggcccacctccaatatcggggattacaattcaacatgagatttggcaggaacaaatattcaaacatcagggtctctctatctcagtgtctctgtctcttaatttttattgttgataatttacatgcaattttataacatgctgttacttaaaattttatgacttctcatgttatcaaaagaaagcactgaacatatataaatatttatgtaatctagtgtataaatataaaatcatttgattaaccattttacagataatgaaatggatgtacagagagattaactttcccaagattttacagctatttggtaccaagcctgggcagtcagacccatctgtgtcctggcctgtgtgtatctgagtgtagttttgtatgtgtatgcttcacaggcaccagctctaggggcactggttttgtccagtagctcagaaccttccatcacaacaccccactcaaacaagccctgtcttggggaaacctttgaagttgtacataccgccctctgtcataaaaccaaataacacttttctttttaacaccccagctctttgtcttggcatgtagacctttgagatgctaagggttatttaataactaccaggtgtggagcacttcctatgtgccagaatgtaccaagctatttgcacacattttatcatccataaaatcacccagtgaggtatatgtttttttattctcacttgactgggaaggaaacagaggctcagcgtggccaagctgaggttcacatctgggtctctgtcattcccgtgccttcatgctgtttccaacatcatcctgattccctgcagagaaaaccagcactgtttttggaagtttttcacttttctgcttcaggcctctcagtctctgaaggggattcatctcccagtgcaatggcagtagggcatggtccctgggtttaatgaggcacagcacttgcagggacccagagcatccgtctctgcccaactgcctgtctgcatagctatctcagaccttgtgccacacagccctagccatggtgactgtggccataggaacagtggcagtagcatacacagtcaagtagaaggtctctggactgttcttggccttcccaactgcggagacagagatcgctcaaaggataacagagcacctatagtttctggcctatttctgtggaaattggcacaaggcaggttgggcccagtcacttggtctgtagggtccatggtatatacctacaggacctcccatagaggcagggctcaggaaggagagccctcatagtgccacgtgctagattctctcttgatcggtccacattgctgaattcccaactgtggggccagcagacaagcatcaggtatccagatttctaacagagacgagtgcccatcctgtccacaaagaaagggagaaatgggcatggagaggtgcaagaaaagttaaaggaatatctttcaagaatcatctggcctttgtagaaatggaggttgagagtcccaaagctaatatcttcagaagccattgtcaccatgagtcataagcccatgggcatctttgccctgagtgagctctgataaactgctccatagctgcatgtctcagaaagtgggttacacagcaggacccagctcttggcctctgtgagtggagcccagagtggagggacagtgcttcattatgaactttggaataaggaaaccctaccccttgtcatctctttatatggtcatccctgtcccatttgggggatgttagggaaggttattcagaaacccttgcggtgggctgagggagcccaagcctggtaagagtggccttcatctgtcctgttaactcagaagcagacacacggtggtgggtggagccctgacattggagcaggcaggccagggtttgcatcctggcctggtcaccaagtagctctgtgactgacacagaatcttgtactactcccgttttctccctgatgacttacggagatattgtttcctcgggtggttgcttgtgaggatttgatgtaagaaagcagtgagcacgggggctgatcagggtgcgtgctcagtccatgcgctgaaactgaacacaaggcctgtccagcaacagagttgccaacagggccagtactcatttaattacttggggttggtcagatattaacttgggcctttgtggaattgaacagcccatactataaccttgaggaccaaagtgggacatgattgggccaacacatggggaaggggtggccagaggagaagcctttgctgtcttttattgaccggctccacggtcgatgctcatcccttttcttacctggtttgatgctgagagaattgaaccgattatccacaaagaaaagaataggatgagaggagcaaatagcagtagcatttattgagcacttagtatatactaaatattggactaggttgttgataaccattatcttaaacctaattgcagtcccatgaagtaggtgtagtttttcccattttatagatgagctgagactcagaaaggttaacttacttgctcaaggtcacccaactaggaaatgagagaatcaaggtttgtttgactccaaaatccaggtacctcttcggacaggacctatacaattctgatctcctgatgagtatgggaaagcatgaacaaccacacctagtgttgtgtgtggatttaacctgcactacttaatggcgacatgggaaccatctagtgcagctgcctgtttgtgtgcaaatatgaatgtatgtgtgtacttatgagctgtgtatacaatgtttttttttgcaaaagtatgtaaatgaagcactcctgaatgcttgtacatctgtatatgagtgagcgtgcacacatgcctggaggttgggcagaggcagtgactgtacccaaagggtaggagcgtgtggagggagggagcccttggcttaccttttcttcagcagtggtgatttggcttccgctgcattttctctgtgggttggaaagatgaaaactgcatgcacttgttatagtggtgtctctaaatgttactgtatgagtgagtatcttgggagaagaaagaccatgtccagaatatcctcctctgcaccaaggacagccctcccattgcacacaatcccagctcctcatcacaatcctaatcctcacagtgcaggggagagaaactggtcaggtaggaagatgcaggggaagaagcacattgatggccagagccgtggggagggccaggatggcctagaagagtgagttcactcagcagagttccacctgtggagagggcagtgagcccctgctcctgctcacctcttctcctaactcctgatgcaccctggtgcctgatggggtctggactctgacgggaggcacttcatcatgatttggcagtccttctgacctggtagggatcctctgttgctcttccaggctgaagtcgcccagctgcaagaacaggtggccctgaaagatgcagaaattgagcgtctgcacagccagctctcccggacagcagctctccacagtgagagtcacacagagagaggtgactagcttgactctgacaaaatgcagttgtctgggtccctgggtctactcttataagtgagcatgtgtttctataaatgagtgtgcatatgtgcttgtgtgtgtagccatgctaatggacatgcatgtatgtgtgcaagcgtggccaagtgaatggatgcaccagtttgtgtgtttgtgtgtgtccctataatgcagcgctcttgtggaatcattcccatggaaccctcccctaactagaaggtttttctcagatgcacagaagttctgtgcagccacctctggagcttttactgaaaatgtaggaaatacctaactctttcatttgactgaaaggccttacttttgtgtcatcaccaaaggggaggctttagaaatttactcagtcatttcatggatacctgcctgatgcctgtataaggccctgagactacagaaacaagtcagttctttttcattcttgagatttcaaatcttacttctcagaaagacctttcttggccaccctaactcaaataggtgctcccagtcctattattctctaattcatcatccttcctttttcctgcctagcacttattataacttaccagtgttgtgtgttatccccactcaggggtaaggactatatttttcttgtttaagagcatatctacaaagcccagcacaatatttggcccattgtaggatcctaagaaatacttcttgaataagtgaaaggatggtgaatggtccctgaggagttcaagtcttgctgatcaaaaatagaggataaatcctcaactactgtaatgaacacataaatctttatggctgtttgccatgtatacaaagtgatcatacacctttcaacttgtccactgactaccaggctgcagagcaatgccgaagatcatatagtcctacggattggtgccactacctagtcacatcctggcctcagcactgcaagcttagcttggatccccagctggggtgtggaagccatgcaacaatggcttaggctggagaaggaaattagtgatcaatgtgctcgtccctctccgagcttttctcagtgtccgcccaagccactgggtgtgttgcctacctgccaaggcctgcttgtagaggctgggttctactaagacaccctggactatctctgatgctaagcctggacagagagtgccccatgccacaacttctaggccaggcagccttcccagtctacccctcctcttcccacagtctaagcctcccaggccctaccccactccattactgggtactttctagagctggtccttgggtcatttgctgccgaaggtaggttctgaccagtggatcagggttggcagtcttcatctagagcttactgccctccccagcaaagtgagctgcagagctgatgttagctacctagagcctaaataatgagcaagcaattctccactttattctgaaaatgaatctccacaactatttacacaaagtccatagatctactgttgctattcttgttagatacaacaagcatcccaaaagaaaatgggaggcctatatatttgttcccttgtacttttttttttttatatagacatccctattcccatttaggaagaggcatagatccttctttgaacaatctagctatgtgccaattcctagagtatctggcaaatgacctccagcttccttaggctcttcaaaacagttaaggaatcaacagagtccctcttgggtccaaactgagagaaggccttggattttccaccacagaccaacagagatttctcagcccatagggaaattctggtttatgatgaaataagattgtttatcctcaacccagcatttgcatatatgtatatatcccaatacatctaaacatttgttagtcaattttgactatatcattttaaattaagccaagtaccaactcttttacataatttttatttcccagtcttcactcaactgtagatttttttaaatgttaaattctcctcttcctacaatttgtcagactgtatgattttcttcaaagccagtcagaagcccaggtgcatgcctactcaagttgtaaaggataaaaatgtctatattcttaggagatgttggttttgaaagatttttggcttcctctgtcctctcgagtacatgggcattttgattttgcccataaatgtctataaagagaagacagagtactagcttccttcatttagtagtctagcaaatatttaaggaggccgattctgtagcagacaccatcccggcctctttaaagaactaaaggagccatgttcacatggcaagtcttcatttgaacttgggggacatcatagcaagtgcggatagctgtctgtatttatataaataattatttctatacctgaattcttttagaccaagaaattcaacgtctgaaaatggggatggaaactttgctgcttgccaatgaagataaggtaagatggtcattgggtagccctgtcttttccatgcttacatccctggctgtgtttggtccctgctggtctctgatattctggacaggaccatgcttatcatgccattgacatagggatatgtcaggagaatgacttgtgccttctagagacttggcctcagccacctgtttttggctttgataactggaaagtttgtctaaatggaatctcctaaaggcagattatagccctgcctgttcctgctggtgtggggggaaaaaaatactgctgtgatcactgccaatatcatagctcctgctggaactcctagcacaacagcccaccagtctcccatgtgcatgacctgacaatagaaccatcatagagacacttggcagtatgcagtgcctcagtttaccctgccatcttatatccttcgcatctaatttcggcacagtcataaatagccacctctataaataaagagtgcctggctggtataaacatcatctctgaggatcacaaccctgcattttacagatgaggaaacagactcagagtgcttaagtaatttggcccaaggtcaggtaactagtaaatagcacagccagctttcacacccaagtttgtctatgacctgtgtggtctcccaagttcctttcaaggcctttgccttgaaagaaacgatcttctctgggaatttcctctgtagtatgaggtatctcagactcctagggaacaaatgagtatattgagataaatatgacagctttattttagtctttttttgtgtcgctccagagggcaacactaggaccagaaggcagatttcaatggccacttcaggaaggtagggagacagtgagtttcgtgcttctgaaaatgtttaagccctgtgaagggtgtctcagatgactcacagtcttcaggtagagcgtgaatgcctgcagatgcctatgaggcagaccactgaaatcccagctctgtggaatggggcctggacactcttttcctttggttccacgtgggatttcttctccttgtgccaagaacatagcgtgggttccaaaatgaaatcatctgagatgccagcatagcattaatctaaatctctacttgcactatggcaggaccgtcggatagaggagcttacggggctgttaaaccagtaccggaaggtaaaggagattgtgatggtcactcaaggtaagagcaagggcgatcctaccgttgtctctgaaagatattccatcagctgtgttaaagccaggggcagttctgctagcagctgtttcacctctgtttcagagaagactccctactggagaacagagctgtttagacttttctgcatgatgagaacttagcagttgttgatttccagaaatactaccaaatggaagtcagcttagggccttcagggactatccagatcaccaagaatataaagcttgtgaattccccacccttggaaggtctcttatgcatcttcccaggacacgccttagaggcagcaagtgcagttaaacctggatcaaaaatcaactcagtgccatcattggggattagagctcatccacctcctagaaaatctaaagttccgcagcagactcagagggccctctgggagccttcctcgagttgctgggcctgagttgctataggaagtcacaggacagagagagctgctgtgttttatatttgctgcccagactgaatgcaacatgcaagcagcatcagggttcttatgggcatagtggtgcatgtgccgggctgccttcattgttcatgccattgacctgggctcccatcatagatcctgaggaagcagctgtttcacagcacagggctgctttgaaggatattcaggaacctctgattctggctgagcttctgctgcttcttgggaagaagccaagcctctgccaggatgtgactgactggtcactggccagggcctctgccagccctcacacacagccctcttttttttctctttttgagatggagtgttactctgtcacccaggttggagtgcagtggcacaatctcagctcaccgtaacctctgcctcccaagtttaagcaattcttgtgcctcagcctcctgagtagccgggattacaggcactggccactatacctggctaatttttgtatttttagtggagatggggtttcaacatgttgaccaggctagactcgaactcctgaccttaagtgatccgcctgcctcagcctcccaaagtgctgagattacaggcgtgagccaaagcacctggcctcacagccatctttttaagatcatgggtcaagtcactctcagggccttgattgcctatagctaaggagtgagaggtttggaggcaggggtacattacctctgttctgcagataaactttgaccttgaaatgatcctgatgccagcccttgctcagatgccctgaagaatcttcagaatcacactcttactgtccctttatatatttcttagtccttcttaatgaaggagaaacaatgttagaattttgtggtacgattataggtttctgaacatgaattcaacaattcagtcttactaccttaatgcttgcagggccttcggagagaactctctcaatcaatgaagaagaaccggagggaggtttcagcaagtggaacgctacaaataaggaccctgaagaattatttaaacaagaggtactgtgtttccatccatgacgtagggtttcagcaggtcctccgagcttgccctgagcttgagggaggatctagtcagacacgtgtcaggtgcacatcttggcaggtgaatacttaaattaatatagtgcccctcaggctgtgatggggatgggcgagcaagaggctgaggctctggcctgtgctctggttggaggcagcatggtggatactggaactttcaaggataggagttctcctttttaatcaggctcctagtttatttttatcttttttttctctggaatgtaagcatagaccaaaggtgatgtttgatttatctaccaccctttctccaaggtctgcagtaatgcccgatacccagtagaattcaacaaatatttgttgaatgaacgaacatgtcttgctcatttagaggaattaactgcaacctctgaaatgccgcattcctgcttgacagatacgcccttcagcccctatagccaggacacagattttccttctcatctatttcgtttgtttaaaatctggtcctattgtatgaatctctctagacttaagctagatacaaataaacaaataaacaagacctcaggtgaaggaggggcttcagcctagggtccaaaagattcctgaaaacgtcacactatcaaattgaaaagaatcttagtgcttcagttcaacctttttaattaaggagcaaaagcatcatccagtgagccagttattgactcagaacaagcaccccagattgctggcaattacagaatagcggtgtccaagtcttaccaagtcttactggatacctccacgtggtcactgtgatgaacattgtatctggcagaatatggacttgaacccaggtctgaccacaatgcccaggtatttaaaactatactataatgccagcgttgttgttatagtagaccaagaggatgctaggatctagagaaaagaggcagtactggagacatgggactgtcttctttcataacctccattagctcaaggtggctccgcctgtgatgctaggtgcactgctgaaggcacagtgttgtggtaggtacaatactgaagacacgggactgtattatttcataccatcattagctcatggtctttccccctgtaatgttctttcctttcttgccttaaccagttctcatttctcaaaattcagctcagcttttctcctctctaaagctttctcagccttccctctggtgagagggagcccctctctcccactgttcccatattgtgttacaggtgttggagccataagagcattgcacattattctgttatcctagtgtacttgtctgtctcccagatgtggggagtgcttgctccagacctggcacagggcctggcagggagtagatgttgctgatgtttgtcgggtgaccatatcaaatgggattttctcattgaaagcaacaaaatttggctctggctaacctaagccaaaaagaatgtttttaaaagagtctgcagtggctcgctgaatgaaaggaaaagctgaagaaccaagatcagaaagggaaggagcagaaaaagcccaagaacccaggtctcaggactgtactactgggatatgaacatgatctaagctctagggtccaggaaggagaggcaagctggcccagatggactgataagcctaccacacccccttgcatcttgaaagagcaaggcatctataatgatgtatccaccatggctgcacccagggaggaaatgtctccctaaaaggaatcatgtgaagcagggggaaagatggtgggtggtccccaaacagactgtcctctaccgtgactcttctgtctctggtgcagatgcctccaagatgtagctctcctacagtggggccacctccattgccacagaaatcactggaaaccaggtaagaggcctgggcatttccccacagccactgtgctctcaggcttgccttggggctgccgaagtagatggtgatgaccgtgaatggtgagcatggccactgagtcctaggtgcacctgcccctctgttgttagggcagttacaaaccaggcctacctcttttggccacagaagggcttctcatccttcaggctgagggtgtggatcattgtcactgagaaaggatctggccaaggattagagcctcagaggagaggtggctgcaactcatctgtgtcttatagcagctcctcagagctgagagcatcccgtgatgtgtgttccttttgtcagcctctgcctcctgctcttagagtgaatttagccctttgacagtcgaagctttctagggaaggccatgtcttctcatagcaattggtctaattgctttaaggatgcttcacaacaatgaactaataatgggctcgcctctgaggtcatttgactgccatctgtcttgttccctctaaaataaacctaaatctagttccctatgtccgtacttcagcacacattttgaaattgagccccatgtaagggagacatggaggcttcactaccaaggtactggcaaccactaccaggctgcctttcagctaaggtgttggggcagatgaccacaagcatcacagaaactccccagaatggtgctgagtctccagagcctgcactctgagtccactttccagaaagcagttgttcccttgagcctttagcccagaggaaaatggtaatgttagagaagttgatcaggcagtccttagttttggagaataagaattgtggtttatgagttcactgagggaaaggtcaacaccaaggaactcggactgaccagatttacaagagactaatattttttaaaatgatgacttactcgtataatctgagaaatatgactgccaaggagacttggcacaggttacccttgtgaccactggtggcattgcctcttgacacatttggtgcctttctctgcaaaatagaccctgagagagccagatgagtctgagcagactagatgggcatgcagatccagagcagagtgtggcagggtcctagcaagtgatgttctggagccatggctggttaatgtgttcatctctactctaaggaggcccaggtccctcctccctggattactcttagactcagacaagcccagcatcagcacctttcccctcttttgacactgtagaccttggccttttatgaccgcacaattgtcacctcagtgcagcagaattgagtgtattctggctttttgtgcaatgccaagaacatttcatttggatttaagtgaccctgtcatgcccttactaacacattattggaccagtctgtcccccaaggtgggccagtctcattttgtatgtaaaggctattatgagagggtatttttttttcttgactttgaacctaagcccaagaccatcggttaagcatttgaaatgtcctctgcatgagtgataacatgtacctccttctcataactatttctttcttttgtgtttttttcagggctcagaaaaagctctcttgtagtctagaagacttgagaagtgaatctgtggataaggtcggctcatcaacctatccttaaagatgactgagttacttttttgggcctagcatagtactgggatatacaggcaggtcctggtccctaccttgtagaggattttataaagttgtagaggaagcaggaattacatgaacattttgagaaaattaactgggtgtggcccaaagcatcttagaggaaggacaattcaggaaatgttgcctggagttgatgagagaagatgttgagatcagcaaagcttggttagagtctgctgagcaatagcaggttttggaagatggtggagagtaggaggaggtaaggtcagagccatgagacagatcaagccagggaagatcttgactactagtcctatatccctggggcacttggggacatcgtatagatttttttaatgatgaattaatgtgaataaaggagatgatcccaaggaaagatgtgggatcgtcaggatgttggagagtgagctgttgtaagagtctggaaagatggaggagggtcttgtggctccttatataggagtagcccttgatcatgtgggtggacctcatgctgcaggggacagtagcaggctcttgagcttggtcattagagaccaagggagcctgccctgatagagacccttcagtgagcctgtgctgcataccatcccttggtctccaataatgttcatcagcctccttgttgatacagtggagaaccataaaggctgaagtctgcaggagccctgggatcattcagtggctctgctcccatggtcacgtgtctctcggttgccatggtcatgttgctggcagctgcccaggacatctgtccatggagttggacagggatctttcctgccctggatggtgattacttgacatgaagatgtggagggaggggatgcgcctttcagatttaagcaaacaggtagtcctgagttgttgctgtttgtgaataacacaagtctctttttctccacataaacgaaatcctcatgttactccatagtgtatggatgggaaccagcccttcccggtgttagaacccaaggtacattgacttcgtgccccgtcgtctatttgtggttacactgtttgctagtattttaatttagcaagtcatagttttcataaccttaaaatgtgccaactgtaaggagtaagagggcaagaggaaagacgcaacttttctctcccattttatttttatgtgcactcagctatttaatatgcttttgctatcattatctgtgggacaggatttattattatcacctccattttataggctcagagaaattaatctttaacaaagtaatctagatttaatcactgggaaggggattgctacgatctcagcacactgaagaacgtgacagctctcatcctttctgtgctgatatgtcatggttaaaaaaacacaagtgtacactcagtcccgctttgatgaacaagttatgttataaaaattccattaggactgatcttctccagggaagcctgttgtggaagaggattaagtttttaggccagtgcacaaaatgttgagcccataaagaaatgaagattcatataattagcatgatttcagccacacccaaccaccatttataacattatatggaaaatgtattgtgaggctgatggcatttcccttctctgtcccctgcctccatgtccatatgaaacatggagcttctcattgcttgctgacttctgcctgagagggtcattttatattttcacggtaaaatggggcatctctgctcctccacatctgcgtaagagaaagatcttttctgcacgtctgcatctatataaggggcttctctactcttccatatttgtagcagttggttcttcaagtgggcagccattccttgggccatctgaactgtatagcaaaagtcttctgcctgctcccctgcccaggtgctctgcaacacagtcccttgagcctggggttggtgtggtccctttgtgaactgaaaggcttcctatggcgtcagctgttaaatcgctcagcagtcccccctcccacctcagcgtcacagaggtcattcgcaggtgtttctaaagcacacctgtaagtgaccacctgctcctttggaaacacacccagctcacaggctcaaggtttaagacgccaatttgattaccaagaaatataagtaacgtagaactatttataaagaaaaaaatgctccagattaaaagattaattcttacatggttttggccataatcacaatcttatacaacctcagttattcaacatgaccaccctcccctctcacccacatacaccaccgtcctccccagaatagctacacaggtgcagaaccgctccacagtcatctttctgcagcatccctaactgtagtgtctggcccttgcttaaactggctcttgctttctgtgactgagagctcatttcattggaagacatcctttgtattcttttgcagctgtgtgagcttctctaaaatgtgcatctgctgatcctctccctccacatctagcccatggaaaaagtcaatctcccctactcctgacagctctggaatttaagtccctcatgccctctctgagtgctctgttctctgggctgaacatcaccttctcatgtgcatggatcacaagccttttaagctgctacttagtcttcttaggctcagcgctagtttctcaatgtattcttcaagttctgccctggaccagacttggagtgtgatattctagatgtagtctgaccagtgcctgccgtggtctaaggactcctcttctagattgctatttctttaggccctgggtatgtgatatttcctgtgcttctccttatccactgtccgctgtgtgctaggccctgtggatatgttatttcctggcaaacctgaggtaggaattgttattctccatttagaaatgaccagaggtcctgagaggtggaagagaaacagctctgtctgagttggtctgactcaaagcctaggccctttccactctggcatgctgcttctctgttgtaatttaaagcagctggataatcagttctacactactcccttggctggggcttctgttcccctacagccaggaggattgttctttttggagacaggagaaacagaactggagttgagcatccttgtttcctctgcgtcacgtcttgacattgcactgccttccacatcagtgagtcatttcttcccagcccttattcttggcctgagcagagctcagagagccctttccattgtccttgattcctttttgctgtctttcttacaggtcggggctgccttttaaaccccatccttgggttaggtatgtgttctccttgcatctcagctcctcagggagctccccgggtggcccacttgcttccttggctgtctctgccctgccttgagggagcatgcgtgatgatgcaaccagaaacacgtttttgagagctcttcccccctccatatgtcgtatataatagggagcttggagtcatgcccttcaggtctctaacatctttgaacactaccttctcacagtcagtggttcctgggtctgactgcattagtataatctgagataatctgagatccttgttaaaaatatagacatctggggtgtgcttccagagggactgaatcagggactgggcactgggaattcatgttgttttacaagtgctccaggtaattatgaagagcagccggcacatgaactaccacttggaaactgtgggtcttgaccgtatgtctgatcatgtctaatcttcacctcatgggtcatcacaaacttgaaaatctcatagccttcctctctgaaggttctagttacttctactccaccagccagttctttcagaattcagtttcctctcactgtatctctcctttctgaactatttatggggagttaatagtcaatgttcaatgaatgaactgaatctcaaacaatttctaggacatatgtttataagcaaattgaattggaaatatattggatatttggcctttagctaaatggaacttcataagatgtctcagtcacagcagccttccattactgttgtgacttgccagtttgaaatctgttttgttttttatattactttcttcaggatctaatcaggtgatccacagttgattcctttagtgacattgcttcaatttctcttttcttttattctcactttcacagcacattccactgtgtttctctcaggtttgcagattaagagaggccattgtatgcctctttaccaaataagtgctatcttcttcctcatttaatcaacttgtttctttgggacctttccatggccagggtccaagcatggagctggctgcactgaggctctacctcgtgcagactatgatcctaagttcccaaaggagctttgttggcatgtagtcctctggcccatttcttgttgtcagctcccccaagggtgtgtgtgtatcttcatgcttgccttaacatgatgttttttaagaagccatgatcacaatatagggattttttcttcttttgctccacatttaaactataatttcccttctgtaccatagccgctctcaggcaagatccatatcatttatgcagttggtcaggccctcacagagatctgcccttttctggtctgagtaagggttccaattagcagaagcacctctctcctcaccacaggaaagcaaatctgggggaaacagaggagcccagaccagactgagctcagtttcctctcttgcaggattgttattttacatatatatgtatgtatgtatgataaaacactaggcagcttttattagaatgccaattttcatatccaaagagcttacagagtaattcacggctgttaattcattgagtctctgagcactaggccagacagcaaaggccgctttgcaagacagcttcacttcctgttagagtcagtttcagtcagccccagatttgcacttgactctgtccctgtcttactgtgtggccttgggaaagtttcttccttccttggaactctggtcccctttctcggactagctaaataatctttgaggggtgttcaagtcaccatatgtgaaaaatggctcttgcaaaacagggagttgttctgtatccaaggatttcctaactgaggctgacagttaagtcggtatctctctctttctctcaccttccaataggacagccctttcttggcggagcacaaatatcccactttacctgggaagctttcaggagccacgcccaatggagaggctgccaaatctcctcccaccatctgccagcctgacgccacggggagcagcctgctgaggctgagtgagtgtccagccctggtgctggtggcctctgagcagtgtccttggcactttcaatgattgtataagatccctgcacctaccaccacaatccacaattggagaatggtggggtgggtggctggaacaagttgtaccttggggtggtcccacctccccagaggctccccctgggcgagctgttttctaaggtcagcactctacagtctcagcaaaccagggtgtgtgtatcccctacttcttttcggctgcagcttttcacccttatttcctctcttcttctcttcctcctctcgaactctttcctgtccttcctagcattgttttccctcctctcagacacccccttctacccttcctgcccctggtgcttccttcctctgtcattctgatcttctctctcctgtctccaccttcttctctgcagcttccctattccccgtaggagggtatcatgcactccaagtgggagcatttccttaggcaaatgaagtcagtggccaatgggcaagggtgtcggtctgcaggtatcctttcggtgcgtaagacctgaaaccacagaggcttttgctgcttttcattcaaaataagccatctttccccaccagcagcaaaagattcaatggccccggaagggaacattctggtcctggcagggttcttcctgaggctcctcagcctcagctcttccctgagctggcccatgcattggcctagtgaaggccagctctgccgttggctgcaggaacttcagataaacccttgaatgagtgtgttctagtgacactcaaactggactcactatggcttcagattgttctagtctgagctgagtgagcccaggcacctgcacaagagctgcctgtggcctggagtattcagcccctgctgctgtcccttcctttccctgggtgtggacacctcagcctgtcacaaaggggccccaggaacacttggtcccctcacatgaaacctcttctcagtgtcagtcaccactcaccccctccttctccatgggattatttttctttctgtttgagtttttctctcttgctcgatgacactcttttgtttatttctttgcttccccgtaactctgttgggctggactttggcctctcttgtttcttcatgtggcttctctgcttcttggttcactggagatcgtggccggagtgtcagtgcccccgtattaggtactgtacccattccaggtgaggtggagagtgagaatgcctttgtttccctaccctaaccctccccttcaccagcactcagccagggacccactactgcctgcgttcctgcatctccctctgaggaaaaagaagctgcttgttggaataatccacaagtactttggaccccaaatccttaaaattaaagacattagctcacctagatttgaaatattgagcacactaatttctcagcaaggaagcctggagtccccactagtctctgggatcttggtatggagttctgccctgaaggcagaactgggcagattctctggactcccactgaaggggagggcccaggcttggggaagaagggttccaggggtcacatccttacattcacattcattgccttcttccaatctcaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaagtaagttggtgccgttgatcctaattatattgcttagaatttttctttttgattgggcaaagagtctatgtaagcccctggtccaatagacactgaaacagcagtcaaaacagagtgttcatgttcaaagagaagaatctgagatattttccagggccaagagaaggagaagtatgaaagacacccattgaatatatccagttgcctttcatgtcatgcatcctaagcacccacccattccacacaccctgaacataatctctgcagcttatattacattggatctggcacagacacagatgagactgtattctcccttcttaggagtcagtctgttttaagaaatctttgaaaaacctttgaaagccaagtacttgctggcccaactgatccactttgtgacatgaggcagaaactggggcctcctacaaggcatcaaactttgctttgacttctatggcaagtgaccaaatcccagaggcaggatccgaattgaggcttgagtctggccaaggagctgcgacaggttgtgatccttgatctctgggaaggtacggagaagcagtgctgccgagagtccctgtgctggcctgcatggccttgcaaaagaggaagcacagtgactgtaggctttctgactattccatgaccgtctccatggattcttctccatgcagaatccgaagaactcagtcaggaaatttctacactgacacgctggggatggcagagtttcgacgaggtgggctccgggcaaccgcagggccaagactctctaggaccagggactccaagggacagaaaaggtaaggcttgacccactttcctttgatctccctgctctgaaaaagaagtatctcccttcaaacctgcatgggtgaatctttactcctgtgttttgcggaaacccctttccatattctcttccccagtcaagcagtccctacagtacgtcatttccagcacaatatctcctaagttctgagttactcagccaagatcagtactcctggaggtcttccacaggattggaatgtgacattttatatctaaccaaaaggcaaaaagtaagctgtaactctcttcagtttagtcacctcaagattgccatataccaatgcagagtacaggtaattactggttatgatatgtatcattcagatgtccgttctcagaaataatatagtctagattccaattaaggaagaaaagcatttccctaaatgcatcatattgtttgcagacctgcatcccctgcggaagggagtcttagcttattttgcacatggatatgatactgcacttccctggcttgccaaacaggtttctagtcttaccaggtcctcctcgtgcatgagacctgggacctttccagatccatttattcttcgatgagtatccccagactccaggaagcttgaaaagaagcatgagaatgtgtagaccattagcttttagaggctagagaatctaaggacatagtctaagtaagtcagagaccaattcagagcccttagaaagtgagccagggaaagctttacctgtatattcaataattagatattctaatttacttggcaattttctcaatgtagacattactgttgtttctgatttatctgagctgaaaaaaaatcaagctatagtaagcttgaatgattgatctttgttttaattctggctagttcttgaaggattgactctagaaggggaatcattgggtcagggtataaaaactttcctaagacccctcagcattgtccctagagtaggagagcatggttagggagctatctgtattctgacagtcactttagggtatggggtgaccagggtcagtagctttctttgccaaaggaaaaaactgcagttccagccacaggctgctttgttcaaatgtctttgtgctttatgaaccgtaacagtggatgagaaagggaagacgtatgaagaagtcctgatgagattgttatgtttatcgtaatggtgcaaaatgaatttgctcgtggaaaagaaaggccttgtgactcttaactagaaattgatatatgttaatgtcctctggtgatatttataatttctagatattaatatttaggtgtagctttaaaactgttgttgctagtattctttaggaaaagtactttgatactgaaagcctccagccccaacctttttttgttcaataaaacaattgatttttttttaaatatgatatttgataacattgtgtaggcactctctctcagattatggatgaacacattttattttctttcttctcccaggtaaagttttacagagttacattccagtcagcactgctggacagagtgcgcctattacacccacatccttgtcagcattgagtagttaaatttttctttttcaaagttttctacttttatgaacctccaaatttcctttttattggtaatttagttttcatgtttgtccttttaattcttttgtgaattatctgcatttttgttcattattattattgtatttcttatagatttctaactgttctctattaagatattaagtcatgtctagtaattgtgacaaagtatttttaggtttgtagcagaattttacttttgcttctgatactttgatacatggaatttttatgtttatatagaattaggttcatccactttgtgaattctttcatcattttgttttaaatttttttctgtgatttttaaaaactttgaataatccatttaggaattattatagtttgtgagtttattatgagttactatttttgagaaaaaggcagtaaagtataatgtttaaggcaaacaggctctagagccacatggctggatcccacctttgcggagtgtttttttcctgagttgatctactgactgtattgcccttcaggactccagctttaggagaggtccccaatcctactgctcccctaccctgggccccattttgtttccttttcctacacgcatggtgagtcagattcatcatgaatgtaaagatgcttaagcttcagggaccctcctttgtatggagcccttccagggtccagagaaagtctgatcatagtgttaacagggccaggtgttttgaaaattttgcctaaaaaaggtattttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaaaaaaaaaaaggtattttaaacacaaccagttttaagactgctgactatttttactgcaactttcccttggtctatacttttccttgtaacagatggtgttagggcagctgtgggggttttggaggacttgctaaggggaagttgacctggggatccatgtagtttgggtttaggggggtatgtgtgtgcatgtggtttgcagtcactgcatgtttagttttgttaggtttaattcactagctttcctactgcacaaatggcttccaggatttcttctacttcccattgtgccgattcgctcagtgctctgtactcactaatgaactgtaaattataaatgtgccatgtgctctccccctactgtgagaagagcatatttgagaaatctcagctacatcatttgaactgcaatttgaaaggatgttttggaatgtgtcaacaaaacaaatggtttggctgtatatgaagggtatcttctctgtcatctccaaattatttcccagcgtgttcagtggtgccctggctgaggatatgggagatgctggcactgagaggagctgaggaggaggtgcagaagctgggtctgattctgtgtgaacacctcaaggcttaggagggaggagaggattcgcaaaacaaaaaatgggaagactactggagatgatgcccagagctctaggtggttttgaaaaggtcgatagcacagaggttttccaattatgatctcaaaaacacttatttcccctttagagctgaaatgttaggttcacaaagactaggcaaaaaataaaagttaaaaaatttaaaaaagaactgaaatgtccctcagatatgtttgtttttcccacttccaagaaacaaggaaacaaatgaaataaaaaccaaatataatataaaacaaaagtgataaaatgagcattgaaatttgagagaaattattctttcttacattaaaaaacaaattataaacaaaaaatccagatcacaccaaaagcagtaatttgctaagagcaagaggtaaggtttaaacaaaaggagtgagtagccctctagattgttgttcatataagatgaatgatatgaatccattgggaaaaggttgaaatttcttgctgagtttacatgatgtactgacagtgacaaagataacataaaactcatgtactgccgcaaggacatagacaacacatgagttaaatgaactttgtcaattcaaagaatgtttaagattagccatagcgttagaaaacttgaatgcgttatagttttacaactcacatataaaagacatttgatagaggcctttctaaatttaaatgattctaaaaatgtacgtgacaataccagttataaattgtgaagataaaacttcttaactattgtcatagaagataaatattgatcagtcatgctagaagaaagactaaatcaaccgtctgttgtcatagaatatattataaagttgtggacatacaaagaagcagtcaaagagtatccacccaaaatacaagagtaaagaagtactatagctggatacagtagctcagacctgtagtcccagctacttgggaggctgaggcaggaggattgcttgagcccaggagctcaaggctgtaataagctgtaattacatcactacactccagcctgggcagcaaagccagaccccatctctaaaaataattaattactaacaccctgtctctaaaataaataccccatctctgaaataacaaataccctgtctcaaaaaagaatcaaactatagaggtacatcaagattttatataatgaaatatttctagattttgtgatttttttttcagttttgcaaaacttgcaattttttgtggcttgttttctaattctaaatattccctttgtttctaattgtatattcaaattttatactattttgaagagaaagtttgtaagttccaggcctcgtaaaatattttcaggacccatgaaagcccaggttccagattatgattgatcagtccctgccccagggtatacattatctctaacatttgatctaaaatggggcattcttatcatgcttatcctttgaggaattccctcactttaacaacagctcaaccaggcatttaaaaaaatatgttttaatctaatatgttaggggtactttgaaggaatctttctggtctttgaaggaatatctacgatattctataaatcctcatttatgaacataaagttgctctgtcgaatcccccctaaaaaaatgactctattgggatttttagtgtgctattcacactttaaatgaaaaatggatgtctttaagaattgatggctttataaaacccagtcatcctgtctaggaacataatctagcttttcatttattcatgtccttttttatctagctcagttgactgctgcagtcaatacctctccccacccccgcaatccccacacataatcacacaaggccaaacatctcttgttaaggcaattcctagacgttttataatgttggttgctatgagtgggatttttaaattgttttaacagtagcattagtatctgtgcattgatggtattagaaaattattgatctttgtatgtaacatacgttacatatgtttatatgtgtatttcgtaagtggccacctcactgagctttcttgggttttctaaatgggcagtcctgacatctgtaaagaatggctttatttctgcctaatagctatacttcttgttcttatttatctctaatactggctatgactctcagaccagtgttgttagtactgatgaaaaatatattgtccttttattgactttaatgtgaatgttcctcctgttttgttaataagtaatgtgctagctgttgttgattggcaagtttttgcttttagttttgggtgttttgttttttttctttttaatgttaagagaactgaccctcttaaatgctaagaaaagtagttttctaagcattttcctaaaaagatgattccgcctaatgaggccacagctctggacttgtggcatgtatatgtgtgtatgcggacctaggacatgtgaacatgatctcaggagggccatacaggctgccccattctctaagtagcctgagatttgaaattcagatcttgtgttattaagaaaactctagggtctacctcctatgagtgtgttgtagtggaattttgttcagcagaatcccatgatggaggttgtttgttaaaaaacaggttttttgttttgttttttcttttcttttcttttgtttgtgagacatgattagattcagaacctcaggctctcccactaacaggaatatgctgttttcctgcttcccagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggtaagggctcagcttggggagaggaggctcccatttctccccaaagcatggggaggccagggtccgccactcctgtcacacatacacacaggaggatggatggaggaggctgagagttcctctgtagctgcaggttggcatcccagggcacggtgtggagatacactgccatactcagagcatctccacccagacacagctttctctgagggccaaattgcctgccaaaatttcacatgtggtcttcatcttttaatttcaggagctaggaattaagcacccactccacaggaagaagcttgttttagcagtgaaagccatcaacaccaaacaggaggagaagtctgcactgctagaccacatttgggtgacaagtaaggataggcatatatgtattaagaatgtctctggcagcaactaagagtagaaagaattttcctgttaaatgggtacctcaaggacagctgtctccttgtaaaaagcagaggaattactaaacttttgggggaataaaacgaacctcaaaatataatttgctcccctttttttggtgtctacattctctcattctcatgaatcctgacacatctggggtttttgtatttgtagggtggcttgatgatattggcttaccccagtacaaagaccagtttcatgaatctagagttgacagacgaatgctgcaatacctaactgtggtgaggactttttctttaaatatttcagttgtccctgtgagcactcagctcacgtgtacccatggtggttattttaaacttgattccatatattcttaaggccttgaaatagtatcatttgtcacaaaagaggtcccaagtagcagagtacaaaccactgtgataagctattggtgtctccacgtgcaccttcctgagatgtggttgacttgtctatgcttggtctggtgagggacatcaggggtcttttgtcactttggaaactctggtttataaaccaaactttcctctttcagaacgatttactcttcttaaaagtcaccagccaactacatcatctcagcatcaaatgtgccattcacgtgctgcatgtcaacaagttcaacccccactgcctgcaccggcggccagctgatgaggtgagaccacaaatagtatctctccaggtagccctgagccaggacccctgaaacatcgagcatgagcaaacaagaatgacatcataaaagcactgttttttgcaccatggtgcctgggattcttttgtttgcttgtgcttcctgttgccccaaacatccgttacctgcactttgtgtctcacagtagccatagacctctaagctcccaccctccactggggagacacatgctataaagtcatcatagtgattaaaggagatgaggagatggtgcaaaggagagggggagggaaagacaaaatggaaagatgggtgtcacagtagaagagaagagaagagacagaggagggggaagaggagcccgtagaagctagacatttcagaataggtatccctacttgtagatccaaaattaactgacttccaggcccaggtacaggggatccatgagtagtcttgctagagaagaaatagtatacgtaaataacagcaccccaagtcttgaagaaataactgattatgttccatgaacttcggagttcttggtggacccccaaactgaagattgtcagtcacatcctatctcctctgttcctgggaactaggtctaaccttgctgtaaaattaactcagcttcctgggctgctacctttgctgtctatctcctattttctccttattcaaccaacatgttttgaatgtcttgtatatgtcaggcacagcgctgtgcatttttaagaccacagtgctacgtgagagcacttaggaataagtaccttaaggtgtgctcccctaaaatcattggccacaccagggagatctttcatctataaaccacttggattgtaaaattgacagtcatctttaaagttctgttgaatcactgaaagaataactataatgtcctcatttatttgtctcaaagttagctggaaaatgatggagtaacagaattctggattcagatatctcagtgtggaagatcttcaaagattcagtgggagctctatttcctagaaactggggaggctggtgctctggcagatggggtgggtcactaagcttgagggccttctattgttgtgatgcgtctggggcagggttacttaccggggctgactccacagaggaccatggtgggacctattaagcctaacttcctcactctccttctccctctgacagagtaacctttctccttcagaagttgtacagtggtccaaccacagggtgatggagtggttacgatctgtggacctggcagagtatgcacccaatcttcgagggagtggagtccatggaggcctcattgtgagtggctctctggcctagcccacctgccttggtgcaaatgggatattcagaaacttatttattaaggacaaggcacaaaagctaacgaaaaaaaataggtacttcatctggaggtcttgcataatttgatgtctcaaagtattttgataacttgtccttgagaattaatatacctcatggaagcaagatgccttctggcagcacctccttggcatgagacttgaggattctaggtcgatgggttgcatggagaccaacgcttacaaggcgagggaacagcagggctgaggaagggacggggaagccgtaaaaatgcagcttcccacttgctgcaataggatccctatcactactcagatctgtcagtggcaaagccagaggggaaatgaggaagtgtggtggcttggatgtcatccagagaagatcctgagagacagcctcaccaaagaggtcccagttctctgctggtctgtgaaaacaaggtggtcagtcagcacatgtgctagtatgtgctcagagccaggccctgtgccagccagtgagtggagtgggactcagaacaagtgactgagctcctgtccctcctctggaggcacccccagccccaacaggccagtctctcagcatcctccccctcgagccatttgtatttgctcctggccaggcttgtctctggttccttcttagatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccgggtgagttgcagagcctttctgggtgggccctgggctgcctcctggccctcacgcagcacagcacctggcgcgatgcccacagccagagcagcatgcgcagcctggacaaagaggatctttcagcttctgctgtgggcttgtggtctgtgaggccagtctttgttaagccagttctccaccagtttggagtccaaggaagacagtgcaggtttctttacctagaaaatatgtgcaggaagcacctatcctcaggtggcttagagctcgtcctctaccccactgctgctgtgactcaccttgcagagcggaagcgctccgagtctggctttccttcggtcaggcctgcctgcgtgccgcaatgccgtgggatcttggtcaaagctgtcctgctgatataggaagtgcttccaatggaagctggttccatttgtcttgtttcgtgaagtggccagcacacagatacccagaggtccccaggtctttcaagcaccaacactactcactggggctcccagaatcccacaaagccctttagacctgcctgagccacagcatcctcagaccacattcttcccagactacagaccaacaggcaacctctggaggccaggctggtcctatccctggtagtgttgatgcttcatgcccagctacaactcaggcacagacctccttccccaggggagcaagacaggaagtatgtctgggggagtcaggcagaaacagtgctggatgacgctagggcagggagcaacctggggctatcctacgcgcctttagatggtgccaggtgctgagatgggaaagggttggggtgccagcagctgtgctgaggcaagttctctgtgcttcgcctcaaatgcagacctcaagtacattctaaaggaactcccagttcatctatggaaataagaaagtcactttggtggggcagccaggcatgagtttcaggcatagtattggaggggcagctcttattgttcaagattatttacctattggcctttctgcagcatagaaattgcttccaagagctctgttttgttcagagtctttctaggagcagtttacattattcctctccttgagtgcctgctcttaaattttaagtatattgtcagtcatacctgcacactgccttgattgccttctcataatcttgcattttctgtgttttagccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcagctcaccatatctttaactttgttggggaaaaagagctgagggtagctggaaatggagtcctacggattgcagagctgaagagccggtggcactgagcctagtcctcagccaggtgcatgctcaggattcaccaggggggtagagcaaggcgggaccccctcccatagccttcagaggaggtccgtggccgcactgcttcagaatttgcttccctctgtgaagccgagggggcttcaagtctcatgcacatcctgaccatagggtccatctgtcgtgcagacctcaaagctgagtgctttcagtggcatgagcccccccagtgaaggggatggtggggagacaagaaggcaccttgctggaaagactctctttcatgtgttttgctggcttctctattactgacttagctaggctcataaccatggtgggggctggtctgtctgctggcagaactgaaagagatctgtccccttgatttagaggctgactgactgataatgactgataatggctcctccagatgggccttgtctggctgggactgaggtagagatgtgccttgccagtctggactcctggtcagaagactctagtttgcccccaggcagtgcttggctcccctcaatcccctgggcctcatcgcagaagagtaacaccacgtcaccgctgtctgatggcctgggcacggcctgatgactccattccattgtagcactctgattctgtaccagatggaggctatgctaagatttgcttcttaaactaccagcagcctcaggcatggtctgttgccacaggccactgcctcctgggaggtgagagatgtggggacaagcttgccagctggcaatgctgctgatagatcctggtacccaggtccactggatgacaagtgctcattcaggctgatgcctggccactggagttgtagagccagtcagggcaggctttgtcccttgtttcttatgttgcggtacagggatctctgcatgtgcctgttttcaaaacctgcatggaactgttgtgccactgattctctgcaccctcaagtaagtcctgttccctttgtgggcttgttttcctacctataaaacaagggaggggttacacttggtgccctccaaatttacagaggatgtttccaaatctacagtgtctaagtaggtttagggaaggaggaagagaccagcattacctgagaaggaggggcaggagggaggctcttgagtagtgaggaaggatgcccacctatgtcagggcattggtgtctgagctcctgttgcctggtagcaggagtctagcatcctgaaggccttcattcctactgctctctgctcctggaaatagctggaacattgaacacgtgcagaagggctgcttctgacaagcttgtgtcttgcctctgtgtaccctgaatgccagttcccagtggggccccaggagaggtatgcatgcagtgtgggacattgatgcctttccccaggaaacaggagcagcatgtgctccacccacctgtcactcctcagggcctggcccactccttgcctgtccctccagagaagcatgccctggagaagccaggcttgagcacgacaggacttgcatgccatctctctgaatcacaagctgcatccatgtgtgctgaccaggctgctgcccattttacagatggcaccttcggaaggtaccgtgacgcagatagggctcctctcccaagacattcaccgccttacggtaggactctgaccctctccccacagtcagactggtgccagggaggcccagtgagtttggtgtggtgtggtgtggtatgcacaaggcctgggggacggcgaagaatggtgcttagtgctggggtcacagcctgagcctgagccagccacgaggcagaaagcagcccaggggccttctctgttggcctgttactggaccttgagcccctaagggcagtggggaggctcatcggctgttagccaaagccagctaaagcacactagatctcaggtcctcttcccaggcttagagatgaggaaaccaagatgctcagcaactctagatcacctgtctcatcagcctagagcccaggctgcatcctgtcctagtggacacttccaccctctgcccagagacatatgcatttcctatcgtgcctctgactttgtgggtatcacagagtgttgacaggcttgtgagcacatcctggcacgcccgaaaggacaaaccatatcatggggaagcagtttggcctcgaaaagcagctttggagtgaggctgaagtccctgctctgacttcactagctctgtgaccttggatgtcattctctcctgagctttggcttagttatctgtaaagcagggctaatgacatcctccttgccaggcttataggcagactagagctggcaggaaaaggccagccacagagcacaggatttgtttttgaggatccatcactcccaaggccttttagttcttggacattccatcactgagcctattggctatagtgtctgtccccatcgaggcccctgtccctgtactttgcttgcttgtctagcaaggcccattgggatgacaggacaaggacagggacacacgactctccttgttttcaaggacaaaacaggaaagtctccctgactccaaacaggatcagttttactcaacgtttttatttattggcccacccatgaaaggaatctgcccacacttgcccttatgatctaggcctttggtggcctgaaaatagaaaatttatttctaagatgaacaatttatttttatcttaatagtgttgtttattctgacccaatactcagggtttcttgggacactataaacttatagtgcacctgtgtcagatgcagccctcacccagtgccctctagttccggtgcagctgccgcagggcagcctggaccaaaactctattaaactgacccttcggctgtgtccttttcagacaatgctgagccaggaccagctgctgaatgactctcgcctgcctgcccccaactctgatgactggagatgactttcttcgtggctgagagcgtagggaggcatgtgtgggggccccggagcctttgcttctgtggggagcgggcacacagccccctctgcaagcccagtccgggctggcagggtgtctcagacaggctgctgacaggcatgaagcagagctgtgggacaggtgtccaggggtggccccagggtccatgtgtgtcttcaaccatgctgcgctcttcaccgcaggcttcataccttttgtacttttatacgtggactgcagaccactttgtgggagggcagtgacatatcagcacacagactcgatggctcgtgatattcctggtgacagcctggaggctctcacactcgaggggaagagctgttagttcataaaacctgctggaaaaaaagttccgaaaaactgttttgaatgttctgtagagactgtgttttgtgaaatggtcaccaggaggtccctccggggctgcttcacagaacgtgctttttccattcttgggactgtggctgggcaaggcaggtgtttagggtatgagcgggtaaagcaacgaggctccttacccacagcactgcctgactctatctcccgtcatctgcaaggggtatctgtgcgactcccagcttggagcagaggcgtccccaacacgtgcacaccctgccttctgcctccacccaagctgacacacagcctcctcccaggccttgcccttggagcagctcaggcgtaatgtctgattaaatagctcccccaagtggaaggcccttgagcacctcaagctccgtgtttccaccccaactcaccaacttcccaaacatgtctgtttcctctccactctttagtccttcctccctccaggcgtctgctcaggcccttccctcactagggaatgcatttttctcctagtccccttcatgagggaaaatcctgtctctcaaggcacggcaaagagaccatctctcaggaagccttcccgcatgatccagttacaggtagctctcccacagtgccgtgtctgcccttgagccagagcacagctcaccttgaagtttcttgtcgtcttaccatacccgtcctcaccacaaacttggagcacctgctctgcactggctcctgtagacagtcctccagttgccaaggagatctgtgctcctaagttcctcatccacccactccttcgcatgtgtgtgttaagaaccttccatgccagggctagagatacaggcatgaatgccaaggtccctgcctaaaggtgcttacagtgtagtggagtacagaccagtttcaaacaagactctgccaaaggttacagatgctccaatattagtttctgcagcctaaaagagcatgttgtcattttttttttattatactttaagttttagggtacatgtgcacattgtgcaggttagttacatatgtatacatgtgccatgctggtgcactgcacccactaactcgtcatctagcattaggtatatctccaggtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttttttcttgtaaatttgttggagttcattgtagattctggatattagccctttgtcagatgagtaggttgcgaaaattttctcccattttgtaggttgcctgttcactctgatggtagtttccttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacctttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttgttctgttccattgatctatatctctgttttggtaccagtaccatgctgttttggttactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaaggcattggtagcttgatggggatggcattgaatctgtaaattaccttgggcagtatggccattttgacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttgttggtatataagaatgcttgtgatttttgtacattgattttgtatcctgagactttgctgaagttgcttatcagctgaaggagattttgggctgagacaatggggttttctagatatacaatcatgtcatctgcaaacagggacaatttgacttcctcttttcctaattgaataccttttatttccttctcctgcctaattgccctggccagaacttccaacactgtgttgaataggagtggtgagagagggcatccctgtcttgtgcccgttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcgtggtttttgtccttggctctgtttatatgctggattacatttattgatttgcgtctattaaaccagccttgcatcccagggatgaagcccacttgatcatggtgaataagctttttgatgtgctgctggattcgttttgccagtattttattgaggatttttgcatcaatgttcatcaaggatattggtctaaaattctctttttttgttgtgtctctgccaggttttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtgcattcagagattcaacttcttcctggtttagtgttgggagagtgtatgtgtcgaggaatttatccatttcttctagattttctagtttatttgcgtagaggtgtttgtagtatgctctgatggtagtttgtatttctgtgggatcggtggtgatatcccctgtatcattttttattgtgtctatttgattcttctctctttttttctttattagttttgctagcagtctatcaattttgttaatcctttcaaaaaaccagctcctggattcattaattttttgaagggttttttgtgtctctatttccttcagttctgctctgattttagttatttcttgccttctgctagcttttgaatatgtttgctcttgcttttctagttcttttaattgtgatgtcagggtgtcaattttggatctttcctgctttctcttgtgggcatttagtgctataaatttccctctacacactgctttgaatgtgtcccagagattctggtatgttgtgtctctgttctcgttggtttcaaagaacatctttatttctgccttcatttcgttatgttccaagtagtcattcaggagcaggttgttcagtttccatgcagtcgggtggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaatatgtatattctcttgatttggggtggagagttctgtagatgtctattaggtccacttggtgcagagctgagttcaattcctgcgtatcctttgttgactttgtctcgtttatctgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactagggttgcaacccctgcctttttttgttttccatttgcttggtagatcttcctccatccttttattttgagcctatgtgtgtctctgcacgtgagatgggtttcctgaatacagcacactgatgggtcttgactctttatccagtttgccagtctgtgtcttttaattggagcatttagtccatttacatttaaagttaatattgttatgtgtgaatttgatcctgtcattatgatgttagctggttattttgctcgttagttgatgcagtttcttcctagtcttgatggtctttacattgtggcatgattttgcagcgactggtaccggttgttcctttccatgtttagcacttccttcaggagctcttttagggcaggcctagtggtgacaaaatctctcagcatttgcttgtctgtaaagtgttttatttctccttcacttatgaagcttagtttggctggatgtgaaattctgggttgaaaattcttttctttaagaatgttgaatattggcccccactctcttctggcttgtagggtttctgctgagagatccgctgttagtctgatgggcttccctttgagggtaacccgacctttctctctggctgcccttaacattttttccttcgtttcaactttggtgaatctgacaattatgtgtcttggagttgctcttctcgaggagtatctttctggcgttctctgtatttcctgaatctgaacgttggcctgccttgctagattggggaagttctcctggataatatcctgcagagtgttctccaacttggttccattctccccatcacattcaggtccaccaatcagacatagatttggtcttttcacatagtcccatatttcttggaggctttgttcatttctttttattcttttttctctaaacttcccttctcgcttcatttcttttatttcatcttccatcactgataccctttcttccagttgatcgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttctgttgttggtgaggagctgcattcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgctgtgtgaggtgtcggtgtgcccctgctggggggtgcctcccagttaggctgctcaggggtcagtggtcagggacccacttgaggaggcagtctgcccgttctcagatctgcagctgcgagctgggagaaccactgctctcttcaaagctgtcagacagggacatttaagtctgtagaagttacttctgtctttttgtttgtctgttccctgcccccagaggtggagcctacagaggcaggcaggcctccttgagctgtggtgggctccacccagttcgagcttcccggctgctttgtttacctaagcaagcctgggtaatggcgggcgcccctcccccagcctcgctgctgccttgcagtttgatctcagactgctgtgctagcaatcagcgagactccctgggcgtatgaccctcccagccaggtgcgggatataatctcatggtgcgccgttttttaagcccgtcggaaaagcgcagtattctggtgggagtgacccgattttccaggtgcgtccgtcacccctttctttgactcggaaagggaactccctgaccccttgtgcttcccaagtgaggcaatgccttgccctgcttcggctcgcacacggtgcgcgcacccactgacctacacccactgtctggcactccctagtgagatgaacccggtacctcagatggaaatgcagaaatcaccgtcttctgcgtcgctcacgctgggagctgtagaccggagctgttcctattcggccgtcttggctcctcccttgcatgttgtcattcttaatgggggtttggggaaggagtctgaataggttccatggaagagatgacacttgaatttggaaacatgaatcatattttcccaggtatgccggagaggaagggcattccaggtagacagacttgaaacagcccagtacaacctagggattgccaaaagttggtaggctagagcagggtttcctggcctctgtgctgctgtcactttgggctgcgtaatactctgtgatggaaatactctgtgatggaggctctcctgtgggttttaagatgtttagcagcatccttggtctctaccctctaaatgctaatagagggtagatgcaccccttctgtagctgacaaccaacatgtctttggactttgttatctgttccctgagcagcaaaatcaccctcagttgagaaccagtaggtgagagaatggggtcggagttgggggcccagggaaagaaaaatctgataaagtcggcaggagcaaaccaagaagggccttgggagccaggccctggagtgtgtcctggagagatgggggtggccagagtggggtctcccttgaaagcagtgaaggatccccaaggagacagtgaacagggggatgggtgaggttggctgtccctcccccccaccccgacagaccctcgtttgggtttcatgatacaaaggatttaaggcagtttctggaacctgactttgaaagttgagaagtttctgtgtgtaaccactcctaccatgacccctagtgccatggagagattcttgagagttgatgtgaccccacttggagttttttaggaactgccccgacacttgccagttgtgacccccatgggcatgcagaagccaactcacaggccaggccacggcctcctgactgcctagcacgtcccccacagagccacacttcatgggctgtctgctttgtacttgagtttatttcacaaaaccacggagaaagatactgaaatggagctctttccagcctccaagcaaggaggccccagcagccagtctccagccccttgagccctttttgttaggcccacacccaaaagaggagaaccagtgtgtgcgcgaaggtacatggcaaggcacttttgaaaacatcccagtttaccgtggtgaaattgaacttactctgaaacagatgaaaagggacatgcaaaattgctgagcacgtggaggtgttagtaggtgaaaatcatgtcctgggtataacccagcttctccaggttagggtgagccgccgtctggattagtggtggcgggccacacaccaggatgagcgtggacttcgctggaggaggaaggtgctccttgatcatgtcggcagtaacgaagcctgagctgtacttccagcctgaaatgaaggagatgcaggagcaagctgagcgatgccaggtggagttcctgatcccaggccgcctgcacacccaccctcagccagggaggaggtgacaagctgctctacaaaggcttagaagtctgtactactgctccctgcaaaaagcctcagaactagtaaacagccctctgcagcaatcaccccaggtcccaggctcactgcagggaccctgaagccctgctgctgtctgtcagctgtcagcattgacgaggaaggagaacacaacgaggtataccgaggtgtgtgaatcagtacagccagctggagttgtccggcagggtgtggcctggtgttagtggaactgcgcagaattgctcagtagggtagcgccctctgccgaccagggacctgtatgacaagcaggtacagccgggagcagtgtgagaggcgcgcctgtggggtgctctgtgcacagtggttgctgggatgctgtctgggctgcagcagctgtctgggggctcagcatgtccaggtgaggtgggcggtaaggggtgtggtggccgtaagcagaagggtgagtggtgaaggggtcagtgcccatattagatgtgtatgtgatggctgtgtggaatgggtgggtgttcacagtggacaggggcagtgtcccttttgatgttcagtgcagcgtgaggtgctgctgatgtattagacacctgctctcgattgcccttaaaagcaggccatcccaaatcctttctccctcaatttctcacatttcccatctggagccagagccccaggcttaacccccacatctggtcctacaaaactaaaacaaaacaaagagacagagaccagtcctcaaagtggtcaagggttggtgctgacccatggtgagtgagggcaatggatgtcgtaccaatgggaggcctgtccagggtgtaccacaggttgaactggtctgggtgagtcctggcaatttcttcaagctcttttctgaccaagatatcctcctctgtctagaaaagaagcaacactgaaaaagcccctccagggccatcctcttgttccctggactgactacaccggtcagcatactcctggccaaagctgccaccactccagctggagtgctcgctgccaactcccacggcaaacaagagttctgctgctgctcctgaagctcaaaccctttgttttgtggatgaagttcctccatgtggatgaagaacctccatgggatgtaggttcccatggagctgcagtgaccgcctccaactagaaggaccttagccaagcgctggccaggatggcttcactcggagctccagccctgcctcctacatctacactgagctctagcacagcaaacctaactggaacaagctcagtgcaggcccaggatcttctggaagaaatgtaatgggctcagaaagtcctgtgatagaacagcactggatatgtgaaggagaggaaaacagtctggagccccatttgggggaaagggaaccaaagccaaaaataacctgtcacagcctcaaagataactgcacagaagacctggatcttaaaactcctcatgattctcatcccagtcattccacttctgggattctgttttagaaaataatctaaaagtaatcaagcgtaggcacaattattcatcaccatattatttagaactgaaaacagcctgaatgtggaagttagtaaattatagtgcaacttgataaaaactatgatgaaaatatttataaagcatcttaaagagaagaaaatgcctgttgtggtaatgctgagtgaaaaaaaaaaagcatatataaattacaaatatataacatatatagaaaaaagatttaaaaagtaagtaaatatttatattctgtattttctgaagtgtccactgaggacatctgtgattttacacttagcaaaaatacagcagtacatcttaaggaaaaaaggaatgcttagtgcttagggctggctgaggagacacaaaagagttaaatacatgcaaaaagcaggcctggactcagcttctccagctgccagcagccctgttgatcccactaagccctcccacagatgcaggcacccaagcagcatgagctcagtcaatgcaggagaaatgaaaacaagagcccagctcagcaaacattccatcctaccactgcaagctcagcaggaactgacctggttggcaaagatgagggacatcctggtcctgtcactggggtccttggtgatgtggcgaatgagctgcaacatgggtgtgatgcctggaacacagtgagcgagcagccagctttctccctgtctctgaagcccacagtccctgacctgcagcaagcttcataccttcccccagcccaagttatccttttctcacttctgtccccaaaactcaaagcaggaaacagcccttcattttggttttcctttctaatgcaacagtaagtcaggtagtctttctcattttcatatggcaagatggaaagaacactctaagttcttcagtgtcctcattcatcaaacaatgacgggtaaatgtgatcgttttaagaatgcctattacagtgcctggcacattgtatgtctccttcaaagactgctctctttcttcaggcagtcattttcaagggatggggagagtcaggcttgaactggatctaggagcccctgggacagcatgggtgggcctgcccagcttgcccccaagcctgacctgaaaggtccccacaaggctcctgagcagccaccatattggttaggggaagcagggtacacagggtcagtttcaagacctgtcactggttcatcgttcccaccttctacagctggaggcgaaatctctcatgttgtcccttagaggatcaaatgactcccaagtcagaatgggtctcggggctcactctctggatggagcccctagaagcctcttacctgtgcccccagcaatcattcccaggtgatcggccagtgtttttttaggctcactcgtctggtctggtctgattccaagattccctggaaacacagagaatgcttatgacctctgcagttcttgcctaaagagactgcaaaagatcactgacattccttaggactcccaggaggcacgtccagctaagggactgtctgcaccattttaagctggagaagcaggccagggcagtctcctcagctagccctggtgctccagtgcacaaagtgggaatagagcctgggcttggtcggggaatcgccgggccttctgttctgaggaaaaagaggggcaagctgaagttaacacagagactcaaagagcattctcactcacggaggtgaaccagtgagtaaacaatggctatgtgagtaaccaaggagcatggactccctccatccatttttcagtattagcaggcaccatttatgtatcaggcattgtgctggagattttgatacaatgacgaggaaacaccaagtcattcccctaccttacaaaagctgacaacctcatgaagtgggtgtgtgaatgtgtaacaagtgtgatcattatgcattgtgtgtgaatgaatgaagactaaggacaaccccatgtgactcaaatctgaggagtgtacgagaacaatggaaccattgcaggaatcttcctcccagctgggagcccaagtattaacccctccagtacctggcccatggtaaaacaagcgtccccttggccctcgaaaaaagatggtctccccgattttcatgttctccaaatactgagtcatcttcccaccttcaggatattgggggtgtacatttttgaagtagatctgaaaagcaaggcagcactgctttcacattcccagacacaatgccacagccacgtacaactagaaaatgcatttactgctggaagctttgcagagaaagtgttctcctctctgaattgttgtacgcaatccctgaagatgaagctgccacaaggttaactgtagcttcactgctggaaagccctgcctagggcatatgtgccctcagagaaaaagcactgcccctccaccccaccaccctcagtaggcttggaagcacgagctagccagatatggtgggcactatttacctttataattaggtccacaaagcctctgtcatcatcactggagacaggggtgtaagccctgaccaccaattcattatcgatttttgccaagagctggacatagttacctatagaaaaggcatcaagcactgagtcaaagcatatttagcttaaataaggcccaggaataaaggactgagcttcagtgaagggagcaaatactgggggcacaatgttaagaggggtgggaagaagagagcagggaaggaacccaaatatgggatgcccggatcctaggcctgccctgcctccctgtgctaccctaggcaagtcacttcacctctctgggttttggtctcttcatctgtaaaatgggggtgatatgtctgcccacctgtgatcttagtgtaactgctttttggagcaggaaaagatcattaaagttggagagtgagtattaaaaattacagaaaggggtcagacatggtagctcacgcctgtaatcccagcccagaggcgggtggattgcttgagctcaggagttcgagaccagcctgggcaagatggcgaaaccccatctctacaaaaaaatacaaaaaattagccaggtgtggtggtgcacacccacagtctcagctacttgggaggctgaggtgggagcatcacctgagcccaggaggtcgaggctgcagtgagctgagactgtgccactgcattccagcctggacgacagaatgagaccctgtctcaaaaaaaaaaaaaaaattagaaaggaatatttgtctattcaagaaaaatatgtggccttcacaaactcctttcttcctaaactggatgtatcactgagatctgtgaataaattacaactactccatctgtatcctggtactaggcacagagcaggcctgggctcacagatactacagggccctaggatttgggtacccatggagcaaatgaaacaacaatatcatgtcttcctggcctatggccttgtgaggagtagcagtgaagtttttaaccatgtaactctgcccttcctgggtagaattcaataaaccaggtgtggccagagacctatggatcatgactacatcccactgtcagatgacacactgggcagctacgacctgttggatccaaaatgtgagactcaaattactaaggcaattagtggcagggacaggagtgcaatcaagagatactaagagctagaggcaagagaaagttttgtaaccctaacccttgactaacttcctgtatgtatgtagtcagtttactccctcagtttctactcgctcagaaactgagtggactacatacgggaaattagtcgagacaaggaagatggaacagagagatggatagaaaccaagacctaaggtgcagggaggaggaggaggcaggaggagaaaaaagcaggcagagtaggcactagaggggctggtccctgaagctgattcaaggggatgagccaagtctttgaggtgccaacactctgggctcagaacaggctcaatgactctggtcatggtccctctgggcaccagggatagccaggagtaagtgagacacctagcttccttctgagaacctgaaactggaaacctggaaaggctctttcatatgcagccacctaggcctggcctgagggtgtccccagggcaaatggggctccctggctggtccttcaagccccatctctaacttgcttcacttccactgggctgggacgaagcagcgaactctgaggcctcatattagactctcccagaggcctctacattaccttgtcccactaactttgcacggcctaggccaaggctgaggagatagtgggtcaaggcagtttctaagcaattctctatctcaaagtttttcattcttttaggcttcctgccaacaggacctgcctgacaggccgagcagggagctgagagacggcacgcacaacactgagctctcgtgcatagagatggagtgagggaacagcaaggaggctcaggggcccagcgagctggctagagtgtaatctcaccacctgatagagctgaggtcaaggttttggcctgtgcatataagacaaataggccacggagtaggatccaccaggcaggcaagcagcactagcagattatacaaagctgctctgaatccctgattctagcagttttctactgcactaagactgactcagctatctagtggtgttacagattagaaatgggataactcaactctaggactcctagggctggaatctgcaactcgtagggctggtccctccttatgtgggtctgaggcccctgcagagaatctaagtgaccttgggggcagggcacacctgactcattcctgcctacccgcacattctgggcctttccccgaccactggttcctcccatccctcccaggtgcacaatactttgtagtttctgaattttcatatccatcagtcactctactttcacaacaacccaagtgaggtagacaggcaggcctgggaaatcccatttcatagactgaggctcagagagattgaaggacttcccttaagttccccagcaaggagccttccatgagattttaggccttttggctctaggttcagttcttttcaatgctcactgaggtaccactctcgtgtcagcccaattggaataatgaagaaaagaaattttctgtcccacatccatccccctatctatctccctgagctcacaggctcaggaggagcaagagggcatcttccacacctcaggacgtgggaaacctgtgtttctgttaagagaggagggcctagcccccagaggccccagtcctggtgatgacccaagcccggctcacctacaggaagccctaagacatggtccggcgaaggcagtccaaagcggaacctccgggtgttgtggctgattttctgataaaacaaaacataggcaggttctgtcagctttctagaagccttgctgggcagctgagatgcctgggaaaggaggtccgtttggcgctattccagcacacacacacacacacacagggcggcggggagtgaactggaggccatgagatgactgtctggatgccctgccatcccagccatcatccacttactgccttccacccacagggctgacccattacctctttctcaatcaagggcagcgggtacttggcttcagggtcctgtaaggtgattggctctctcctcctggagttcatgctcttcaggaccaacacgagcacagtgaccccagtgacggtgatggtcaggagcagggacgggtcctggcagacacaatgtgaacagagcacctcaggtcttgcccgccctggacagggcagctctcaggcgcagaacaccctccccacaccaaaggcacaggagctgagctctgcctgcaggaaataggcaaagagaacagtagtgacacagaaggcggctgggagagcctgtcgtggaccagagggtagggaggggtcagctgcaggtcacacaggaaggatgtttcaggcccctggagcaggcagcacacatggcctggggtgctcaggtcactaggcccctcctggctacagccaaaggttcatacactggaagtcccttccttgaggtgaagggggaggacatcacccctaacacacaatccggaatgaggggcccagtccctaaagacagaactagggtgcgtagctctaagaggtgccccgtgacttagggcctggggactccccaacagtctcctggacagggcgaagggggcctgggcactcaactgccagagactcgggagcctccccgcatctgtccctaccctacaaggccgccctgctcctctcccaactcaagcccgacagggaaagttgcctctcctcccgccgggtcactggagtctcagccttccggaatccgagccggcccgccccactccccgcccttcgcggtcccgcccacgacctctccccacgcctcccgctccggcccccaacctcccggtcggacgttcgttcccggctctagccggcctccgcgcctctggcctctttccttccggccgtcccgacggagatatttcttcaatactccataaatacaccccgccgcggaacccacccggagtgagacgcccaacacgtcgtcgaactggggttggccgggggccgctccccgccgcgggcccgcagactcgtggcgtcgccccgcagctccgcctggccgacggggaaccggccgagacccggacacgcacgcccgggaggacaaaagcgcgggcggaccccgcaggctgggaccccggcggctggcccgctccccgagaagggccgtggtcggggggctctcactcacgagccgctggctctgggtcagccctgcccccagggcagcgctccatcatgaggctggcggggcgctgagccgtggcgtcctcgctcctgcgctgcccctctgcatcctggccccttccctgcacacgcagagctgccacactgagcgcccctcagcttacttaagctcggcaaggctggagaaggccgtctgggtgaccgggcggagggggatgctggggaaggaagaattcaggcagctgcaaagagcgcgcgaatatattcattcgacatacctcatgggcgcctaccctgggcctggtccggggcgggtgtttgcggggtggggccgaagcaggggcgtcgccgagttgaagacgtgtactccgagcgctcctgcgttcattcattcgctgggtggagagaggaaggacaagagccccgcgccgatcggaggggagcagaatagtaggcacagttagagggtcttcacggtgcgtttcggaaccttggctgcccggctcgcccttgattacaggcaaaggcaaattcttgcctcaggacctgtgtgaaacagagaagcccagaagcagatccccacctgtttgactctgctagggctgctgtaacaaagtgccgcagactgagcggcttaaacaacaaaaatttattgtctcgcaggtctgggggctggaagtccaaaatcaaggtgtgggcagagtgggttccttctgagggctgtgagggaaggatctgttccatgcctctcctaggtttgtaggagaggggctaggagaaggggcatcttcttcctatgtctccacattttcatccctctgtgtgtgtccctgtgtccaaatttccccttttatgaagacaccagtcatattcaattagggtccatcctaatgaccttgttttaacttgattacctatgtaaaggctctaccttcaaataaggtcatatccttaggtactggggcttagggcttcaacataagaatcagggtgaaaacaataacccataacactttaccaacccttctccccaagacacacaccaccacaggctcaaaaattcttgctgtgtgaatgaataaacaaacttaattttctctctttgacttaatcaaatgcctttacttttgatttacctgcaggtgcttggttattataggcagatattttaatttttgacaatgcgataagtgtaaaatgatgtatcaggaatccaatttgcattacctaataactgctaataagtttgagcacctttcatatatttatttcccatggagtttccttttcagaaaaaaaaaaatgcctgctcataaattttgctcatttttctgttgtctttttcttactgatttttaggggttttatatgttttagatatcccttctttgccagttacatgaattagtaatgttttctcgtaatttgtaacttattctttcttttttctttctttcttttctgtcccacctttttgtggtgtagtctgatgaatagaaatttgaattgcagtataaccaaatataccaatcttcaatttttttgccgttatggttagtgatttttgtgacttgtctatttctacccaagcccttaaagatattctatattttccccaacaagatttaaagattttcctttcacatttaagtttttcaaccacttggaattgatttctgtgtaggatgtgaggcagggatacaatttcatttttccatgtggctaatgtgtgtttttcagtaacatttattgaattgctcacatctggccactgacctgcaactgacctgctacccctggcctatatcagttttcataggtgtgtgagtctagctccggcctcccatttctcttacattatctagctgcccaaccttgtcgcaatactacactgttttagttacggtagtttacaacaagtgtttatgtctttcattcttatacattctttagatctcaggtcagatatcactcccttggagatgcctgctgtgatcccccaacttaagtacatgtacatattataatctgttaagtttaacttaaagctgcctccttaatgttttagtttcaccctaaaagtttcttcgtacatagtgaactgtaacctactcttgtatcaatcatggaagtttcagcccattataggcagccaactgttcagactgtgttcaggtaaggcaaatcatgagctgtaaccaatcccgctgtttctgtacctcacttatgttttctgtacatcactttcctgtttctgtccataagtattatgcaaccacgtggcagccccagagttgctctgaacctattctggttcttagggttgcctgattcataacttgatttttgctcaattaaactctgttaaatttagtttttcttttcgtttaactattctattcatagctttttttttcttttttcagagacagtctcactctgttgcccaggctggagtacaatggcacgatcatagatcactacaaccttgaactccccggctcaagctagcctccagcctcagcctctgagtagcaaggactgttgccatcatgcctgggtaatttttgtattttttgtagagataagggtctcactttgttgcccagggtggagagcaatggctattcagaagtatgatcattgcacagtacagcctggaactcctagcctcaagggatctttcctccttggcctcccaaagtcctgagattttaggtgtgagctaccacacacggccctattcatagcttttactttcgtttgtaattgtgcatttgaacagtgcgttattgaatgactgactttcacactagtctggaagttcctttatggcagacaccttgttttcctagggtttagcacactgactgtcacaaagaaagcatgcaataaatatttaatgaacaaatgaatgaattcatctctgccttatgtgtgcatttagcacacatgatagacactccataaatacttcttcacctaggagaggaataatcctttccatcgcactctgtcccccttccttgcttaatttgtctccataagacatagcaccagatgatatatttttttacctatacaacatattttacttatttgttacatagaatgtaagtgtattaatccattctcatgctgctataaggacatacccgagactggctaatttacagaggaaaaagatttaattgactcacagttcagcttggctggggaggcctcaggaaacttataaaatcatggcgaaaggggaagtgaacacatccttcttcacatggcagcaggaaagagaagtgctgagcaaaaggggaaaagccccttataaaaccatcagatcttgtaagagctcactcactatcacaacagcctgaggggaattgccctcatgattcatgattcaaccacctcccactgggtccctcccacaatatatggagattatgggaactacaattcaagttgaaattcggatgaggacacagccaaaccgtatcgtaagcttcatgaggataggagttactttgtctgttttaactactgctatatccctagaacagtgtctggcaattggtagatgctcaataaatacttattgcatgtatgtatgaatgaatgaacaaacattgttttcccccttggactctgtcaaaagcttttacttgtagctttgaaatccggaggcacctcaccttttcctgtggttttcttagtagtttgtttctacccttcattcttccctctcattttctctgcctgttccctctgtgttattagagaggcagatagcaagcacattctctttattcattcttggagcaggataaaaggcatttttctgggctcccagtaatcttgaaagggcagtgattcgcctctcttctcctaactcgtaaacactgtaaatgtgtccctcacatgctcatgtgctgcctggattttggctcattttctactaatcccctgaaataaaccatgagcacaagtctcatgtctgtaaatccccagcttgataatagggcctggcaagggtaggctctcaacaagcgtttgctgaggaaaaaaaaacaaaacaagatgaacctctgttgtcactgtttgaacatctgtgagactccaccccacaagattcagctcttcctgtgcaggaacgaggcctccttcattgctgagtacctctggagggaactgatgtcctgcccaagtcattggtcaatgagtgtttgccatatggaaaaatgctccacatcactaatcatcagaggaatgcaaataaaaaccacaatgagataccgtcttgcaccaatcagaatggctattattaaaaagtcaaaaaataacagatgttggtgaggctgtggataaaagagaacgcttatactctgttggtgggaatgtaaattagctcagccactgtggagagcagtttggagatttctcaaagaactgaaaacagaactacaatttgacccagcaatcccattactggatatatccccaaaggcaaataaatcactctaccaaaaaaacacatgcacttacatgttcatcaaagcactgttcggaatagcaaagacatggaatccacttaggtgcccatcagtggtggaatggaaaaagaaaatgtggtacagatacaccatggaatactacatagccataagaaaccaaaatcatattctttgcagcaatgtgggtgcagctggaggccattatcctaagtgaattaacacagaaacagaaaacttaatgccgcatgttctcacttataagtgggagctaagcattgagcacacatggacataaagatgggagcagtagccactggggactgctagaagggagaggaagggaaggaggcatggactgaaaaactacttattggctaatattctcattacctgggtcacgcgatcatttgtactccaaacctcagcatcgtgcagtaatatgcatggaacaaacctgtgcatgcaccctctggatctaaaataaaaggcaaacattttttttaaatgaatgtttgctctcaaaacagtttccaggcagctgtgaacttttcattaagtgtttaatcttgaaaataatttatttccattttatcctctatataaatgaccatttcttaggtcctagctgttaagcctaaattggggtagactgaataatggcaccccagatatgcccacaacctatgaatgctaccttttatgacaaaagggactttgtagctgtgcatgatattgtgaaatatatatttggtcttcctcccagtttcctggcatacaacaactaaaatccttggaatctcccaagtgatatggatctttttgtatgataatgagttgactgattgttgggggctcctgaatagcctcctgatgggtgctggttgccaaggaaaccaaccccatgtttagagggtgatatggtttaggtctgtatccccacccaaatttcatcttgaattataatccccatgtgtagagggaaacagggaggttggtgattggattggggggcagtttccccatgctgttctcataatagtgagtgagttctcaccagatctgatggtttcataggtgtttggaagttcctccctcattctctctctcctggtgccttatgaagaaggtgcttgcttccccttcaccctctgacatgattgtaagtttcctgaggcctccccagacatgcaaaactgtgagtcaattaaacctctttcctttataaattatccagtcagtctcagggatgttctttgtagcagtatgaaaatagactaatacagaaagttggatggaaccttcagcatcccactctccaacctccagggaggggaaagggactgaaagatgaattgcccaccaatggtcaataatttaatcaattatgcctcataacaaagcttccataaatacctcaaagggctgagttcagggagcttctggatagctgaacacgtggaggtccctagggcacagtgtgccgggagaaggcatgggagctccgtgacccttcccatatgccttgctctgtgaatctcttccatctggctgttcgactgtgttcttcggaatatgctttattagaaaatgatcaacataactaacatgattccctgaattatatgagcaactccagcaaattaatctaatctgaggagggagtcatgggaaccccacttcatagccaatcagtcagaaattctggaagcccagccttgagactggcatccgaggtgggtggcagtcttagggactgagccctcaatgtgtggtctcttaggctacttccagtagacaatgtcagaaatgaattgaattagaggacagtcagccagtgtctactggagaattgctcacctggtgcgtggggaaaaatttccacaaatctagggtcacagaagtgttgatcattgagggaaagaacaggacaaacacttttttttttctgactctcaaactgcaattaatttaaagatcttgagacagagaggctctcctcaattatccgggtgggcctgatgtgatcacaagggtctttataagagagtcacagtagaagagagtcagaagagaaggcagtgccataacagaagcagcgactgattggcagaatgaactttgaagatggggggaggggccacctgccaagggatacaggcaaccactagaggctaaaaggcaaagaaatggattttcccctcagagcctccagaaagaatcagccctgttgacacattgactttagccctgtgaaactatttcatacttcttgcttccagaactgtaatagaatagatgtgtgttgttttaagccactaaatttgtagtaatttgttacagcagcaataggaaactaatacaataaatgaatgattgtttttgtctcagagggcttatttatttatacttgaatttactctattaaaaaatttcctagggcttggctcagaagtcccccaagggaggagccccctgttctgatgttctcattgctttgattgtgggcctcttttccaatgtgccccctgctacccagtcacatcttcagctcattgtctctgccagagcttgtaagcagaccacccactccatctcttcctcttcaccctggcgctggcccatcctttgtgcattttgctaaaatgtcatcctgaacaaagaggctcggaggactagtacagttgactgggctgagcttcattagggaccactgatggagcacccagcccactcagacactcaatgctgaccaatgcagaatatttcttaaatcagtttcattagcttcccttttcaaggattttagactaaaatatgttaatgctacctgttcagaattctctaagaagcactatagacaggtataaagcaatggcaatattttgctttctggaatatcttcaaccattacttatgcaacataaatgtgcccatggaaaaccttgtgcactcctggcaacgtggggctaacatgggcatgatagactgtataaaggcaagagtcttgagacacctggagtggtcagaatttgctagaaatagtgtggttgggaagagtcaacagaaccgcttgcagggtcctattcctgtagaaccttccacacccagctatgtgtacagagctgtgttaatgatactagtcaattacttcaccaatatttacagcagttgcttcaactctttataaacggcatctgttgtggtaggggctgggttagagcctccagaaggaattgcttgtgagttcacagcttgggctgtggagacaaccaggagtaagtgaggcagtttccagtggagaattccacctgcatggacaagcctggggatgggcgcttcagatttgtaataggagaaaagctggcttccaggacggggagaagggggaaatgtccaaaaaaaaaaaaaaaaaaagaaaaatgaagggacgcattccagactcctacttaaacatgaccaggactttggtttttcacaaatttgccccagcctctgcttccttttcttttatgggggcaaaaacaggagcttttcagagaagagttttgtttgtgatgacaatttctgttttaaaaagcaaaacaagtgaaaatagagcaaattgggctaaagtctccattctgagcgttattctaaaaccttcattttcatagagctatatagtttataaagcattacaatgaaacatcattctgaaattgttataatctttttacaaacaatttagtttggagaagaaaaaatctcggaaagattctctgccttctccaacatcacatcgctggacagtagcaaagctgggacataagcccatgttcctaaatccagcctagtgttcttcccctacaccacagcaacctgtgggccagcaaatgcataaataacacttttgttttaatgccatgcaaatttaaatttctgatttcaaattgaaagaagctccccattttcagctggtaaagctgaggcctggagatgttaagtgatgcttttggaggaagggctatgactgggtcattggtattgagctgtcagctttgcacagcctgcagtttgattaagagccagtggaagaaaattgagaaagtatagagatgtagaaaacatacatttttcctctgcatttcctccagttactgttcccacctgactaaatgctccttttgtgtcctagctctcttttcctctccaatgctcaagaacattgccccagcagttttctctttgctccttatgatcagttccttctctccatttgataattcctattaatagacatatgtgctgtaatttctgccatgttttaaatgacaaaataccttctcttgacttccttatccccatctaggtgctaacacccttccacattcctagttacgacaagattccttgaaagaattgtctacacttgcaatctctattttttcccatcacattctgtctaaagtctactccaaaaagcttttactctcaccactcctttgaaaccaccatgttgcaatcaccaatatcctcacattgctaaatttaatgtaatggtcaattctcagtcaatgctcctcatttccaacccctggaaatgttggagtgccccagggctcaaatcacagacacctcctttggtgattttgtcctgcatcctgggttcatatatcaacaatatgctgatagttttgaagttttcatatccaggctgggtcagtcctctgaactccacattcatatatccaactgcccacttgacatatccttttaaatgaataggcaaatcaaacttggcatgatcaaatactaactcctggtatctaccgctccccgccccgaccccaaattctgataccttggtctatatcttacttccagttgatcaggccaaaagccccatggtcacctttgacatctctctttcacacctcatatccaatatatcaggggatcctgttggttttttcttgaaaatacgtccagaatctgacttaccacttccactgctagcattcagatcttaatatcttaccttgattattgcaatagtctcctaactgatctctctgcttcctccctttccctctcctgcagtctaatttcaatacaatagaaagagtgatcttgttacaatgatttcaggtcctgttactccatttgatgtcatcccattccacttagagtaaaagccaatgtttttaccttagcccataacatcctacacaagctgtcctcccacctaccttctctgatatccccatgctcatgactctccagacataactgacctcctggctggctttcgtatatatcaggcatgctcttacctcaggtctttcgtacttgcctttcattccttgtgcctggaattctctaacccttattatctgcatagcctttgccttcaactccttcaggccttttctcagatgtctctttatcagctcttctctgaccatacttttttttacaattgcaataccctgctcaccagcattcactatcccctattcctgctttatttttctcagtatcatttattgccatctggcattttatatatatatatgtatataaaatattaaaatatatattatatatattacttctttgcttattatctgcttccccatccccactagactgttgtctatttttcttactgcagaatcctttgtcagcagacctgttctatacctggatacctggatgagatgtccttgaggataatgcctgacctttcttgaccatcaaaaaagtttgtcagcagaagttagaagtggaggtatggatctcatgccacatatattccattcactggaaagcaatagcctttctcacacattcacacaccagactttgtgtttgcatagcctcttgttgagtcgggaactcatttcttgtgagcctcgtccctgtgagcatcttgacacagttgagtttctgggccaacagagctgaggacctggaccctgaaaagcaccttgggactctctgcctgggatgccagctgcctgccctcaaacctatatatatatatatatacacacacatacatacatatgtgtgtgtgtgtgtgtgtgtgtgtgtgtgtgtgtgtattacggttcttaaatccagcttcagtaagctatattagagcacatttttttcgttttgttcctagaatcttaagtgtaactacaaattagccccaacaaatgaggtgtatggtctatatataagatatagttaattctcttgtgtgataggcagtctcagttttagtctaagcagatttcagacatatccagtgatgtatgaactggtgggatggaatcagcgaaagtctatttgcctagtgctgaggagcttcctgaggaggaacttaggttgagggaacagtaatccaggcacagagagtctgggaagacaatgaaatcttagcatcttaagggggaaattctgagaacatcgtggtgtctgtctcttgcatttgtctctctctcttgagcctgccagacttatcttaaggaaagcaagagtgaggtccttaagtcaaaactgaaaaaatagtttcattaaagtctgctttaaacactgggactcaagaaattctcatggagggtaacacaaagcagagaggcattctttctcacttgaccaagaaacatgagagtcttgacacccctgggtttccagtgacttggtggaggagctggtaggagagtgggggcacacagagaagtcgagtggcagggtcccccaggagggctggaggctgagcagggacatgctgctcctggtaggcacagaatgggagggagaaaaaccacaccgcctatgggagcagacttgtaccgaactacgtgagataacccatgagggctacaggacattggaagggcattttgcaagagctgagacccttcatgacaggtgggcacatgaataagtggaacttgggtgttattaaggcaattctatttctacccacctgctgaggaggccccaggaaactcaggataccttccacacctaggaaaagtgtttaccttgcataatgagtttcttaaatattaacagatacatccaccaaacatatttttagaaaattttccttaggttgtcttccagacccaatccttctctctccaggcagctttctcagataactctaatttgatgtttccacttgctcttgaatagctcccacccggtcggtgtccagccacagctcctgcccttgcccatactctatgttacactattccctaattattgcaggatatctttatcttgtgtcttcaatgaagctgggatgcccttgaaggcaagggcacatctctaccttctcttgtacctatctagctcagctaggcatgtcacaggtgttcagtaattacttgttgattacttctttactttccagaactgtttttcagattatactcagtgtggatgaagaaggaaaaccccaggtatcttgctggattctagtgttttaggagcggaaaacagatccaaaggccaggttgtcattgaaaaaaaaaattctctggcttgaactgaatttgaaatctacctgctaacaggatttttcagatagagctcaactgtggatcctctttgtgtggctgaatcagtcttatattcagatttatcatttgtatattggagatacttacaccgaatatacccacctgagaggtagcacagcactgtgccgaactctggtagaaggttgctgaggtatgaagtcctgctccaccagtttacaaatgatctggctggggactattactgaacatttccaggtcttggtttctccatctttaaaatgggtatgatgatgacgatgattcttacctcttagggtcataagatgattttatgagttaattcatatgcaacgtttagaatgaagcccagcatataatggattgtacattaatgctattatcaatcttacataagttttgatttaaaaatgagtgtagagtacccataacagtaattatcgcttaatgtatgttagctgccattctctcatgatgaacaagcaagtactacctattttaaattattaaaaacgacagacatttgttgttaaatacacatttttaaaattattaaaaacaacagagaaaaagaagcactcattctcattctcacaaattaatttgtctatactgagcctgatcccaatctataaagaatctgcaggaagaaaggaaatcaaaatcctgaaactaagaaaggagagccctttcccttacttcgtatcagagagtagaacatttctgaaaattcacagaaagctttttttagaacagaccattcaattctgaaaagaaagttcttaaaattgtctatagtgtatccctgagcatcctgaagattttaaataagttgtcacagcagcttcacccagaggctgtttcatcaaaccacaaagtgacactcccagcccccaagtgtcctgtggagagcagaaagatggcagctggagagctcacccagcaggaatcgttgcccgcatctgctgcactccttagaattcctggagagaaacataccatactcctggcatgcttctgatgcaaaggtggggattctaagctgctatagttttttggacttctttctaccttaaaggcaaggaatctctgttgttaagttcataaagatccacccccggaccccaaccccgcaaaaaaaaagaatatattttcaggggatatatttcagggcatgttattcatacagatgaaaagaaaggtgattccaccatgtagcttaaaaggtatgtgatatttctgcgcaaattgtcaaaaaaatatgatgttacccaaaacattatttataagaagtgatggctgtggaaataataataataataataataataataataataaagcctaagacataattttgagaaaattgaaggctaaggctgagaaataaattcttactgggattatgctagtgtatcggaactgcttctatgactctatgactcctgaagcctgagagcttcaggcaacagaggccagaggctcagaacaacacttggggacctttctttatgaaagtgaaatctacctccagggagcctctttctcacctcccattcactctctatctttagcaatcagactgtggaattctgactcactgaggttacctacaacatcccagtggccaaatccaaaggcctcttttcccattgttatgttactagattctgtccagcatttttcatcattgacacctctttcccctgtctttgcttgggctgatataacaaatataccattgactgggtgatttaaacaagaaatttatttcacaaagttctggagactgccaagtccaagatcagggtattggcagatccagtgtctggtgagggcccccttcctggtttgcagatgtctgtcttcttgttttatcctcacaaaggggagagtagaaagagaggaagcaagctcttgtgcgtctcttcttataaaggtactaatcccatcgatgagggctccaccctcagaacctaattatctccccaaggacccactccaaatatcatcacaatggagattaagcttcaacacatgaatttggtgggagcgcaaacattcagtccacagcaaaacctaatctctctctccacagctcccatgtctgtcctggttctcctcctccccttatgcctggctcctttcagcctttttctttggtcttcccttttctctttttcctctaaaaataggcttcttttgggttgcaactctcacctttatctgctacctcccagaccaccccatcccaggcttgattcttaattcctggacatctgcagctggatatcccacaggtaaattgacaggcacacattaaattcatcttcaacctctcacaccctcctcaaatgtgctactgctatgatattctcttttttggtctttggaaatattgtgcttggcaatggctttgctgaatgtaccccctggtggccgagagaaggaatcactgcagccacactttacaaaaatttttccacccggggcttctttgcatcatgaggtcattgtcaaagaagccagaacaaagagaccccaactgctttcatcccttcttatgaaaatgaattttcattcccgactctctctattattctgtgtcctatgtgtccgaaaatttataaaaataaaaataaaaaataaaggatttgacttttctcctgataaatcaaaatggcaaaatggcaaactataaaagtttccccacctcatcttctgcctgctctcctcaccactgtattttccacatggaacaagatgtcacttatatatgccaatggatgtcatggacaaacaaggaacagggaaagcccagaacttctcaatgctcattggcactagaacatagtagtatacttgctatttttcagaggtgggatcttgtgaatgagaccacaatttggcacagaaagtagtcattgccactgaattattcactcgagatgagaatttattctggtgactggaaatattccagtgttgctttgagcaaaaggaacagtgaccacatcccatgaagctccatgtgatggcttttttgatatgtcagcttagctaggtgacaatccacagttattaaatcagacactaatctaattgttgctgtaaagaaattttgcagcagtaattaaaattcctaatcatttgactctaggtaaagaagatcatcttgaataatctgggtgaacctgacttgattagtttgaaggcccttaaaagcagggctgaggcttccccaaaagagagaagaaattctgcctgtgaggaacaacttcagcccatgctgtggattccggtgtttctatgattttccctttctgagcacctggcctgtagatttacctgcttagtcagcccccacaattgtgtaagccaattctggtgtatccgtttgctagggttgccatgacaaagtaccacaaactaggtggcttagaacaacagaaatttattgtctcatagttctggaggctagaagtccaagatcaacgtgtcagcagggatggctctgtctgagggctgtgacgaggagtctgccccaagcctctcctctagcttctggtggtttactgacagtcactggtgccccttggcctgtagataatgtattgccccaacctctgccttcatcattacacgatattctccctgtgtgtgtatgtctctctgcttccaattttctccttttaataaggacactagtcatactggattagggcccaggctaataacctcattttaactgattaactctgtaacaaccctatctctaaataaggtcacattctggggtactggaggttaggactctagtatattttggaggaagatggaattaaatccatatcacctgcttctccggttgaaccctggattatactctgtgtgtatcaattggtccccaaaacagcttaccagaaacattggtttctccatttggcacatctcatgtctccagaaacattgattcatcctctgatatggagatgtttaaatctgggtatactgggtataagtatgatacaattactcagtttccacaaagacagccagggttggagatttatcagaaaatgatttatgaagctattgttagaattctggggcacctcagccagctagactctataggtatttcaaatgaggagtggggcattttaactataacctggctttgccatctgcagctgcttaatacctaaaaagaatgaacaacttggaaagcagataattggctttgtggggtttggaaagaagaatcatgggtatgagaatgtgtaaggaagctggttaggtagttcgaatgtccagggcctggaactggtgaagatatttcatgtttctatgtctctgttatgtactgcacacttgcttgtggccaagtgtatcttatctgatttaatcctcactacattcttattagggatgcattgttttcccttagtagggttgaaaaaaatgagtctgaggtgactcttaagattacacatctagtaatgattggccatcaggattcagacatacagtcactcgttctttgtgaactccctatacgtgaattcacctactcactaaaaattatttatagctccaaaagtgatactcatgttgtcctcaggatcattcataggcatgtgaagagtgacaaaaaatacatgttgttagacacacgtttccacacgaggtaaaacaaggcaatattttgccttcttgcttcagccgtcatcctataaacaaatgtccttttcatggtctatttagtggcacttttttttcatttctgttctttttattggtgacctcaacctttaaaatggccccaagcatagtgctgaagtgccgtctagtgttcctaagtgcaaaactctgtggtgtgcctcacatagaaaacacacgtgttagataagctttgttcagacatgagtcatagtgctgttggccatgaatttaatggccgtgaattcattgtaatgaaccagcaatatatattaaataacatatctttaaacagaaacacacataaaacaagtttatgtactgatcagctgatgaaaatgtaccttgaaggcacctaaccttgtacatttcctaggagggatggctgagtattctcttattcagtgtccatggtgacttgataggatgtaattactgcagatagtgagaatcgactgtctctgtgttgggctctaaagacctctaattcacatcacaaggattagaactgggaaccaaagagttggtaactctatcttcttacctgctttaggaatgaaggagactgtagcctgaaagcccctgcaggtcccgttttcatctgattggaagctgatgagcatgatgctggaggggctcagcacaggggtggggacatcatagccacacagccgagcttgttgaaggccagcccaggcatgacattgtcaagcacccagcagatagccatggcattggagagaagaaaaaaagaaaatcatccttcaggtaattgttgagaaatacgcttttcacaattcattttctaaataaaggcagctcactccttaattaaccccatgacatttcaatttggttttctctcctgaacactcccacacacaatgatgttaagggaactggttctagcctcaggacttgtttcaatggaactttccctttctgactcctagtttcctcatgggccttttgcatttctgtttcagtggttctttgattctccctttttctcttcctgcccctaatgaagaagacaaaggagtgatggtgagaccacagggaggggtggaggtggtgcaggaagatggaggaagattgatctgtctccttttcgttcccatctcaagactgggtccaaacacaaaccagagcgagctgaggctcagaggacacaaacctatttccttcttcctttctacatcgctgtgcactgtcacatagtcggaagtgcagtctccactttcttctatttccagactctgaaatgaaagctgagaagacacgaagttacatccagagtaaacaatctgaatgaattacctgactttgattcagcagagaaatttggattgctcaacttgttctggagtaagaccttagataagaaagttaatggggtattcaggagtgggtcagattaccaagggaaggattctatatcacaggctctaactttttgaaatagctaccaaatatggcctgaatcaaagggcaggaaactgtgcaaatattttagcttcctaacatctctaagagattaggagagctaccgcatggggatttttttccttggaagcaactaggcactcaactcaactaattgcatatacacaaaactgcttctctggacatcttagtgttgttcacctggttcctgatgtttcatcttgaacctctagttctcctgaatcaagactgaaatttgttgtgccccttggagaccgtgtctttctacccagcgggatatagctggctcctcttctcacctgctttgtcctgttgccactatatttccatgcctcactgcaaaattctgagaaggcacagatgtaagtgagtctaattgctgatataaaacaaagtatcatctgagctactgaaagcatttgcataagtgggctcggagtcaaatgtagtgagcctcatgaatgtgcatgaaaaaggaaatccttgtatgagttagagagagctgattttggatactaagcttaaatgtaaacctcagcaaaattcttgagtagattattaagctatgatgagtaatgacctagaaaagaaagttgatcacctggaatcaacctagggtcaccaagaataaatcatgacaaaccttttctcatagtttctataattgtgatgcttattggcagcataatatttcatttatctctatccttgagacctgtattttttgctatcttaaaaacttggcagtgaatatctttaggcatttactttttttcttctcttgtatcattccctgcatggggcacttgttttgtttcaggaaaagggaggggaactatctagatagaaggaacagtgtgaaggagaaacaaagaaacaataaagagtgatcttggagcagtttggtgagcactagccaattgaatttgaagtgaagagtggtgggagagagggctgatgaaataggaactctaattttaacacacagttgatggggattcaatgggacccagactctgagcaagaaacagaaaggattgtgtggataaaacaaaactggaggcaaataattactaatggtaaaggtaggcgtggggagggggacctgtatcagaaataggattcattcaaacatttattaaacccttactgggatactttctgggaaggggcccttttctctccaagtcaaatggtgagcatattcctatgacttttaacaccagtttccaaattactatcttacacgagttctgcaaaatgatgctgtcactggcagagtatgagagcatcgcttcactgatgcacgacactcaaactttacttattgaagagatatttttcaatcacttctggctctggcattttcagattttcaactaaatttcctcttcttcctccacctggaaacatgctcacaacctaaattttatcctccaccactaacaaattttccttaattctgctgaaatttttgccccaaatctgtttaggtttgatgaacttttagaaagaaatctataccaactgcctctgtatcatcttttcccactcattcataaaacctgtgtgatcttgtttctgccattaacatctgacttcacgtgatatttcagataccaccaatcccaactcctctcaattgttcaatttcccatctaattattctcccttttttatggaggtgtggggtggggactggacacctcagttctcatctctttaagttctaacttagtgtggtatccaaatgattggtcacatctttttctttggttttgtttgtgttttaagttaaaggctgcattctccaggctgtcataaaaacacaccaatttggttctcctcccacatctcagagttctttccatctcttaagtgagaacgctggtgtctcatcatccctcactcctctcccctttattttctgctctcttttctctccatcgtacactgtcttgttttcaattattattttaaaagaaagatctatgagaaaatgcctcattccaatctcaccctgactgcagtcctacttctacctccctgatgatatctctctgcagatggtccattagtgtttaatgaacaaacaactaaccacacactgctaatcaaatgtggaataaactccatttccaggcgttcaaaggcctccatacagtgacttccaccttgccttccactgtccactccaggacaccttaagaccctcttaaaccagcgattccctgagcctgttctgcgctggttcctctaggcttgctctgtcctctctgcttgaaaggcttgatgattttggcctgattgaccttgattttgttatctataacttacaatgtgttttgtgagcagtttaataaataaggaagacatgcttgtttctggaatggactaaaagtcaccaacacaaagtttttgttttgttttgttttgttttgtgttttgagagtttcgctcttgtagcccaggctggagtgcagtggcgcgatctcggctcattgcaacctccatctcccgggttcaagcaattctccagcctcccgagtagctgggattacaggcgcccgccaccgcgcccggctaattcaatacaaagattaaagcggcactttttttttttttttttttttttaaagtaaggagcacagtgccatctagtggaaaaaatgtgtagttgcaggggaaactgggcggatccattattcagcaagtatttattgacagctttgtgtgtcaggtgctgggttctaggtactgaaaacacagcagtgaataaatcagataaaacctctgacctcatggtgcttatgttagctattctgtgaatttaccatagctacgtaaggacagccaaagtcaataccttaattaggtgatgtttggaggcttgaaaaatccagtcacagttagccttgtcactgtagttttcaggatagtttagactctgtatgagaccttcttcaaaaaggacagttaagtaactgcaacctgaatctgaaacgtaagaaaaagtccaaacagatggcaccattcaaataaagaagaattctcactgctctccctcctgtctcctgaaaatgatgcatatcaattgcattttcagacactgcgaacaagaaaagacgtagtgcatgattctccagaactcatcaggccctctcgactcacttggaggggcaatcactacgagctagcagggtgaactcagggttgagggggagactgccccctgttctctagttggcctgtgcccctctcccatgtggagtcagttgggccttgggagagggatccctgccactcacctaattcctatggggcctaagcttctacagaaggtggagatagtatgtgattaaaagtaaatggttttaccaggaatgtagtttggtttaagagctttataggtaagattaaacccagctgcattatctgtggcatcagagacgaatttcagccttagagaattagagccaataagaatggatgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctacttgggaggctgaggcaggagaatggcgtgaacccgagaggcggagcttgcagtgagccgagatcccgccactgcactccagcctgggcgacagagcgagactccgtctcaaaaaaaaaaaaaaaaaaaaaaaaagaatggatgaagggaggctttctccacaaaattttcctgcaggatgagaaaaaaggattctttgttcagaatctagaaaatagttcccattcaatgatttaagaagaactgaatttgccatgatatttcaggattgtccaatccaaagtttctcagtcttgtcacaattgacattttgagccagaaccttctttgtgttcttgccatcctgcatcttttgtaggatatttggtagcatttctggcctctaccagtgacaattcctgcccttgtgacaactgaaaaatgcttctcattcattgccaaatgtgtcctgagggttgggggtacaaaatcacctccagctgagaaaccacagaaacaccattccatttctgtttcttgtaagtaacctgtctccttctcatggttgtctatttgtattttccttcttagcttgatgaggcagggaaaggtcattttcacagctaggaaagcagtgagctgtctggacatcctgagaggccctggaatatatctagagtttattcctcatggacaccaggtctggcaaatgggcctaggaagcctggtttgatgggaagcagatttggcaagtaaattgccctgtgaccttgcagccatcacccaggctcagatttggttccttcccactcccaattctgagtctcaaagcggaagtcaagaagtgtggcatttacagatggctgagtgccagacataagataactaggcctcattaagcccacttggcactggtttccatttgacactgtgaaaatccactcaccaatgggtctgtcttctaaagaatacattgacaggtaactgtggtgacaagactcaacatctaggtgggaaaaactgagcaacacatgcatttcctctggtaccagcagggtccagacacaccgtctgtaggcagatcatggagagggcgttatttctagacagaaaacgactatcacagtccaattggtgggcccagaccggaggtgggagtaaggaggaggagtacaaagggggttactcactgcttgctctcataatataggtggaggctttctgggaagtgcagcttcccctcagccccgctgactatgacatcctgctcactgcaccaggctgggagggaaagccaggagagtcagggttagttatgccagttaaccacagcagcccctccctccagaagctgcaaacaccatagcctcctggttcttcttgatgtactcttcgttcttcatgaaatcttctcctgtctttgcttctatgatgcctttttggttccttttagatcctgcttaaccttgagattctatgattggttttctttccttaactcttctctctctttttattttattttattttatctttgaggcagggcctcaatctctcaccgagggtggagtgcagtggcacgatcacagcttactgcaacctcaacctcctgggctcaggcaatcctcctgcttcagcctgtcgggcagctgagaccacagactcacactgccacacccggctaattttttgaagaaattatttgtgagacagagtctcactttgttgcctaggcttggtcttgaactcctggactcaagcgatcctcccacctgagcctcccaaattgctgtgattacaggcgtgagccacctctggccctttactcttcttttgctgacctcatactttattctataagtgcaggtatttcccagcttctagccttcgtcctcatctgctctgtctctatgatcccttggaccaggttcattcacaccctccatttcagatgtcatctctacatttctgaacttcagacctgattttttatgacggtttcctagctgtctccctcagaactcaatatgctataaatagaattccttgggtcagcaaaactgcacccacttctgattttattatttttgtgtgcccttctcttagtctctcatgctcaaaactttggtactatcttctcttcctccttcttcgttacaacctttcatctaattggctcccaatcctcatttctcgtttctattccttccttttcattctgtggatattgccttggttcaaaccttcatttcttgtctctcaaactaatgaagaatttcatacgtccatgcatttgtcccctcgcaacccatcccctacatgctgttcttacactattaaaatatagttcaaacctacttatctaattaatcagctttctattactcaatcgtatccaaacttttttggctagcatttaaagtttccatagtttgatctcaagttatgtttctattcttctcccttataaatcctcatcacatgccctgtgcttttgttgctgtcttcatccttaagacctttcctttaataaggatgattccttgagctggaatatttttctttacccatattccatttccacttgacaaaatcctactcctccttccagttgcagcttcaaagatgtctgtgcatcagagctcccctgtgagtttatttgttttcagctagaagcagcctctcattcctctgagctctcagggtactatttttctatattgctctttgtagatctttccacgggttcaaagaacaactaaagatttgaactaaagtgtcttagagaccatctggcccacactattttctttatggatgagggccagagttaggaaaaggctcgcccaaagtcacagagtgaattcatcgcaggatcgcaatggaacaaaggggatgagaccctatataagtagggacactttcagggcaaggtgtgtagcttactgaccacatcggcactgccttgccctctttccttgagtctctgattccaagctagtgtttggcaaaggttggctgaattgggacagagctctggattgctaagaaatgaaatgggagggcaactggggcttctgctgggcataatggctgtaggtgctccaggtggtagttttagacctactgagcagggagcgctcttggagaggaagacttcaggaactgatattcagaaatgctagatgttaatttgtgctcctgatggagcagcctgcaagggatacccacctctggagctctttctccgattacctgggaaaggaaaagaaggatgcaattgaaagcctgtggtatcctgaacaacgcttcaagaagttagcatcttcttggcgcacaagagatttttaagtcaatatgcaactaataaaaatcttatctgtggaaagaagggaagggataaatggataaagtaggaaagggcctctggtgttttaaaatgatttaattctctttattaagtgggctaatatgaaatggtaattaactggaggtttcacagaggaaggggtcattttacataagaacagaggctagagatggaaatagtttgtccataactataaaagagttgctgggttaaataggtcaaactttaactgagggctcagatacctgccactgtaccatacacttgaaaacaaactcaaattcctactaaacttaatttaaattaacttgtttagaaaaggataaaagcctttttgaggttggaagccaccagataagaaaacaattaagttggatttggaggaggcaaagaagttgcaatgagctctctagtcagtttatcacaagggtgtacactcatccctcaatatctgtgggggattggtttcagaacccttgcagataccaaaaatccgaggatgctcaaatccttagattaaacggcatagtatttgcatgtaacctaggcatgtcttcccctatgtagcactctaaattgtctctggagtgcttgcgatacctaagacaaagtaaatgctatgtaaatagttgttacactgtatttttaaaaatttgtattgtcattattattgtactgttatttttattgtttttatttttctccaaatatttttgatccacagttggttgaatctgctgacatggaacttgcagatacggaggcctggctgcatgtagatcctggcttttgcagacttactatacctggatctacgccagggattctcattgttggtactattaaccttttgggtgggatcattctttgttgtgggaggctgtcctgtactttgtaggatgtttagcagcatccaagtcccctacccactggacaccagagccactcctcagctctgccagttgtgacaattaaaaatgtcttctgatactgtccctggggacaaaattgcccctggttgataactactgatctgttatagtttgctggatttttttgagaagtaagtggtgccatcgtgtaatggtgagcactctggactctgaatccagagaagtaagtggtgaaagcatatcatcaactgagatagtttcaattaaaggccagtttgagaaggtctaggatggatggattcatttttcattgaatatctgcatgctgctccacataccatattttactcttgttttatttagacttggtaaacctcacaatccttgtgtgctacactgagaacagaggtagagcctgttggttcaggtgctctgatttgccaggactctgctgatgctgtctctggccctagcagaatggcagcttcttaaccttgtgtgatggcttagttaccagtttggatgtgttcgtggatccagggaagcactttactaatgtctgtgaagatcccaggggatccttgatcacttttcctcacattgtttctccagcctcgaccacagcccaaaccccaggaagtcacaccagccagagtccaggcccctttcttattccggcacatgagtgaacctcctgaatctccctgcagagggaaaaagcctctattagcatcactgtcagtgtctatgccccaaaatgctcactgtttcctcacaaggatgctggaggaggatcaatgacatctcctcacttctaataatttagactcagggtcctgtgtatacagatcccagcacaattcccatatgatcctcaactatcactggaacccaacaatcccacctcccttttcctcatccatggctttcatcaaagcagcagactttcttctttctctcctctcatgctgcagactcagagaagtcttggccagcaatgagactgacttcaggccttggttagtaggaagaatggaggaaaagtgtaaagttcccaacatccacaaactggaaaattctaaataggaaagagtcagccatccttcaggaatgggagaaccccgagttcattcttggcattatctctgttatttggtcttttggaaaaagcagaagacctcttttaaatcacacttcctgctaaaaacagattgtttccactgtccctttattttgatgtaacctcccttggtactcctaacccttctttccagattcctgccttacctggaatcagtcttcctgcagcccctcacctgataacaggtgagcctcttagggaaatggtttggatctaccatttttctcacacatttaactaactatttgacccttatagcttcttcaagactattctttattctacccctccaatatgctttctaattaaattaaatttcactgaaatttaagaaaactagaagaaaacaaaaccaagggaatccttgcctggggcctgacagccccgcagctcccacccacctgacatgcgtctctccctccatcaggaaaacctgtgcaaagaaaggtcttcccactgatgggcctctttagtgttaacagagctgccacacactcttcccaggtcaaaataggcagattcacttcctgcaagacttgtgagaggacgccacctgaaaaacagagagatggaagccccagcaggaactctttcaccctttctgagttgaagatgcatcatttgtgtttgtgtcgcttggcaagacttgaatttctaagtacaatgtgacattccctatctttagaaatgtatgcacaatcgatttttaaaaatggattaaaaattccattttctgattgcccaccagaaagttctgacctctgcttaagaggaatggcacacaagttcttaccttcagttaagcggccccagcctgcagttgtacaaataaaaccagcctcaaattgctcccgcagctctggaagacatatgggccccacaaagtggcctgaagaaaagagcaaggtagggcttgtctcattcatggaggagaggacactataagccactcaccacttggtatccaggtggtcccctaaagacctcatgagagttgtgatagctctgcctggcacctccaggggttacttgtcaattaaagaaaaccttctcctgactccatgtaatgctatctccagaaccacaagcaaaaagagtttcaggtaggactctccagcctaaattcctatctcaaagtgcatgacccagaacgtatactgcaggaaatgtgctatggcacagaggttatagagaacatggggtagacaattcagtatgatcctcaaatgtttaccaaattggaaggctccagccatcttcaaaagggcaatatcatagtccattggtttcttggtggagaaatgtggatgtatgatgacagtttcaatagtgagagtttgctctcctgggtctgtctggcttaagtcatactctccagcagtaacattcaaagtagacacaatgtttctatggaaagcaaagagtaaaatgaatgaatttcattgtgcctctgagtacagttgcaatggttgacacactagcttctttaaaatgatatggataaataatatggggtgtgaggctgctgagcagagaaagtgagaataattccaacactgttagaaaaaaatgcagagattccaacttccagtagaggactagtgaagagtgggttcatatatagccaaggatatgatgaatttaatactttgcaatgttatttgaaaatatctagagaggcacatacattgtagttcagggctctacagctataggggactttattcagctaccctgggaggttgacctgacctaatatcagtgagaccctttgggaatgatttgtgattcccagtaagtatgctacttcaatgtcagagatcctatgcttagtatatattataaggcacagactgcattataactaactaatgttctctgaaaggaacttggtgggatgcattgagatatataaagacttcagcttgccatcctttgagacgcttcattcccagaagtgatgcttctatacaaaattgaaaaaggcatgttttctctaggtatacttccctgactcttggccaaattaggtacctaacttaacacataatgtctctcttacctaccacttgccacattgctgtgagatgatcggttgactcttgttaaaagaagagtcaactctctgggggcagaaatcatgtcttagtcattttggtacctttggtatctagcacaaagtaaacatccaggaaatgtttgcagacttgaaatgaaagaatgactatatgggaacatgatcttgattacagcctagtatacgcccagaacactgtcaataataggatatttggatcacacaagaaagtgggtaaagggaagttgttgggttgagtcccagagaggcaggatcaatgggaaggaagacagggagcctactttctactttactggtctccctttgttttcttttatccatttcttcagatgcataatgaactagatattttttcactgaaatttaagaaaactagaagaaaactttcacaaatccttctttgtaatgctcttttttttctgacttggatgctattattaacttccagttattttaagtaaaaacgaattttacctctgaaaagaatatatgtcatctaccaagtgccatctgacaatgtcacccagccccatttgtgtcatgcaattaggatattcatctgttaaaccaatactcacctatcacacaggtccatgttttaatagggttattgctgatgattccaagggagaagaaatggtggtgtggtcttcactcatgggctaggcctttcttacctgtttgcaatgcagtgagccgccgtgatcacccactgtggtgagacgatgcttcctccacaaatatgcttctgcctttgtttcagagatacctaaattgcaaataccttaaatgaaagcaagttcatgccctgggatccccctaaacacggtgatgaagcctattctcaaaaccagactcagatatcacactcgtaaatgtcaagaatcgtggactgtgaaaagataaagcccagacactaccgctcagaaagaagagtggtgctggcaaccctggtctagatgagaggtagttaatttgagatgactggctgtaagtatgtgtcaacagaggtagcagttagaagtggtgagatgtatttacttatttttataacacagttgatgcagacctgttgctctaacaatatgaacagtgtctgtgaatgaaggtaaaatagtataagatattgcagagtccagctgaagaggtttggaagaaaggcaaggtgagggctggggagcctttcaacacatactcctatttctctaagcctcttagggaaatggtttggatctaccacttttctcatactcttaactatttgacccctatagcttcttcaagcctattctttaccctacctctccaatatactttctaatttttgcttatcctatttgtgatacttgatttgattctaaaatgacttactatgtacaagtaaatactttttcttatgacattcatcacatgccatgatgactattctgtctttcaacccaactaggctgtaggctcctcaaagatataaacttaaccttaaaaatatctatatccataatatctagcacagttcttgatgcatagaagtccttgagactcacctgccagggataggaacccttctccacttggcttcctccaagaatgcgactgaaaatgttaaaataattccaaggctgtaccttaaccagactctgcccacaactgggagctgagaaaaaaacgagacaaactaaatgattagatagcttctaggattgaggtaatatcttctccatttcacccatgaaactgagtctgagactatggtgtatggtgctcagcacacattcagatatcaataaatctttattggatttaattctcttgagggatgaaaagtgacaggtcatttaaggagagtggagtgaagtgtcctgattcacaagttggtactcggatagaggtttgctaggtaatagaagaaaaaactcctccctctttatgtaaaatactttatccctgaaaaagttgtttttatttatttgccctcaatgggttttctgactcctcagcaaagaggtagactagattaaagatgtttaacatcacctggtaactcaaggatggcacatcttctgtccctcctggaggtcatccttttccatattttgaaggaggattagaactagccttgcttcataatcaccatgcttcattgcctacctaaattctgtaattcttattcctcagcttggagatcacctcaaccaggaagtcttccttgatttcctcaaagtgggattgcctctcccttgtgttgtgtagcacgctttcttcaccccttttatagttcttgtcatgcagaattgtgataatgaattatttgcctctatcatcggactatgaactactcaagggaaaaaacttgccttattcacctctgcatttctaaggtttagcttaattcttggcataagtaagcacttagaaacactggatggacaaacaaatgacttttcttgagaacacatccttaagagtatagctatttagatcaacatgttaaaatattcaaagctctttcatacagcttctcatttaatcccactctatgcctataaatgaagcactgttatccccacattgcagatgagaaaactgagaatcaaggagacacacagctggataatggcagagcatgaatgtaacagtaagtgttttgatcctgaacccagtgccaggatgacattggaacaaaagcttattttctaactgtttcagttgaatgagtcataaatactttaaatacaaaatttactatttcccaaattcagtaaagcaaagtcagaaaacatgttgattctcagggttggcacaagtctgaccaaggagaaatcttccaagaactgttttcagcttaagttagttgaaggggaaaaaagaccatttataatatactacagtgaacatgcttcatatttctcagcaagatgattttgtaaaagattaaaaatgcttccaaatccatgctgatttccagaatttgctctatgaaccaagatgggattatgtaatgggttcaagtaagtgaacaatctcagttcacttaggaaaactaagcgaagaaaacagggattgtttacttaattggatacattagttgcattctataaatgtttcaccctgtgtcctatgccgattgcaggagataagtccaaaataattgtttaaaaacaattagatatccaaaatatatttgcttctcctattttcccaaaggaacatggagtctcggagttgtgacgtccattgccagcaaaggttcagacaaaggtaattatagagttcatttgaaacttacctttggggagcgaaagagttgcagatttacctcgttcaaaaaagactattcctagtagtaaaatcagcttgttcctgcttataagcattttgagactcatagtttttccctgaaattttagagagactaaagcaaacaaaaataggaagccttgagagaccagcaataagccaatttaaaacaagtttattcattaaccaagacgtggtgaatcaagcatgtccatctgatgtttctgaatgtagtgtttcgcaaagatcttttggaagatgtggagaaacaaccacagaagcagagtcttgatcaagcaatattacatatcctattacacctacaccaattagttgattcctccagagtgtatctggctagcaaagtggttagcatgtaagatttgcatctgcaaacattacttgctcctttgtagagcttaccacttttaccactttctataagaagattgactatcaatgttgtccttgtttgcaagggtacacttccctacttttttgcaaacgacccatccaaatgtatataatttttttgggcagagatggagtttcatcatgttgcccaggctgatctcaaactcctgggctcaagggatctgcctgccttgccctcccaaaggtctgggattacaagtgtgagccaccacgcccagccaatattctaaaatatttttatttatcttattttgcaaatgtaactacatggttattataaacatatgttggtgaatgagagaagtggaaagatatttgggtgtcacactcaggaagccctgctgttagaaagtcatctaggatactgtacattggggcatttgtgactctgcattctcctatcatttttgtatttatagaagggaaacactaaatctcctttacttctatgcctggtagatgcttgggagagtaaagtggctatgattacctgtacattttcctctttcctcaacgagttttgggcacatggtcagtgtgtgagaaatatttataggatggtcaatgccatctatgaccagatagaaatataacatttttctgtcaacttttataagttacccactaaaaataacaaatgtcagcccaaaagctcttaatttccttttggcaacttttgtctttgtacaaaaaagtatgaaaatacaacacatacaaataatataaatgcaaaacagagaaggtgtaaaaacttaacatttgtaagcactacatatttaggtacactaatcaagaatgtagccttatggaaagaaggaaactcaaacctctattgaggctttatctataactactgtaatcctgatgccaaacatttttggctattggtatggagtgatagccccaagaggtaatcaatcaatgtctaagccctaatcaaagtctcaatctttctttgacagcaagctccctttaaattgctattgtgttttatcaatcacttttgagagcaacttgactaggaatatggcctttctgaccccaaattcactacattctgtctaaaatgtgtatactgttaatgtcaaaagtgcagaaagacctagtgtgggcctaggatgcactaaacttgacaagcctaaagtaggcacatagcataggacaataaaatttgactctatactgaaagaatgatgagttttcctttgtaaaatgtgggagtggagcgtttttattgattgtcacacagaaatatgatgagctcttgcttagtgcttaatttcaggagagggtatttgcttcaagctcttgcatcagcacaactatcagtacacatcaacacactcttcaccacatgaagctggtcattaagagtttgttactttcatctcttaaggggctaaaatgtggcccccttgctgttaaaatatttgctcttcatgggggatgtagcaggttctaagacactatatttttgtaagtccagctattcaaccctcccagggtctggataggaattataataactgtacattgtagttacttgcagacaggaatatattaaagtgttgcttggcatggtagtataaaatcaatttttcattcatgaaactattaaaccttttaaaggggaaaaaatctctcttgagaatcttggaccaaagtctgcaccaaacatggatttggaattcaaatacattgttttccctgtctgtaaatccccaagttgagaaattagtatcaaaatttctcctgaaagcaaaactgtctctcttcacagatgatatgattctatacctagaaaatctcaggtctacctgttataaccttcttctctcttttttgcagcaattatttttgttgaaagaattggttatttagacctttagcattttctacattctgtattttgctgattgcagagctgtgactttaatgtgttcctataaccctgtgatataatccatagctaatgattataacttctgtattgtaccctccaatgaaaagagaacaactccagtatgagcaatctctctctgtcttttcagatttttctgtcaaaacctttcaccttctgacagacctcagaacactccaactttgttgctgtgtcttcctgggtcaatccacacatttgaggttcaataaacctttatagatttttttctgtcttgacagcctcaattttggtcaacagtgccataaacactcatcaccaggaatgttctcagccacctccagtggcccagagaaagtaacagaatgtactgtctggtagagagtcccaggagttgggtttctggacctgtctgcttctcattctccctgaagtttccagccacctggaattgccctgccccatgggcccaaataccccctcacatctccctcccaggggaaaacaccaactggttcttacttggaataaattggagtgggtctactccagaactttttcagcagttttctcctaacaggcatgttaggttgtggttctttccttaattgaattccatctactttttatcgttctagaaatattcataatttggggccactaaaagtagctttccttgttcaggttttccagcactgctatgagttcatttgtttaatacatccttcttatcataaatttggagcaggagcaggaggacacaccgtatggtctcaggctgccaacttaatccaatcgctaagtgggaaccactgaatcctcctttataaacaccttgcatattccctgttgcaactaagagatgacactaaaggtacatgcaaggtaagttgaagtgtaaaataattaagaacaatctgagaatgcctcaaggataatcaaaaacaataagggtatttttaaaaataaattttaaaagggaagagatgatttggaactgagggatgatatgaatcatgcaaaggaaggatcactttgccccttctcactgtttgagtcttagaatagaaatgggagtactccagaaagtggtttagttatacccaggaatttcagcgatactggagaaaggaagagtggggaaagttcctatacatactaagcacaggagatagatagcaaagaaacaaacttaggcaaaagtgagctggccagaaatgagagggaacagaagggaaatcgtgtagggatttgcctgagtcagtgttggcaaaagcaaaaaaattcacacacaggtatgaagaaaacaggaaaataggggaaaggaaacaggagtctgtttggaaaagatacaattagcccccgtattcttgttgaaaacttgatgtgttatgcttcagtctctgtagtttgtctccaagatactagcttttatgaagacaaaattttcatggtatgacggagaaaggaagttagcaggagatgtagatgagtgagaaagccagaaaaaaagaagtagtttaggacaataaaaaagttatctccaacaattatgaagtggtgaaggaggccagttgagaagataaatcgagcaagtgcatctttctttcttttgtgtcagttttgaagctagtgattggtaggagccaaaaagaaaaagaaaaaaagggatcaagtttcagctttccacatatggctagccagttttcccagcaccatttattaaatacagaatcctttccccattgcttgtttttctcaggtttgtcaaagatcagatagatgtagatatatggtgttatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactgtgcagccataaaaaatgatgagttcatgtcctttgtagggacatggatgaaattggaaatcatcattctcagtaaactatcgcaagaacaaaaaaaccaaaccccgcatattctcactcataggtgggaattgaacaatgagaacacctggacacaggaaggggaacatcacactctgtgaatgttgtggggtggggggaggggggagggatagcattgggagatatacctaatgctagatgacgagttagtgggtgcagcacaccagcatggcacatgtatacatatgtaactaacctgcacattgtgcacatgtaccctaaaacttaaagtataataataataaaaaaaaaagaaaaagaaaaagaaagacaaaattggaccaaatcctgtggtctgccagagaaaaacaaaaagcacgcagaaaaagtgacaagggcttagatgatgtgatagcatgatagaaagggtaggggatcaataatttttaaaaaaacataaactgaaatcaagactccaacacatactaatagtgtagccttgggcaagtccatcaagccattagatccttgtattcctcatacgtaaaatatagataacagcatattgggtaattctttggtagttagtggaatgatacccatggggactgtttagactgtgatgtgttacatgacttcataataacactagaaaaattaatcatcttcggaagacgcatgggaccaaaactaatgactattcagtagtctttggaaggattgataaagaaaaataatcactgggtatggtggctcatgcctataatcccagcactttaggagtctgaggcaggaggctcacttgagcccaagagttcaagactgcaaccactgcactccagcctgggtgacagagatactgtctcaaagtaaataaataaataaataaataaataaataaataaataaataaataaataaatgaaagaaaaaagaaaatggagccagcatttatagtaaccttcctttcctttccctttccctttccttttccctttccctttccctttccctttccttcccttcccttcccttcctttcctttcttttcttttcttctttgtttgacggcatttcgctcttgttgtccaggctagtttaatgatgtgatctcggctcactgaaacctccgcctcccaggttcaagtgattctcctgcctcagcctcccaggtagctgggattacaggcatgcaccaccacacccggctaatttttgtatttttactagagatggggttttgccatgttggccaggctggtctcgagctcctgacctcaggtgatccacctgcctcggcctaccgaagtgctgggattacaggcgtgaaccaccgcacccggccggtaatttcctgatgatttaactagcaaggtgggcagtggtaagagcaggatgagaggtagctaaagatatgctaagattcttatctaatttaaagtcaggatttataaacaaattaattatagacattagtagaaaatgtaaaaaaaagtgttagaaccttaagagttatgactactggaagaatagaaatatgatgcataaattccataagattagattataagtagtgaaaagaaggaaagaaggttgattcaatttaaaggaaataatgataggaaaacaaacaacaaaaacaacagtgacaaagaaagcatggtaaatagaaaacaaaattatgcacaatgacaaccattaagcttttttaaaaaaacaaaattagttacattataatagatcatgttattcattgtaaaaatgagtaagttcaatactattaacagtttaagcagtgaataaattgctttcagatgattcctggtgggaagtaaattggcaatgttgcttttaaaggttttattaaaatgaaaagtggcattcacaaagaagtcatagcagtcttaaacatttaaatacctaataacacaatgttgaaatatttaaagaaaaatctgataggagtatgtgaaactgaaaaatgtacaatcatcatgcaagagtttcagaaattgataggtcaaataagtaacaaaaaaagcctgatctaatagattgttaacataaagcactatgagttaaatggtgctaattttctttgagggcaatttggcagaatctgttataatttaaattgtgcaaaccttttgacccaggaatacttctgagagaaatgctggtacagtgaagcattggttggagtatagttaagtaaatactaatgcaatgctttcaaaatgctttcattaaaattgtgaaggatattaatgcatacatggaattatctaaaaaatatttttgaattataaaagcaattttagaacaatataaatggtaaaaatcgcttattaaaaacacatggaaattaggaacaaggaagagagtcttgggttatctggaaagacagcactggattacagataaatatagagtggaaaaaggatgaagtatcttcaataactggatctctatctgaagagtccaagattttgggaaaaaaagtctacataagtggagttgaattgaaacataggtcaccttcatgtggggaaagcattatggctcttcatgcaactaagatgcaactaattatgtaaaaaaaaacaagaaaatgctaaaaaaagttcctggtacctagtcatagctgcttctcagagatggtacagatgagtacagcatagcccacaataattatgttgacccaaatcaagtttcaaaactaattagatctatgcagttataataactgtatacaaataatgaagagaattaatgaaaccccttggatcttaatgaattatctcagccagcataatttcctatgaatacataaacacgcctaattgtctcaatcttattggattttctccattggattttcaataagatgttgacaaacctgtgcaggtctggtgttgaggtacttttggtcttttattccaaatggtcccaaatcctgcaaaaataaaccctgctgcacagagatgattcctggagtttgtcattatctttggcaggcaacattcgttctttattattgatatataaatgccctttgcattgctagtggaagctaatagttgcaattttaagtagattcttatttatggattactcattcattgccatccattgctaggtgttttaacataaatcattttatttaaaatagtgttcatgtgagataaacattattattactgcatctcaattttaaaaataagaaaaatgagactcagagggttacgtaactttcccaagatcatttagtaagtggcagaactgaaatttattcatataaattttggctgaaatcttcttttctttcttaatattttctttttttttaagttttttttttaacttttattttaagttcagggctgtatgtgcaggtttgttacataggtaaacttgtgttatgggagtttgttatacagattatttcatcacccaggtattaagcctagtatccattagttattcttcctgatcctctccctcctcccccatccaccctccaccctccaataggccccagtgtgtgttgttcccctctgcgtgtccatgtgttcttaccgtttagctcccacttataaatgagaacatgcagtatttggttttctgtccctgtgttagtttgctaagaataatggcctccagctccatccatgtccctgcaaagaacaacactgcattctttttttatggctgcatagtattccatggtgtatatataccacattttatttatccagtgtatcactgatgggcatttagattgattccatgtctttgcagttgtgaatagcgttgcaatgaacatatggatatatgaattataaaattataaagacacatgtctgcataaatcatttatatttatatatatgatttatattcctttggatatatactccgtaatgggattgctgggttgaatgtatttctgccttaggatctttgagaaatccccacactgtcgtccacaatggttgaactaatttacattactaccagcagtgtataagcattccttgttctccacaacctcaccggcatctgttattatttctttttaatgatagccattctgactggtatgagatggtatctgataacagtttgcttctgtgccctcacccaaatctaaccttgaattgtaataatctccacgtgtcaagggcgaaaccaggtggaaataattaaatcatgggggtggtttctcccatgttctcatgatagtgagtgaactctcacaagatctggtggttttataaggggctttccccctttgcttagtacttctccttcctgccaccatgtaaagaaggatgtgtttgcttccccttccaccacgattgtaagtttcctgaggcctcttcagtcctgtggaaatgtgagtcaattaaacctctttcctttgtaaatcacccagtcttgggcagttctttataatagcttgagaatggactaatacagtatctcattgtggtttcaatttgcatttctctaatgatcagtgatgttgagctttttctcatatgattgttggctgtatgtatgtcttcttttgaaaagtgtctgctcacatcctttgcccaccttttaatggggttgcttgttttttccttgtaaatttcagttccttatagatgctggatattagacctttgtcagatgcatagtttgcaaaaattttcttcctttctgtaggttccctgttcactctgttgttggtttcctttgctgtgcagaagctctttcatttaattagatcacacttgtcaatttttgctcttgttgcgattgcttttgatgtcttcaatatgaaatctatgcctgtgcctatgtcctgaatggtattgcctaggttgtcttccagggtttttatagttttgggttttacatttgtcttttatccatcttgagctaatttttgtatatggttataaggaaggggtccagttttaatcttctgcacatggctagccagttattccagcaccatttattgaataggaaatcgtttccccgttgcttgttttcgtcaggtttgccaaagatcagattgttgtacgtatgtggtcttatgtctgggttctctatactgttccattggtcatacctcacatatcatactggttggtacttatatcatgttttgaattcatttgggtctctaatgtatttttttacataaatataagattttttccagattcatgtttcttaaccctctgatagaatcctgggactaattaacggagtcagagatttagcattctttcattattttatcaagttaatttatatgaagaattgattaaatcacattgatttaagaactgcttcatagagtatgtttgtcatattcaggttgacaaagaatagagtactgatagttattcaccagtataatttgtagagatattttaaatgttaagatctttcaaaaagtagcaaatatttcatttggccattcaggggacttacacatgagcaatccttttcctatagaaagtaatgacataccttctccctcaatggcagccttctgatacttgatagtacttctcaagtattacttggtaaatgatagaattttttatttggtagtatttgctagttcttttattgtttgacacttgctttttcagtgggtctgactttctcacttggatgccaggatgttaagattaaacactgtaagtagttgcagattaactgagctcattctcttgaggctgaaattacctcaaaactataggtagttgcagatgagctccctctcttttaagaagttcaaaaggatattgagacacaatagagggtggacactggactgtgaaaacgtagttacttcaatgattggtgcttccagtgagaccaaatacattttgaatggacctggaggtgatactcagagtggggtgtttgaaattgatgtgatgaagttggtaaacttactgacaatgacaaagtctgttccatgaccatataaatgtgtgtgaagagtagaagtcttttccctctttatacttctttgtctctttaccctttcccatttataatataattgtgtcttaaaagttatctctacttatattgagaaccacatcagacagtgttataattttggctatgacaataaaaaacaatttagaaaacttaagaggagtagagaaatgtatttatctatatgtttacatctcctgttttattttcttccttcctgctgtttcaagattccttctttgattagttattttctgttttgagaactttctttagctattcttttagggtaggtcagctggtgataaattctgttagttttccttcatctgagaatgtctcatttccccttaatccctgaaagatactagctagatagagaattcacacttgaccgtttctttcctttgcaaataaaaaacttttcttttgacctctgtgattccaggtgaggaatctgctgtcacttgaatggttttctgctggaggtaaggtgccatttctttttcactgcttccaattgtttttctttgtttctaatttttagaattttgattatgatgtatttaagcgtggatttccttagaattatcctgtttggtgtttgctgaaaatttattaaatgtatgggtctttgctaaatttgaaaaattgtaagtcattattccttcagctttcatcatttttctcctctttttctgttgctttgatgacataaatgttagatcctgtattatacaggttgagtatcactaatccaaaaacctaaaatccaaaatactacaaaatctgaaactttttcagtgctgacatgatactcagaagaaatgctcactggagcattttggattttagattttcagattagggttgctccattggtaagtatgatgcaaatagctttctctaattctgtgaaaaaatgactttggtagtttgataagaatagctatgtgtaaatagcgttgggcagaatgtcaattttaataatattgattcttccaatccgagaacatggatttttttttttccattttgtgtctctaatttctttcagcagtgttttgtagttctgcctatagatatctttcatctccttggttagctgtttttgctaaattccttcatcaagaaattagaaagatctcaagttaacaatctaacattgcacctagaggaactagaatttttttaaaagccagccccaaagcagagagaagaaacaaaataactaaaattaaagaagaactgaataggattaagatggaaaaatccatataaaaggtcaatgaaacaaaaaaatgatttttgaaagaatagacaagattgatagaccacaagttagattaacaaggaaaaaagagaagatccaaataagtacaatcagaaaagacaaagatgacgttacaataaatcccacagaaatacaaaagatcctcagagactattatgaacaactctatgcatacaaactagaaaatctagagggaatggataaattcctagaaatgtataacctcccaagattgagccagtaagtaagtgaaaacttgaacaatcaataacaagttccaaaattgagtcagtaatagaaaaaaaatcagccaaaaatgtatatttggttccatatgcaaaattcatatggaaccaaaaaagagcccaaatagcaagagcaatactatgcaaaaaaaaaaaaaaaaaagaataaaataaaataaaaacccagaggtatcaaactgcctgacttcaaactatactacaaggctacagtaaccaaaacagcgttgtactgatacaaaaacagacatatagaccaatggaacagcatagataacccagaaataaagtcataaacctaaaaccatctgacctttgacaaagccaacaaaaacaagcaatgggaaaaggacttctatgcaataaatggtgctgggataactggctagctgtctgcaggagaatgaacctggatcctttccttttaccatatacaagaactaactcaagacagattaaagacttaaatgtaagacctcaaactacaaacatcctagaagaaaacctaagaaataacctctcaatattgcctttggcaaagaattcatggcttagtcctcaaaagcaattgtaacaaaaacaaaaatgaacaagtgagatctaattaaactaaaaagcttctgcacagcaaaagaaactcttaacagagtatatagacaacctatagaatgggagaaaatatttgcaaactatgcaaagtgatgagaaatagaagcaaattggacagtgctaaacagtgacataaagtcaatcactttggccattctgattctcatcagagtctcaaaaacatcattgttgtaagtgttcattcaaaaacctgaattgatcaaatgatgcaaatgtgagtgctaaccatattctaaactgagtcactgttttcttttctttctgtctttatttatttattattaatatacttaagttttagggtacatgtgcacaatgtgcaggttagttacatatgtgtacctgtgccatgctggtgctctgcacccactaactcgtcatctagcattaggtatatctcccaatgctatccctcccccctccccccaccccacaacagtccccaaagtgtgatgttccccttcctgtgtcaatgtgttctcattgttcaattcccacctatgagtgagaatatgtggtgtttggttttttgtccttgcgatagtttactgagaatgatgatttccaatttcatccatgcccctacaaaggacatgaactcatcattttttatggctgcatagtattccatggtgtatatgtgccacgttttcttaatctagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccaaaagtctcaggatacaaaatcaatgtacaaaaatcacaagcattcttatacaccaacaacagaaaaacagagagccaaatcatgagtcaactcccattcacaattgcttcaaacagaataaatacctaggaatccaacttacaagggatgtgaaggaccttttcaaggagaactacaaaccactgctcaaggaaataaaagaggatacaaacaaatggaagaacattccatgctcatgggtaggtagaatcaatatcgtgaaaatggccatactgcccaaggtaatttatagattcagtgccatcccccatcaagctaccaacgactttcttcacagaattggaaaaaactactttaaagttcatatggaaccaaaaaagagcccccatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattctctatttaataaatggtgctgggaaaactggctagccatatgtagaaagctgaaactggatcccttccttacaccttatacaaaaatcaattcaagatggattaaagacttaaacgttagacctaaaaccatgactgttttattttatctcatttctttctttctttctttctttctttttagatggagtctcactgtgttgcccaggctggagtgcagtggtgtgatctcagctcactgcaacctctgcctcccaggttcaagcgattctcctgccttagcctcccaagtagctgggattacaggcatgtaccatcacacccaactaatttttgtatttttagtagagacagggtttcaccatgtttctggtttcaaactcctgacctcaagtgatctgcccgcctcagcctcccaagtgctgggactacaggcatgaaccactgtgcccagccttttctcccatttcattagttgtctcctttttctgctgatttttccctttgccatgctgaaactttttagttttatgtaattccatttatctatttttgcttttgttgtttgtgttttgggggtcatatccaaaaactcattgaccagatcaatgtcatggagattttctcctatgttttaatctagtagttctagagttttaggtcttatgtttaagtctttaatccatttgaggtaatttttatatacagtgtgggatgagggtctctccccagatttgggaagttttcagccataatttcttacaggaaactttttgccccattctctccctcttttccttttggaactcccctaatacaaagttagctctcttgaagtgttccacatagcccaaagacttcttcatttttttattcttttccttttttctcctctgataatttcaaatgacctgtctgattttcctgattttttcttcctcttgagtgagtccgctgttgaagaactctattgcattttttaattcagttattgtatttttagctcaaaatttgtttcttttagtgttttcctatctcttgaattcttatttttttatttttttccttattttgttaaattgtttatctgtattcttttctagtccctgaatttcattagaacaattatttcaaattctttttcagtcaacttgtggatctccatttttttgaggacaattactggaagtttattgtgttcttttggtggcgtcatgttttcctgattctctgtgattcttgtaactttgtgtaggtgtctatgcatttgaagaagcagtcatcccctccaaaattcatgaactgacttttaaaagtaaagaccttcacctgcagggggctagacctactggaatgaatgaggtaccaaatgaaggggcatatggtgactttgggtctcagtgtgtattgtgtctgattgactcatatagctggggttggcaacctcggtaactatgtggtccttggtgatgagagctgaagaagggccatggtcactgtgaggtgctccttcaagttggtgaagtttcactccctaccaaacatgaaaaagacaaaagtggtagaaaagggcccaaagcaggagtgtgacattgcagaatacaaaacagacagtggttcaagatgggagagggtaggtactgttgatagttcattattttgtttttgtttttgttgttgttttgtttttcactatctttagtcactagatatactttattatttttaaattttgagtgtgtattaaaaagtataagcagtctttattcctgtgtatttattaagactgttttatggtaagttctgcaaaagcagaaccttaccaattcaaatgcgtgtgatttagtaaaagagtgatctcaggagaaaactaagagtgagagagaagcaggacaaagcatgggaatatgccagagaaaggtgtggagtcagctgaaagtagcttcagtctgattccccaggaagtactggagcatgattggcactttggagtggttctagcttgcaacaataggacatttctgccattgttttaaaatcaccatagcattccatttttggctatgggccaccctgggtgtgagggcatgcactcccatctatttccagtcacttatcttccttttggctaagagcaattctcaaaagagaggtttatatatgttagaagctggctctcgaagaagcttggggatgtatttactgctctggtaagggagatccaggaaagtcagtaaaatgtctgcttagtttcaacaagtcttatttattatgtacagctacctacactgttacactgactctgttagtattgatattctggtacccaatgcaagttacccaaagtaagtgcctcccgttatagaattccttcttaatgacaacaatttctgtctcagtttttatacattatgcaagctaggggtttcttggatgatgtggcatttgttctgaaccttgaagaatgagcaagatttcggttgggtaaaatcaagaacagagatttttcagacagaaggaacagaaaacagaatgaggaaaatgcagaatttgattagaatatagtgcattggtttgcctgaagtattgagaggatgagaacagatattggagacaagacttgataatacattaggtagaagattgttacagatggcaaagaccctgagggacaatctgatgacaggggcaattcgaagccacctgtgaatattacagatggcagtgcagtaactggaggtttggataatagtggatattccttttcagcaaggtcttctacagcaaagttgtcccatgagaaaaaaaaatcacagtgatcatactgtgtgtttgttttcttcttgccttccttcttttgtttccccaggcaatagcgtctaatgatgacccattcccttgccctgtgaataaggttgaaaagacctgaaagacctcgcaaattttcagaatcataaaataaatgctattgtgcaggaagtaaaatacgcccaaaggcatcctctactttctaaggtatatttttaacaagttgaatttcaatcatttctactgttattcagaagaacaggagcaaatatcattgaaaagctcctatggtgtgtgaggatttaagaaaacatatttgtgagcatcacagagtgatatagaggtcaagacttgtggtatctaaatcagtagttgcaagatagtggtctcagtggtcccaggactctcattaaaatcttcatggttctgagctccatctccaagaaatgaagacaacactaccttttatgtataggtgactctaaattcagaggggactgatcataggcattcaaggggaaaagttgctttaacacttatccttgaatgataagtgaaatgacaggaagaactgcagaaagccgcacctgagttgtgagactgtacattattcctacagcttaagtacttcatgattttaagaaactggaaggtgattctccttctttagaaggtaggaattttagagtttggggtttttttgttttactttttacaatgtacataatttcattctatatgttctaataatcaagtatctgtgggtgtttatagcctgttagaaattgaagtattttgaatattctactattcttcagtagtattgaagaaactatgagcacagacagctggaaattaagaatgttgtctgtttcttattgttggtaaagacagaacccagaaaactgcatgaggagggctttgaagaactaaaaacagagaccaggatggcaaactcaaggcaaaagccaggtatagaaagagggtaagacttgggcaaaccaaacagaaaggctgacacaatgttaggggcatcttgttcgccagaagctgccagggtcattgggaaggaagcaggtaatgtcatatggacataccttttgtcattactatacttaaataacgaggaaagcagactttaccatcaacatatgtgaaaagtatcacaaaagtcaaatgctcccaaccaacatcactgagaaagattgcgcaaactatacatatcctgataacctggagattttctccttggagatacttgccaataacttgtgggtgtgtgtgtatgtggaaatatattctttgataaagctctcctagtgattctaatatgaccatttataagtcaagcatgatttaatattatagtaaataaggggagtgtctagaatgtaaaaatgatagtttctttctcctaggctctaagaaaccactgctgaagttttcagaacttgtttgtttgttttcgatgttattcaacgttcattagtgcaattaggcaagcatttagaaagcacctattgcattcacattgctaggcgacaagatacttaaaatccacttagaaagcagccaactatctttagtgcatgtctaaataaaataaatgcgaaagagctcaaacaatgtattggggaagaattaatagatgaattgaagtaataatcatggaataatcatggaaggctttctgaagaatatgagatcctattttatcctatagccattgaactaaccttagtcaaagccaacattgcgctcagcttaggctgaaagttgggggagacaaaattttacacaggtctttgtcctgtctagtatagaagccaagcttgtaaaaaatgtcttattacaataaaatggtatctgaatctaaaaggtgaataacatagctaggctaatttagagagtcttctgagaagtgataaattttcattttgagaaagctatgtttttaggaggcagacaagggcaggaaagacattgcaacttagagaaaataacatggatatagtagatgagccccaaaaggacatgctgtatttgggaaatagtgggatgtttcttttgtaggagaagttggcggtaggaaatgaggatagacaggtaagatcgtgaagccatgctaggtggaattcccctttgaatcaactagctaaacatgtagtcctctagactctcactgccttgctgtaaatatgtcacgcacgtacattaccacctatctcacttttggcaaatcaggtacctctctgagccacaatttcctaattgcaaataaggtcattgtaatagtacttatatgttagggtagctatgagtatatacaagactgtgtaaccaaaacatataataaagagtataggttattagtatcatctagcttgtaggcaaaagggatccaaaagacatctataatgaggagacatagcatggtcacaggtgtgacataaataagctggcagtaggtgaaggatagaactgggagaaggagataccatgctcaccctatgggacagatacagggcaacagcagaggggctaaaaagaaggttaagatgttggaaaacagatatctggaattttggaagtaactcattggggtaaaagatgtggaaggaataagaaatgcaacctaatggtaactctccaatgtctgtaaataactcaaataggaaacacaggaggaaaacccgatatgtaagggaatatggccaattttgctctaaacatctgtattcaatacttggaggacattctggaattggagatgtcccagaagaaattggagatccttttttgacagaggctgaaattggagatccttttttgacagaggctgaaattggagagtcatacaaagtaagtggttctgaaacaataaaaatgggaaagattttcctttagaggtaaatcatctgagaaaccttcagaggaaagagtctgtggaggagtaaactaaaaaataaacaatatgagtcttggttgaagaatgcttgggtatatttgttttccacctaagggtctttgtgttatctgtgctttgtacctgcagtattctccccctgatcatcatatattgtttacatattgtcactctattctccatttaagtgtttcacctcctcagagagggctttcaaattccacaaacgacagtagttatgcactctcacatcacagaaatcctacatgtctggttccatgttgtgcttcctatgcatacaactgctggacacattattggcatctagtcaatatatatggaataaattcatggcctttgatagtcgtgtaaccactccctaccttgctttcacattttgtaaaatgaaaacaaaaattcttcacatagccttgtaagaattacatgagacagttttgtctaatcctagcatattgtctaatacattattggcattgagtaggtgctggttacctgccctgactcttcttgtattctttgcctgtaaatgcaatgcacatagaagacaactcctcaactaacaatacaattgttttgtcttattttgtcattagtcttgatgaatctttcaaaataatttcagccagtatttcttttttctctcccagcccttcattctcatacctgcttcctcatttctttccctccacctttaaccgtgactgaaattaaaataaaaattctatgaagagtcttcatatcacttttctgccctcatctcctaagcagattatatgttgaacaatcaaaatagaaatattactggcaaaatttatctgaggaacttgatttagttcttttcaggcttgttgcaaagcaaactacctaagtacattagctggcaaatgttctggaggttctgctaaaaacacaaaaattgatcagaatatgacattctggaatgagtcagtatcttcaaaattatattaaatctaagttagtccattatattatattagacacttcaaaaaatgttcaaagaacttcaaagagatgttaagaacttaaaaattaatggtatgtcttaagaactattgtaataaaaaaaattgatattgcatgtctcaagctttaattattaccacatatagaaacccagaagataaaacatgttaaattgatttgtctgctctagttgttgacataaatgtcaccctcagaaccactacactttggggagcactgatgaagataggattgcattgaaagaaacgcgaatgttcttttggaaatatttactgatctctcagaattttctaagtgttttattaattttaaatgatggaattattttattcattcaatcaacagtttattttaagcgcccatgagtgctagggtaccgctaaatcacaaaaagcatttgataaatatagcatctcaaaatccagtaggtgagatcaaaaaactttcattcatattttgtgtcttccttgcagatccagaatggagaaaagagagataaacagtgcttttggggtaaaatccaggtataggtatttgggcccactctatgtcatctatacatattatcatattagaatcattcttctcttcactcaggctcctgaccttgacctctttccaggtgcatttaactccctttcctcaggttctctaagagttgcctgacacttgcccaggtcccctgaataaaatacaggtaaatcagtgcataagaagctttatacagtgatctcagacttgtgaccaagagcccctctgcaccattgatagacagtggccgtgcccaccaggaggatgggcaatcacactgcagtgagcctattccttctgtggggattttccagtttttcagacctgcagagtctactttttgtggtgattctcttctacatgtgaccatcctagctgcaaacgtgtccataatgggggccatcaagctcagccacaaccttcacactcctatgtactttttcctctgtggcctgtccttttcagaaacttgtaccactgtggtagtaatccctcgcatgttggtggactttctatcagagagcaagaccatttctcttcctgagtgtgccacacagatgtttttctttctgggctttgcatccaacaactgtttcatcatggccgctatgtcctacgaccgctacacggccatccacaacccactgcagtaccacacccttatgacaagaaagatctgcttgcagatgatgatggcttcttggatggttgggttcctgttttctctgtgcatcatcgtcactgtattcaacttgtctctttgcgacttgaacactatccagcactatttctgtgatatctcaccagtggtctcccttgcttgtaattacactttctatcatgaaatggctatttttgtgctctctgcctttgtgttggtgggcagctgtattttaattatgatttcctatgtcttcattgtgttcatagtcataaagatgccctctgcaaaggggaggtctaaggccttctcaacttgctcctcccacctcactgttgtgtccatacactatggatttgcttgctttgtctatttgaggcccaagaacagcaactccttcgatgaagacatgctgacggccatgatatatacaatactgatgcctctgcttaaccccatcgtgtacagtctgagaaacaaagaaatgcagatagccctaagaaaaacactaggcagtgtatttggggttttccctcagaagacaaaaaaagagcctgaacatttaaaaaaattacacagcattgataaataaaggtgagaaaagtggagtacttctaattaatatcactttgtgcacaaagtggttaaagtattgtctaatttcctgatatgtcctggcctcaccattttcctactacagagaggatgcagttttaaaatgtttttaaatgttatgtgtgtgtgtttatgtgtgtgtgcatgtgtgtatgtacacatatccattcagggtacatattgctttagaacactgtattttaatgatagcagttgctttttgggaagaaagaaaattatgatactaaagacagaaagacagcaaggaagagagagagaatgtaaggaagggaggaaggaaggaagggaggaaggtaggaagggagggagggaggaaaggaggaagggaggaagggaagaaggaaaagaaaaaaatcgagttgactagtataattaatccgaaaagagggagaaagtacaaacacaaaaagttgaaaatgaaaatgaggatgtgattaaaatagagaaaattaaaagcaatttaagagaatactttgttcaaatttattcaaacaaatttgaaaattagaaaaaaacatgaatgcatttatggaaaaaataagcttacaaaatgaccccaaaagcaacagacattttttgacataccaatttccatggaaatttttgagaaatccgtcaaagacatgttttcctgttctctcccacaaagcattagagcagatagtttaataattaatttgtttaaatactcaaggaacaaataattcaaatgctatttaaattgatttagagcataaaaataaacagcttctaatttatgaacctcacagtggtggaaagtgctattactgctgacagatcatggccctggtagggaagttctgaagtgaattgtggaagattagatgatgtatgctggtgaaggaattttgaggctacgttgttcacatggttatagggagtgtgaagcaatatattattctgggtttgaattatatttttctaatgacagatgacatcaaggatcttttatatatttattaatcatttgtatgtctaatttagagaaatacatattcaaattctcttcccatttttaattgggggatttgtattgaatttagattgtttaaatgattctggataacatccttgatcagatatactatgtgcaaatatttccttccattctgtaggttgtttcttccctttctttatagtttcctttgaagcaaaaaagtttttaactctaatatggtggaatttatctttcttttttctttttttttgctcatgcttttgatgtcataactaagaatctattgcttaatccaagatcatgaagaatttcccctatgctttcttctaagagttttgtagtattaaatcttacatttaggtctttgatccacttgaattaacttttgtatgtgggttaagataagggtccaaccttattcttttacatggggatattcaaatgacccagcaccatttattgaaaggattattcattaccccactgaatattcttgacacccttatagacaacctgttgaccatagacacatgggttcatttctgacctcaattgtattccactgatctatatgcctttccttttgccagtacacactgtcttgattagtgttgcttgtcgctgttgtgtgtttttgagacagggtctcactccattgcccaggctggagtgcagtggcacaatgggtcactgcaacctctgcctctcgggttcaaacaattcgcctgccacagcctcctgagtagctgggattacaggcacctgctaccatgcctggctaatttttgtgtttttagtcaagatggggtttcaccatgttggccaggctggtcttgaactcctgacctcaagtgatccactcaccttggcctcacaaagtgctgggattacaggcatgagccactgtgcctggccttgattagtgttgttttatagtaagtattaaaattgggaagtgtgaattcttcaagtttgttcttgtttttcaagattgttttggatatttggggtcacttgcatttctatatacattttataatcttgtcaatttctataaagaaaccatctaggactttgatagggattttgtctaatctacagataaatttggggagtatttccatctttataatattaagacttccaattcataagcataggactttttcactcattaggttttatttcattcctatcagcattaaaaaattgatattactgtaaatggaattgtgttcttaatttcatttttagattttgcattgctagtgcaaggaaataccattgactttttatatttatcctatatcctacaagttgtctggactcatttattcatccctataattttaatggatttctatattttttctatatgtttatgttttctatatgtttatgttttctatatgtttatgttttctatgaaatcatgtcatctgcaaatacagttttacttctactttttcaatctggatgccttttatttcttgttattgctaattgccttacttcctccactgcaatgttgactagaagtggcaagagcagacattcttgtcttgttcctcatatctgggaaaagcatctagtctttggccgttaagtatgaaattagctatgggtctattcaggattttgtcaggtttaaactatctctgttcactgattacatgatcttgtaaccagaaaaccctaaagattcctccaaaagaccctagacttgataaacaacttcagtaaagtttcaatacaaactgatgtacaaaaatcagctgaatttctatataccaatgacactcaagcttagaaccaaatcaagaactcaatcccatttacaatagccacaaaagattaaaatacctaacaatacacctaaccaaggagacaaaagacctctacaaggagaactacaaaacactgatgaaggaaattgtaggtgacataaacaaataaaaaaaatcccatgctcatggattggaagaaccaacattaaaatgaccatgttgcccaaagcaatcctcaggttcaatgtaatttttatgaaattgtcagtgtagtatttcacagaattagaaaaaatgctaaaattcatatgggacaaaaaaaaagcccaaatagccaaatcaatactaagcaaagtaatatagctggaagcatcccattacctcacttcaaagtatactacaaggctataataaccaaatcatcatggtacaaaaatagacccatagatcagtgaaacaaaataaagaacccataaataaaatcacacacatacaaccacctgatctttgacaaagtcaacaaaaataaacaatgggaaaagtataccttaatcaataaatggtgctgggaaaaatggccagccatctgcagaaagatgaaactggaccactatttctcactatatacaaaaattaactcaagatggattaaatacttaaatgtaagacatgaagctgtaaaaactctagaagaaaacctagcaaaaactcttctggaaattggccttggcaaagaatttgtaactaagaccacaaaagaatatgcaacgaaaacaaaaataggcaaatgggacttaattaaagggcttctgcacagtaaaataaataatcaacagggtaaacagacaacctcaggatgggagaaaatatatgcaaactatgcatctaacaaagggctaatatccagaatctgtaaggaactcaaatcaacaagaaaaaaacaactagcctcattaaaaagtgggtgaaggacatgagcagacattcctaaaaagaagacatacacatggccaacaagcatatgaaaaaagcatatgaaaaagcatatgaaaaaatgctcgacatcattaatcattaaagaaatgcaaatcaaaaatacaatgagacactatctcactctagtcagaatggctataattaaaaagtcaaaaaataacagatgttgatgaggacgcagagaagaagggaatgcttatacactgttgatgaggatgtaagttagtaaaactgctaagggaaacagcatggagatttctcaaagaactaaaaacagaattaccatttggcccagcaatcccgtgactgagtatctacctaaaggaaaataaatcattataacaaaagaccactgagcttgtttgtttattgcagcactattcacaataacaaagtcatggaattaacccaagtgtctatcaacagttgattggattaagaaaatgtggtatgtatataccatggaatactacccagccataaaaaatatgaaagcacgtcttttgcagcaacaagaatgaacctggaggacattattttaagtgaaatacctcagaaacagaaaatcaaatagtgcatatcctttataagtaggagctaaacaaagggtacacacaggcatatagatggaaataatagatactggggactccaaaaggtattaggtctaaaaaattatctattggatacaatgttcactgtttgggtgacaaattcactagaagcccaaacttcaccattatgcaatatacccaggtaacaaacctgcacatgtacccccgaatctaaaataattttaaaaatttttttaaaagagagtagggttgaccatacatatatcagactttgggtcagaaactgttataagaatcaaaggaggtccctatataataataaaaagtccaatgtatcaggaagatataacaattataaatacatgcacacaacatcagagcacctgaaatataaattaatacaataacagtagaagaagactttaacagccaccttcaataatggatagaatatctagacagaaaatcaacaaggagacaggaggcttgaacaacactatacaccaaattttcctaacagacatacaaaacattccaaccaacagcatcgaaaattcatatttttctcaactgcacatgaaacatgctacaggatttatttcatgtttggtcacaaaataacttttaacaaattttaaaagattgatatcttaacaagtatctttttggattacaatgagataaaactagaaatcaataacagaaggaaaacttaaaaatccacacatatgagggaggagccaagatggccgaataggaacagctccggtctacagctcccagcatgagcaacgcagaagacgggtgatttctgcatttccatctgaggtaccgggttcatctcactagggagtgccagacagtgggcgcaggccagtgggcgcacgcaccgtgcgcgagccgaagcagggcgaggcattgcctcacctgggaagcgcaaggggtcagggagttccctttccgagtcaaagaaaggggtgacggacgcacctggaaaatcgggtcactcctacccgaatactgcgcttttctgactgacttaaaaaacggcgcaccacgagattatatcccacacctggctcggagggtcctacgcccacggagtctcgctgattgctagcacagcagtctgagatcaaactgcaaggaggcagcaaggctgggggaggggcgcccgccattgcccaggcttgattcacagctcaaggaggcctgcctgcctctgtaggctccacctctgggggcagggcatagacaaacaaaaagacagcagtaacctctgcagacttaaatgtccctgtctgacagctttgaagagagcagtggctctcccagcacgcagctggagatctgagaaccggcagactgcctcctcaaatgggttcctgacccctgacccccgagcagcctaactgggaggcaccccccagcaggagcacactgacacctcacactgcagggtattccaacagaactgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacacagagcgtctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagtggaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggtagtttagagaaaaacgaataaaaagaattgagcaaagcctccaagaaatatgggactatgtgaaaagaccaaatctacgtctgattggtgtacctgaaagtgatggggagaatggaaccaagttggaaaacactctgcaggatattatccaggagaacctccccaatctagcaaggcaggccaaagttcagattcaggaaatacagagaacgccacaaagatactcctcgagaagagcaactccaagacacataattgtcagattcaccaaagttgaaacgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaattttcaacccagaatttcatatccagccaaactaagcttcataagtgaaggagaaataaaatactttacagacaagcaaatgctgagacattttgtcaccaccaggcctgccctaaaagagctcctgaaggaagcgctaaacatggaaaggaacaactggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatggactaaatgctccaatgaaaagacacagactggcaaattggataaagagtcaagacccatcagtgtgctgtattcaggaaacccatctcacattcagagacacacataggctcaaaataaaaggatggaggaagatctaccaagcaaatggaaaacaaaaaaaggcaggggttgcaaccctagtctctgataaaacagactttaaaccaacaaagatcaaaagagacaaagaaggccattacataatggtaaagggatcaattcaacaagaagaactaactatcctaaatatatatgcacccaatacaggagcacccagattcataaagcaagtcctgagtgacctacaaagagacttagactcccacgcattaataatgggagactttaacaccccaccgtcaacattagacagatcaacgagacagaaagtcaacaaggatacccgggaattgaactcagctctgcaccaagtggacctaatagacatctacagaactctccaccccaaatcaacagaatatacatatttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactgactacttggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacatattcaaaagctagcagaaggcaagaaataactaaaatcagagcagaactgaaggaaatagatacacagaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaatacctctacgcaaataaactagaaaatctagaagaaatggataaattcctcgacacatacactctcccaagactaaaccaggaagaagttgcatctctgaatagaccaataacaggagctgaaattgtggcaataatcaatagtttaccaaccaaaaagagtccaggaccagatggattcacagccgaattctaccagaggtacaaggaagaactggtaccattccttctgaaactattccaatcaatagaaaaagggggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaacctctcaataaattaggtattgatgggacgtatttcaaaataataagagctatctatgacaaacccacagccaatatcatactgaattggcaaaaactggaagcattccctttgaaaactggcacaagacagggatgccctctctcaccactcctattcaacatactgttggaagttctggccatggcaattaggaaagagaaggaaataaagggtatccaattaggaaaagaggaagtcaaattgtccctgtttgcagatgacatgattgtatatctagaaaaccccattgtctcagcccaaaatctccttcagctgataagcaacttcagcaaagtctcaggatacaaaatcaatgtacaaaagtcacaagcattcttatacaccaacaacagacaaacagagagccaaatcatgagtgaactcccattcacaattgcttcaaagagaataaaatacctaggaatccaacttacaagggatgtgaaggacctcttcaagaactacaaaccactgctcaaggaaataaaagaggatacaaacaaatggaagaacattccatgctcatgggtaggaagaatcaatatcgtcaaaatggccatactgcccaaggtaatttacagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatacagatcaatggaacagaacagagccctcagaaataatgccgcatacctacaactatctgatctttgacaaacctgagaaaaacaagcaatggggaaaggattccctatttaataaatggtgttgggaaaactggctagccatatgtaggaagctgaaactggatcccttccttacaccttatacaaaaatcaattcaagatggattaaagatttaaacgttatacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatggtcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcatccattgtggaagtcagtgtggcaattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacaagttagtgggtgcagcgcaccagcatggcacatgtatacatatgtaactaacctgcacaatgtgcacatgctctctaaaacttaaagtataataaaaaaaaaaaagaaaatacaaaaaaaaaatccacacatatatggagattaaatagcacactcctgaataaccagtgggtcaaagaagaaatcaaaaagacaaataaaaattatcttgagacaaatgaagacaaaacagaatgtagaaactcttgtaggatgcagccaaaacagtactaaaaggcaattttacagagacaaagaagatctggattaacttagctttacacctcaaggaaatagaaaaagaaaaacaaattaggcccacagttagcaaaaggaagaaaatgacaaagattggagcgaaatatatgaaatagaaaaaaggaaaaaatcaacaaaactaataattggtttttaaaaaggtagacagaactgacaaacctttagctacactaagaaaagaatgaaggaagtttcaaatgagtaagattagaaataaggagaaaacattataactgattccacagaaataaaacagatcctaagagactacttttaacaccaactatacaatttgcccaaactgaatataaataagcagaaaatctgaattagtcaataagtaagaagattacacagtaatcagaaacttcccaaccaataaaatacctgggctttaccaaatatttagagaagaattaacaccaatccttctcaaactcttctgaaaattgaagagtgaatacttccaaattcattttatgaggtcagcattatcctgattccagagccagacaaaaacactgcaagaaaatataattacattccaatgtccctgatgaacatagatgcaaatattctcaacaaattcctagcaaactaaattcaacaacacattaaaaaaaaaaagaaagaaaagaaaaaaagaattctggccgggcacagtgactcatgcctgtaatcccagcactttggaaggccgaggcaggtggatgatttgagatcagaagttacagaccagcctggccaacatggtgaaaccccgtctctactaaaaatacaaaaattagctgggtgtggtggcgggcacctgtaatcccagctacttgggaggctgaggcaagagaatttcttgaaccagggaggtgggggttgcagtgagctgagatcgtgccactgcattctggcctgggcaacaagaatgaaactctgtctcaaaaaaaaaaaaaaagaaattctatgccataaacaaatagaatttatccctggcattcaaggctgattcaaaatatacaaattgatcaatgtgatacagcaatgtgacacagaataaagcataaaaaaaaaaacaagttgggcacgttggctcacacctatgatcccagcactttgagaatctgaggcaggcagattgcttgagtccagaattcaagaccagcctgggcaacatagtgagatccccccatttctagaaaaataaaaaaattagttgggcatggtggcacatgcctgtagtcccagtgacttgggaggctaaggtgggaggattgcttgagaccaggaggtcgaggctgcagtgaccagtgatggtgccattgcattcagcctaggggagagagtgagaccctgtctcagaaaaacaaaaaacaacaacaaaaaaaccccaaatgaattaaaaaggaatcatctcaatagatgcggaaaaatcatttaacaaaattcaacacactttcatgagaaaaactctcaacaaattagctatggaaaaaatttacttcaaagtagtgaaggccatatattataaactcacaactaatatcatactaaatggtgaaaaactaaaagcattttctctaagattaggaacaaggcaaggatgtccatttttaccagttttactcaacatagtactggaaatactgaggaatgaaggaagaaaagaaataaagctgttaaaatataaaaggaaggagtaaaattatctctgtaagcctatgacatgatcttgtatgtagaagaccattaagattcaaccaaaaagccatcagaactgacaaatgaattcattaaatttgcagaacacaaaatcatcacataaattcaattgcttttctagacactaacaatgaactatcagaaaaagaaattaggaaaataatcccatttccaaaaacatcaaaaagagtgaaatacataggtttaaatttaactaagaaagtgaaaaacttgtagactgaaaatgcaaaacattgatgaatgaaattttagatgacaaaaacaaatgaaaagacatcttgtgttcatgaattggaagtcttaatattgttaaaaatgtccatcctacacaaaatgatttacatatttaaggcaatccctatcaaaatcccaatggaattcttcacagaaattgaaaaatttgtcccaaagttcatatggaaccataaaagaccccaaacagccaaaacaatcttcagaaagaaggacaaagctggaggcatcacacttcatgatttcaaaatacaaagctacagtaattaaaatggtatgatactggcataaagacagacagaaaccaaaagaatagataggaattccagatataaactcaggcatatatgctcaaatgatctttgtgcagagtgccatgactagccaatagaggggaaaaaaactcttcaacaaatgatgctgataaaactgaaaagctacatgcaaaataataaaattagatccatatatgtttgagctgttagatccccttgatgtggaggggctgacgtacgggctcttcaaggacaagaccaaaggaacttggccttcaacctagagaatattctgttatgtagccatagttcaggaacaccatgagagtcagttgtgccatggcaacctcccagtcaatgtggcagctgtgtgtgacagggtcacaaaaaattttagtgtaagcatcattgttctattggaaagcatacatattagtggattaaagtgggcaatgaggaaagggaagaatgtgtgtgagagaaatatgtgccaccaccaagtatcaagtgtcctagaacaagtctatgagatgtggaaagcacaaataatttttaaaaagtgtatgctactcatcatgctgaaaataatattgcaattctattctatacacgtttgtaaactaaactggcaaacccagatgatttctaaacataagtgaccttaaaacttgggccactgaatacagccacatttcagaagtgccacagattgctgcaaccatattaatcatgttgatctgaagtgcaacttcaataatagtaaaatgttataatttctttttttcaaatcactgaatttaaaaatgcatggaatgcttgggtgtgtagaaaatacttcattcataagcctttatatgatcatgtgggcaggttatttcgctgtcccaatagatgtgtacatataatttctttgccccaatggattctcaatgtaattttccaaaacaagtgattaatttgtaattacagttgaagtaaataatatcccaaatgacccaaacctcacttaaatatggccttgatgtatgataacaattcctttgaggctatccccagtgttataataaatgtatcacgagtttatacttattttttaggattaaggaatatttgattattttatctgtaccagaaacaggttgattatttcaagcaaaagtttagtaattgagcatctacttattgtgtaaacagtgcttggtgttttcccacgttgtatattttaacacaagaatcatatgaagtatgtattattatctttttataggtaaggaaacagaagatcataaagtttttgtaacctgcctgtgattccgtagactgtgagaggcagaactaaaaactctgattccaggtttgcatggctgcaaagtccatggtgtctctgcaggtcactttgtcttccatgctggcaactgtactcaactttaaaacatttgtgtctttcatgcacttattttctttaaaaatattaaattcattatctggtttgggtgtttgtacatataaaaaaagccagaatttaataattcaggcacacaatcctagtattatttccactagaccatactgttgtcatgattctcatgtaatttagattgaatgaaatttgatagaatgtgtttgggtaagagcatggttgctgatatttatgtatgtatgttttttaaattattcttcacataggctttcttgaaaaaaagcaaattattctgaagaatatgttggtctttagatcagagtcatgggaaagaatgaatatgacttctctattctcccctttccttgatcatgtgctgtattgtgaacaaagggaccatcattttgaaatgccaattaatcttcttttcgatatgacttcctaccttttctatctggctacttcttcccctacctgtttaactttcccgtccccatcaaatactcccacacttcttatttctctataggtgcctgttagaactggtggaactaagacgtacctaaacatccccgaatagttccattcactttccatttaatcctagcccataatgatacctaggtttttcttattgcttcacacaatcccatatgtatgacaaggtatggtataggagataagtctttggatattttgcaaaatatctaggatgtttagcttttaacaataataaaaattatttgacctcttcatcttaaatgtagacatcatctagctcttgttgtcaattattataactaaggatgttgtttttttactctatgaaaaggagcaagtcagaaagaaagagacgtcaaaatcaacttttaggcccaattaattgtgtaactcgaggcagcatttactgagatagagagcactgagaaagacatatttgggatgggcatggaaaattaagagttgactttttttttttttttgagatggtagtctcactttgtccccccaggctggagtgcagtggcacgatctcagctcactgcaaactctgcctcccgggttcaagcgattctcctgcctcagctgcccgagttgctgggattacaggcacccaccaccacacctggctaattttgtgtttttagtagaggtggggtttcaccacgttgaccaggctggtctcgaactcctgacctcaaatgatccaccccccctcagcctcccaaagtgctgggattacaggcatgagccactatgcctggtctagagttgacttttctatgaacatttattaatatgttaacagtttatgttattttaataaatgttgttgtaaacatttttatgtatctcctgtgcacatggtgattagacttactctaaagtgtacaaataggggtaaaatggctggatcccaagaaaattgagtcttcagttttattttatggaatctgaaaggaaaatttgtgagcaaaaaaactctataaggcaaagttaccattttaaaaattgaataagatcacatttaggcatatacattaactgtggggtcatttcaaccaacttaatttcctctggtctggttttaataggcgctgttaaacggatagatggagactgaaaacaatacaacagtgacagagttcattattttgggattaacagacaatcctatgctatgtgccattttcttcgtgttttttctagcagtttatatagttactataccgggaaatattagcataatcctcttaatccaaagcagcccacagcttcacacgctaatgtacctttttctcagccatttggcttctgtggacattgggtattccatatcagttacgccaatcattctcatcaatttcttaagagagaaaacgactattcctgtcacaggctgtatagcacagcttggctctgatgtcatgtttggaaccacagagtgcttcctgctggtcactatgtggctatctgctctcccctgctttactccatccaaatgcccccagtcgtctgcttcctcctactgggagcctcctacctgggtggatgcctgaacgcttcgtcttttacaggctgtttgatgaacctgtccttctgcggtccaaataaaatcaaccactttttctgtgacctcttcccactcttgaagctttcttgtggccatgtttacattgctgaaatatcccctgccatctcctctgcatctgtccttatcagcacgctgtttaccataatcgtgtcctacatctacatccttcactccatcctgaaggtgtgctctactgagggaaggaagaaggctttctccacctgcgcttcccacctcactgcagtcactttgttctatgggaccattttgtttgtttatgtgatgcccaagtcaagctattcagcggatcaggtcaaggtggcatttgtgatctacacggtggtgattcccatgctgaaccccctcatctacagtctcaggaataaggaggtgaaagaggccatgagaaaattgatggcaagaacacattggttttcctgaattaaatcagtataatccataaataactaaaccaatgatttcggagacatttgtccttaatattctaattatatttatcattgactgtatcacttatatagtgaagtgcttgtataaatatagaaagccaatgcttacttccatgtacaaagttaattgtgtaatttatatggatatctgctggagtcgattttttttttttttttttttgagatggagtttcattctgtcacccaggctggagtgcagtggcgcaatctcatctcagctcactgtaacctcctcctcctgggttcaagcgcttctcctgcctcagcctccctagtagctgggactacaggtgtgcaccaccacatctggctaatttttgtacttttggtagacatggcgtttcaccatgttgggcaggctggtcttgaactcctgagctcaagcaattcacccaccttgggcttcccaaagtgctaggattacagcatgaaccactgcacccagcctggaatcaaattcaacatggatttgtcaaggtaagaatacctcagaaaagagcttctaataagatgtcccccaatcgccaattacagagttctaattcaatagagacacaaagagacatatttcaaagatcaattttttctaaatcccatcttataaaacgacatctgggagaggaatttccaatagatgtgtaatcagtggtaatgttgacaagtcaggcagctcaggttattttctttaaaggtactactctgctgtggtccatggatgtttaaactttccaaaatggcaatgtgagtgtcaaaaagcttctatttatttttcttttatgtaagccagagcaaaaattatgattcctgtatttggccattaagagatacaaggcacatagcacagaagaaactctgaacaaatctcagctaactctttttataaatgaagccttaacagatgagcagtagagttggattttgaaagcagacatttctttagatagtgagactttctttgaccaatagcttatagatagaagacatgaaattatgatccagacaaaacatatatctgccccatattttaacagtgtccctcaaaaaggtgtccatcatcactgtttcttcaactgccctttttgtaggggctcgtgacccagtctgattaaggcaattgtctctaaattgattccctgcctccagtgcttcttccacaacaatttctgattaacattttagttaatatatttgcattattagcatagtaatgatgtcatacagatcctgagacactagggagggactattcattttacagtctgaccttccatttctgggttcctcactgaccagatcaaggaaatcttctcttcttctgtctggaagccatattgtgcaatttctctgttcctgtttccctgtttatacctctttacttgcattaattataggcctataatccccccaatgcaataattctggggttaacattagcatagacatgcccctttccaaagagagggcactcaaaggtgtgacttcagtctgagaaagagccatcttagcattatggtgagaacactgaactctggtggttgaaggttttcatggactgtttctggccagcctcctcttcgtctcaccctccgcacttcactcttcaccagggtacatcctcagatctctgtccttatcgccattccccatggaacccaagagtgacctcattttctcccatggggtcagctgtcccctatgtggttaacagtatccctatctccaaatgcaaccttcctcggaggacagatagacttcactggccttttccctaagaccctcacactcagcgtgctgtgaccagatttatcatatttctcccaaaactgtttcttctcctctgtttcttttcttaatgtggtcacctcacaaatgtcacctctttgtgaggactagtactccaacagacttggggtggccctcactgtgtacctgtctaaatggtcagcctccctacctccttctccttctctcaaaagaaagataggtcacatattaatctatcctcatctaagtctcttttgcctggaggcttaagtgtttcccaactgattatgataagtccatgcagaaatttgtcctctgttcttcaactctaaggggctcaattaattcaatcacccagacatagagggtatggctgcatctggaactgttacagtccttttgggagaggattgatatttaaactcattttcccctcccaagttctgaatcaactgaagaatgaaaaaaaagagaaagtatatgtgagaacaaaacattgcctgtagaaatgaaagagttgatattagagaatgtggtttatgttcatggacacatatgtttttgtgttctgaatcccagaatttgacactctttctttctgtcactgaaaatattgtctctgggaagacactcaggtcttcccaatgagagtcagcctttacccatcatcatacagtatgtccaagggcagtcaagaacattgaggcaaggctttctcccaagagaaaggaggaagaagggctgggatgctgtttgggagtgaattgtgttcctctcaaactcatatattgagcttttaatcacctgtatgtcggaatgtgactttattttggaataggtttattgtagacataatttgttaagatgaagccatactggagcagggtaggcccctaatccaatatgactaatgtgcttgttgaaagggaaattttggacttacgcaacacatagggaggactgcatgtgaagataaagacagagatctgggtgatgcttttacaagccaaggaacaccaaagattgacagaaaaccaccagaagctaggaaaaaggcctggaacagattctccctcacacccttcagaagaaaccaaccctgtcaataccttgatcttggacttccagcctccagaactatgagaataaattgatgctttcttatggtagctctagaaaatgcatacaattgcatatctagttttcccctaaaaattcaccatcagctaatttactccttccaggggaggagggagtgaaggcttggaaagatgccaggtgtgttacactaggggatgcccctctgtgatggctaatattgagtgtcaactttattggatcaaaggatgcaaagtattgttcctgggtctgtctgtgtgggtattgtcaaaggagattaacatttgagtcagtggactgggagaggcagacccaccctcaatctgggtgggcaccatctaattagctgttagtgcagctagaataaagcaggcagcagaagatggaagagcagactttctgagtctcccggccttcatctttctcccgtgctggatgcttcctgccctcaaacatcaaactccaagttcttcagcttttggactctttgacttataccaatggtttgccaggggctcttgggcctttggccacagactgaagcctgtactgtgggcctccctacttttgagggtttgggacttggactgatacaccactggcttcattggtcctcaactggcagatggcctatcgtaggactttaccttgtgatcatgtgaatcaattctccttaataaactccctttcattaatgcaaaaatcctcaataaaatactggcaaactgaatccagcagcacatcaaaaagcttatccaccacgatccagttggcttcatccctgggatgcaaggctggttcaacatacaaaaatcaattaaacagaaccaaaggcaaaaccacatgatcatctcaatagatgcagaaaaggcctttgacaaaattcaacagcccttcatgctaaaaactctcaataaattaggtattgatgggacgtatctcaaaataataagagctatttatgacaaacccatagccaatatcatactgaatgggcaaaaactggaagcattccctttgaaaactggcacaagacacggatgccctctctcaccactcctattcaacatagtgttggaagttctggccagggcaatcaggcaggagaaagaaataaagggtattcaattaggaaaagaggaagtcaaattgtccctgtttgcagatgacatgattggatatttagaaaaccccattgtctcagcccaaaatctccttaagctgataagcaacgtcagcaaagtttcaggatacaaaaccaatgtgcaaaaatcacaagcattcttatacaacaataacagacaaacagagagccaaatcatgagtcaactcccattcacaattgcttcaaagagaataaaatacctaggaatccaacttacaagggatgtgaaggacctcttcaaggagaactacaaaccactgctcaacaaaataaaagaggacacaaacaaatggaagaacattccaggctcatgggtaggaagaatcagtatcgtgaaaatggccatactgcccaaggtaatttatagattcagtgccatccccatcaagttattttcccttttattttgagagagaatatgtcttttatctccccctggaagcttttaacagtttcttttgtttttggctttgtgtagtctttttatgatttgtgtaagtgtggctgtttctgcacttattatgtttggaatttgcagtttcttgaatttgtagctcatggtttttcatcggttgggaggtttatcagtgattatttttttctactccattgtccttatcctgttttcttggacgtcaattgcatatatgttggatattttcacaatttcctatatatctcttgcactcttttaaactgttttctactgacctatctttcagttaccgatcttcatttctgctatgtccaatctatgattaagactatctactgaattctttatttgtttttcatttctaatatttcatcttggttcttttgatattctttctctctcccgttctttctttgttctatatgtagctttctgttgtgattcttcataacattcctctatttttcttaaacattttttgcagtgtctaaattttgtttatttggcccaatttttggcatagcttttctaaattgatgatgggcaatgaagatgaaaattttcgaagctctagtgaaagtatcttcttccaaaatgtatttaattttcttccagcaggaaaaaacagcattggattgatctcttcgagaaaatggaaatgtcatgcccacagaggtcattcacatagagaaataacttatgtcactgtatacattataactcctaaacttgtatcctaagagaatggaggtggtgtttccaatgtgggtcagacattgcactttcttggggatgatatactactagcttggtcttatttccaggtaaggtgtagctctttaggagtctcaaataaaagcttggagtattcttagtcccctccatcttaaatggtatttttatcaaactctatcatatcagcatttcaaaaggttgaaatctgctcagatcttcagcctcccacaggctacttcctgcttagtgttttgatattctgccagcccatgtgcagcttaggagtagttaaacctcttaatgggaagttacacatcacatttcagactcacttctctacagtttattcctctgcaggatcttggtctgtcgagtcttagctgccttgacatctttgacccccaacctctgtgtgcccatcctgtcacactgccaaaagccccagcctctggcttttttctctgccctaattcttcatgatatcatttgtgaggatcaaggaaagtttcacttgcaaaatgacatttaagctgagacatgaagaagataagagttaacaggcctttgggagttggaagtacagttgtagaaactttggtgggtggggaaaatagtgatgtgggaggctgacctaattatcctcagctcaaagcacagtgtctggtacagagtgagcactcaacaaatatttatttgttaaatattaactctaattcaataaatatttatgtaatatctttcatattcctagcactggggtatgaactaaagaaatgaagttgtatgtgtcacgtacttttcttttaagaagttcacagtaataaaatacatgttccaaccagaaataccatttgtcccagcaatcccattactgggtatatacccaaaggattataaatcaatgtactataaagtcatatgcatgcgtatgtttattgcagcactatttacaatagtaaagacttggaaccaacccaaatgcccatgaatgatagattggataaagaaaatgtggcacacataccctgtggaatactatgcagctgtaaaaaaaagtatgagttcatgtccttcacagggatgtggttgaagctggaaatcatcattctcagcaaactaacacaggaagaggaaaccaaacactgcacgttctcaatcataagtgggagttgaacaatgagaacatatggacacaggaaagggaacatcacacatcagggcctgtcgggggatggggggcaggggggcaaggggagggagagcattaggacaaatacctaatgcatgtgagacttaaaacctagatgatgggttgataggtgcagcaaaccaccgtggcacatgtatacctatgtaacaaacctgcatgttctgcacatgtatcctagaacttaaagtaaaataaaaaaaaaatacaatgttttctattcaaatggtgtgaacaaagtgttacatgttatgtttcttaacagtagcttccttgacatttgggcaagaaaatgctttgttgtgtgtgtgtattgcaaatgtttagcattcctggctcctgcccattcaaggctgattgtcttctccagtcgtagtgaaaaaaattctaccatttccaaacaaacccctaggtgcgttcaatctcaaatttggaatgactgttaggggaatatacaggagaggacaatattctacctgatgaaatctggggaagtcttacaggccttttggataattaatatacatctatttggatgtctaattggtcagatctttgattactcataaggtcaaaaattatgttcctctcaggccagaggatcaggtaaatcagcaggtataggcagtaaagaccaggcttggcagactgcatcatatgcaaggtgcatgtcaggaaagataaccaagagttctgttgaccctttaagctccaaataccatcatccacataactctcaatagcaaagttttttactaagatgtacttctttgtctagagaaaatgaaaatagcaggcttatgaccctcaattgtatagcggattctctgttttatgattctccagtggggcaggcttctcccttaccaagagtctggaattgtttttatattctgggtttagtttctggttttcttttgtatcagcttcctccattatctctaagaatgtcaacctttatgttaagctgatgataaaagaagtttcattcttaccttcttctaaaaccagaagaccattggcgaggcgcggtggctcacacctgtaatcccagcactttgggaggccaaggcgggtggatcacgaggtcaggagatcgagaccatcctggctaacatggtgaaaccccatctctactaaaaatacaaaaaattagcggggtgtggcggcacacgcctgtagtcgggaggctgaggcaggagaatggcgtggacccgggaggcggaggttgcagtgagctgagattctgacactgcactctaacttgggcgacagagcgagacgctgtctcaaaaacaacaacaaaaacaaaaccaaaacaggaaaattatcatatgggctatgtacccacaagacggtatgcttcccacatggccatgtcttggtggctactagccttgtcccatttctggtttgccgcaatctctagacacttgggccttgtctagaggcacactcactcgtcagaaacccctagatgtgtaccattcaggcctaaaagcagcagccttaatggtcctgacaagagtaggacacaaaagaatatccatctcagccctggcttctaggtacaaagagtcttttaccacttgcctcatgttcttgggtgctactatcataatttttatgtttgaagtttacatattgaagctgaaatattgaattcacatatgactttatgtacagttattcaccacataacagtgttgtggtctacaatagaccacgtatataatggtttcataaaattataatgggactaaaaaaattcctatcacctagtaataccatagccatcataatgtggaacagtgtgttacccacatgtttgtagtgatgctggtctaaataatattgtgctgccaatcatataaaagtatagcacatacaattatgtacaatacatatacttgataatgataataaatgactatatcactgctttatatatctactctactttacatatatatgagaaaacttaactgtaaaacagccttgggcaggtccttcattgtatcataggagttgacagctccatgcatgttattgcccctgaacaccttccagtgggacaagatgtggaggtggaagacagtgacattgatgatcataactgtgtaggtctaggctagtgtgtgtttaggtcttgtttctaacaaaatagtttaaaattaaaaaaattaaaaatagaaaaaagtttatagaataaggatacaaagaaagaaaatatttttttaaaccactgtatgatgtatttgtgttttaagctaagtgttattacaaaagattcaaaaaggccaggcacagtggctcacacttataatcctagcactttgggaggccaagatggaaggattacttgagcccaggagtttgagacgagcctcagaaacatggtgaaactgtctctacaaaaactacaacaaaaattagccaggcatggtgacatatgcctgtagacctagcttctccggaggctgaggtaggaggatcacctgagactgggaagtcaaggctgcagtgagtcatgatcgcgcccctgcactgtggcctgggtgacagaccgaaaaataaaaataaaaattaagagtcagaaaggttttaaaaatttggtttataaagtaaaaaactacagtaagctaaggtgtattagtgtagcctgttatacaggaatgtcctaggcctccatattcacttaccactcacttactgattcacacagagcaacctccattcctgcaagctccattcataagtgccctatacaagtgtaccattttaaattttctataccatatttttacttgaccttttgtatgttgagatatgtttagatacacaaatacttaccattttgttgcaattgcctacagttttcagtataccaacatgcagtacaggtttggagcctaggagtaataagctatactatatagcctgtatgtgtagtaggctataccatctaggtttgggtaagtacaccctatgatgttagcacaatgatgaaattgcctaacaactcatttctcagaacatatccccattgttaagctatgcatgactgtattacaaagttttatgtatcatatgtattaaaatatgtacttatagattgtaaaagcaatttatatattcacacaaatgtttagatttctttactaacatactttaagacagaagttcttcagcaattattctttagactcagcataaaaataatatgctgaagacatggatgtatgtgtatagataagctttcattttgacctattcatttttatctatatactttatcacaaaaattttgaatgtgcagacatttctagggccttttagtttcacccactttcttcatagacgtttccactttattagaacaaatttcctcttaaaatatgcagagatgatagtaacgatggacgtttttaaagaactcaagtatgaaatggagtccccttagaagaacagctgagatgtagctgcagcacattctatattctttcatagtctcacaaacaacttacacattgttttatggatttacacagatggatttttaattacagctgttttctcttctgatagttaattttgagttaccattttgcaatgcgaggtaaggaatattgggatagtaaatattcaggtagaaagggatatctgtgtaggacacggagtgggagcacttcttccagtgacctaatgaatcatattatggttggacatttctacccctaggttattttatcccaagggaatgcctgcaacacacttctataatgactttccagtactatacctcctttccatttgcacttccaattctgacactacttattttttggtgtatataatcttgttggaactcctatgacaggtgcagaaatgttcttcctgcttttagtctaatatttagctttaggacttgaaaatattttagtactacaaaagtagctcatgtttttatacatttaaaaattcataaatacatcagaaaataaaggatagaaaaaatgttaaatctcaaatgtggtgaatttctcttgtttgtctttccaggtctattcctacccatttgcaccttgacataatccaaagaggctgatccccatggtctgtatcaacagactccctctcctgtagcttctggtttggctaatcagtgggagacactggcagaggagtctgaggcttgggtacttccctggctgttcttcctctacgtcacctggattggctgtgaccctccaccaaatgccacagctcctggcaggtggtcctctcatcacatcgctctaggttcctgttaattgcccactcttcttgttccttcagatcttgagctgatcactacccctaggatacaacattaccctcgaagcttttcctaagctctgcccacaactttgtaaattgccctttactcagttcctctcaattatccagtcatgtgtttccttcagataaccaggaaatattctatcttccacaatttattgcttgctcacacctgtgttaattcttcctaatttttattttgtaaaattatgttttgtaattttacaattttatgtaaatttacataattatgtaaatttacaaaattgtttttaattttacaattttatgtaaatttacataattatgtaaatttacaaaattatgttttgtaactttgtaaaagtaagttttgtaaaaacatacttttctttttacaaaagtaaaattatactgtaaatatatatatttatatataggtatatatatttataaataggtatatatatataaaaaaatttttttaccactgtatgatgtatttgtgttttaagctaagtgttattgcaaaagagtcaaaaagaccaggcacagtggctcacacttgtaatcctagcactttgggaggccaaggtggaaggatcacttgagcccaggattttgagacgagccgcagcaacacggtgaaactctgtctctacaaaaactacaacaaaaattagccaggcatggtgacatatgcctgtagtcctagctactcaggaggctgaggtaggaggatcacctgagaccgggaagtcaaggctgcagtgagtcatgatcatgcccctgcactctggcctgagtgacagaccgaaaaataaaaataaaaattaagagtcagaaaggttttaaaaatttagtttataaagtaaaaaagttacaataaggtaaggtatattagtgtagcctatgtatactgtgtttataaagtctacagtattatacagtaatatcctaggtctccatatatatatatatatatatatatatatatatatatatatacacctatatatataaatacatatacatatatatacctatatataaatatatatacctatatataaaaatatatatacatatataaatatatatacacacacatatatacacctatatatacatttatacctatatatacatatatatatccacacacacacacacatatacctgattttatcatcaataaattatccacaccagatgggacttaatgtattcaagttcaaatttttagtcagacttttatttatttacttttagccatcctgctcacattcataaatgtttagttagattttaaagaattccttagtataaccatattagtttttcagcattataactctctattctcctccacttactcaatgaccctgcaaaagtgagttactcactgttcctgaaatatcctccccacttccggcctcacggcctacccttttgctgaaattattttcacctatcagttccatctcaagtaccttcccacatggcttcaacccactctgaaactgctcttgctaaattacctacacccacccctctgccaaacctcagaagcattaaacaagtaaccaccttctcctattttgaatcactttctttttttgtattctgcaatctcactttcccaatttgggtttttccttacctctcttgtccatttgtcttcatctttcctgaagattgcaactgtaccagacctttaaatgttagactgtcttataacttatcctatatattcttacatttatagccacttattgacctcatgcaattttatgatttttaagacaataccacttgtcttagtccattttgtgctgctataacagcataccacagactgggtaatttattaaaaatatgaattttttgtcacaattctggaggttggaagtccaacatcaaggcactggcatttggtgtctagtgagggctgcatcctctggaaggaaagaatactgtggtgatacatgggggaagtgagaagggcaagaggaggtgacctccttccgtcaagccttttaaaagggatacttaattccatttatgagagatgaaccttcgtggcccaatcacctcttaaaggccccacctttcaatattatcacattggcagacttgaattttgaaggacatacattcaaaccatagcaccacttaaatattgtttactccaaaatttatgtatgcaacctcaatttctctatgacctaacatgtttctacattcaacagtaatagatggtaagggtttgaaaaatagtaaggaaaatatttttaagagcttaataaaagaacacatttgctgagtagtgatgaagtttgataatattgccacctgtgacaaagtggaaaagagaaagggtatcttatatactcttagatttgcctgggaaggtttccaggaagagtgcagaaagtgctacctggcttcttatagttgcctatgataaactataaccagagatctgtgaactaaaggaaaatttttttcaaagaaaaatttagaaaaaatgtaagaaagctagatcttgctggctttgaaaataaggctatttctcatccctgatatcttccagaaagattttcatggtacgaagtgacttcaggtcaaagatcatattcaggttggggctgtaagatcctctgctgagacctcagaaagatctaaggcctcactgacccttaaagctaatctatgtccttctaagaatcttaatggcatgttttagagaccctcttttttctaaaaaacaaagatttttttttttttcttttgagatggagtctcactctgtggcccagactggagtgtagtggcgctatctcggctcactgcaagcttctcctcctgggttcacgccattctcttgcctcagcctcccaagtagctgggactacaggcacctgccaccacgcccggctaattttgtgtgtgtgtgtgtgtgtgtgtgtgtgtgtgtgtgtatttttagtagagatggggtttcactgtgttagccaggatggtctcaatctcctgacctcgtggtccacccgccttggcctcccaaagtgctgggattacaggcgtgagccactgtgcccggccaaaaacaaagcttttgaaatcataaggcttctggcagaaacctcataaacctccagaggaagaattaactggaagagatttatgagtgtgagttttgtccaattcagtagtttataatttgatacaaagaaagcccatgttgtttttaacaacctccatgagatatagttcacataccatacaaactacagatttaaagtgtatgatttaatgttcgtagcatatgcacacatgttttcaagcctcaccatagtcaattttagaaagttttaatcatctcaaaaagaaatcctgtatcctttagtatcaccttacatattcctatccccccagccataagcaaccaccagtctaccttctgtctctatatggacatttcatatgtatggccttagataatacgtggtctcttgtgactagtctcttttacttagtgtaatgttgtccaggttcattcatgttgagacatatatcagttctccattcttttcaatggctaaataatattccattatatggatatactacattttcttccttcacttgtaagttaatggatccatgcattgcttctaccttttggttattgtaaataatgctactataaacattcacgcatgagtttttttgtggacatatgcttttatttctcttgggcatatatctaggagaatttctggatcatagggtatttctatgtttaatagtttgagtaactggaagattattttccaaaatgatcccaccattttacatacctaccagtatatgtgggtttcaatttttccacatcctcaccaacactttttattatcatacttttaaattctagccatcctagtggggtgaagagtagtatctcattaatatttcatttgtattttcatgatgactcccacagtgtgtttgaagaaatgataacagcttagactgaaagggacagggatagtgcaaagtgaaaagaggttttgtgcgaagtgaaaagaggttttggacccttgacctacaataattaggaaataggccaggaaaactactcagctataacataggctatttttttcctggaaaaggaaggataactcagaggatggaaccaaaaagtcagaaggcagagccaagagacatagagatttattaacaaggagcaggattgggccctgatcaagaaaatggcaacatctgtctagttggatttgggaattgcaattggccagtgattgctacatgactcctatattccacccttatgaatgggagtgttcactgcagtttttctacaccagcatcaacagtgtctgttgggtaatatatagggcagatgacttgtctctttagttcgcatgtctttcaatcaagagggactgtatttgagaagctgtgcccaaggaacctcactcatgcctaaacttggtttaaatcccacgatgatggacttaattgtgatgctgtaatggtatgatattttagaggactgtaggacgtataaaagtaatttgacatgtaggaaatatacaaataactgtggccagagggattgtggtaggctggagatggctgtgacatcattgctacttctcttattgacaggtggaatctaatttcccttcccttgaatctggactgaaattactaatttgctttgccagtagacaaaggtggacaagatgtctacgtctcctgaggctaggtgataggaaatactgcagatttcttttaatctcttggaacacttgctattaaagtcttgagccactatgtgagaaatccaactaaactgctagtgagaccatatagaatgatcctatgactacctggagagggagaggctttcaaaccattcctgtgaaggtgctgggcatttgaatgatgccatttttgactctgtagacatgcaaagatgccatctgaatatgactaagtgatcctcattcatgctattagagtaaaattgccaagccaaacccaatcttaatttctgactcatgaaataatgtaatataataaaatgtgtttttatagtcaatttttacatacaacaatagaggtattctttaaaagtgtgaattgtaattaggctacgcccatttagaaaacatttagaggcttcccattcctttcagcataaaatccaaacacttttccatggcatatgatgtcccccaaacatgatctaacccttttggtatacctctctccatctggtttatcattgccttctttttattttttgagattatcaggatctttgcatttcctgtttcctgtctggcagcttccctgactccactcttcacatctatgggtccttctgatcattccattttctactcaaatatcacctgctccacatggccttccttttcactttacctacagtaataccacctatatcacatttactcttaacagtcatattaaccttattgatttatttcttccacatcacttaccatattctgtatttataatgttgattcattttctagtgtttttgctgagatctaaatttcatgcaaagtctgttctattcatcaatataccttcagtgcttactcagttctcgactatgataaatgctgaacaaatatttttgaaataaatggataaatgattatcttatatctacatgtcaaacaattttcaggcattgagcaaatatccctcattggctttgagatcacaatggcaggaaattatcaatgtttgtggtcagtcctctactttctccctgaattattcataaacataccaacaaggatatataaatcttaacagatcagaaagttcatgtttatcactagcctttgacttgaattaactgacaattatgaaggcttagatgatacatggcataaaatataggagacctgtgaacactttaacctttgagacatgaagccaaagtatccaaaggaagctaatctttatattcaggaccatagagtttgcataactaatgctccaagatgtcgtgggaatcaggatgcacctgaaatttttacaggacaactggagatgttgtttatcaaaagataaggaccagggttaggacctcaggaaaaaaacaaaaagctgcccacttacgaatgttcattattatggtgaaaaagcagggcagaagggggaaggagtcagggcatttagagttgaattcagaaattggagaagactggtctctgtgaaattaagaaacttttatccttaaagctggcctttaaatctcacaataactgttcctctgatggcagtgggtatactgagagaatttacagattttatagacactactctcctaatctaccctgggaccttaaatgggagactggtgtcagtaaaagcacttcctcacctaagttggaaccataggagttatccaaattattccttctatctaatcccccatccaacaatcaacagtttctaccagttatctcccctaaatctttctcaaggttgttctctgtattttgtatttttctatcactaatattcaaatctttatcctttgtctactggagtattgtagattgtttcctaatcaggcacctggaaaatcgggtcactcccaccctaataatgtgcttttccaatggtcttagcaaagggcacaacaggagattgtatcccgtgcctgcctcggagggtcccatgcccacggagcctcgctcattgctagcacagcagtctgagaccgaattgcaaggtgacagtgaggctaggggaggggcgcccgcaattgctgaggcttgagtaggtaaacaaagcagctgggaagttcgaactgggtggagcccaccgtagctcaaggaggcctgcctgcctctgtagactccacctctaggggcagggcatagctgaacaaaaggcagcagaaacctctgcagacttaaatgtccctgtctgacagctttgaagagagtagtggttctcccagcacagagtttgagatctgagaacagacagactgcctcctcaagtgagtccctgacccccaagtagcctaactgggaggcaccccccagtaggggcagaatgacacctcacacggccaggtactcctctgagacgaagcttccagaggaatgatcaggcagcaacatttgctgttcaggaatatagcttccagaggaatgatcaggcagcaacatttgctgttcaggaatattcgctgttctgcagcctccactgctgatacccaggcaaacagggtcttgagtggacctccagcaaactccaacagaactgcagctgagggtcctgaccgatagaaggaaaactaacaagcagaaaggacatccacaccaaaaccccatctgtacgtcaccatcatcaaagaccaaaggtagataaaaccacaaagatggggaaaaaacagagcagaaaagctgaaaatcctaaaaatcagagtgcctctccccttcaaaggaatgcagctcctcgccagcaatggaacaaagctggacggagagtgacactgacgagttgagagaaaaaggctacagatgatcaaacttctctgagctaaaggaggaagttcaaacccatcacaaagaagctaaaaaccttgaaaaaagattaacgaatggctaactagaataaccagtgtagagaagtccttaaatgacctgatggagctgaaaaccatggcatgagaactacgtgacgaatgcacaagcttcagtagtggatttgatcaactggaagaaagggtatcagtgattgaagatcaaatgaatgaaatgaagtgagaagagaagtttagagaaaaaaagagtaaaaaagaaacgaataaagcctccaagaaatatgggactatgtgaaaagaccaaatctacgtctgattgatgtaccggaaagtcatggggagaatggaaccaagttggaaaacactcttcaggatattatccaggagaacttccccaatctagcaaggcaggccaacattcaaattcaggaaatacagagaacgctgcaaagatactcctcgagaagagcaactccaagacacataattgtcagattcaccaaagttgaaatgaaggaaaaaatgttaagggcagccagagagaaaggtcaggttacccacaaaggaaagcccatcagactaacagctgatctcttggcaggaacactacaagccagcagagagtgggggccaatattcaacattcttaaagaaaagaattttcaacccagaatttcatatccagccaaactaagcttcataagtgaaggagaaataaaatcctatacagacaagcaaatgctgagagattttgtcaccaccaggcctgccctacaagagctcctgaaggaagcactaaacatggaaaggaacaaccggtaccaacaactgcaaaaacatgccaaattgtaaagaccatcaatgctaggaagaaactgcatcaactaacaggcaaaataaccagctaacatcataatgacaggatctaattcacacataacaatattaaccttaaatgtaaatgggctaaatgccctaataaaaagacacagactggcaaattggataaagagtcaagacccatcagtgtgctgtattcaggagattcatcttatgtgcaaagacacacataggctcaaaataaagggacggagaaagatctaccaagcaaatggaaaacaaaaaaaggcaggggttgcaattctagtctctgataaaacagactttaaaccaacaaagatcaaaagagacaaagaaggccattacataatggtaaagggatcaattcaacaagaagagctcactatcctaaatatatatgcacccaatacaggagcacccagattcataaagcaagtccttagagacctacaaagagacttagactcccacacaataataatgggagactttaacaccccattgtcaacattagacagatccacgagacagaaagttaacaaggatatccaggaattgaactcagctctgcaccaagcagacctaatagacatctacagaactctccaccccaaatcaacagaatatacattcttctcagcaccacatcacacttcttccaaaattgaccacatagttggaagtaaagcactcctcagcaaatgtaaaataacagaaattataacaaactgtctctcagaccacagtgcaatcaaattagaactcaggattaagaaactcactcaaaaccgctcaactacatggaaactgaacaacctgctcctgagtgactactgggtacataacgaaatgaaggcagaaataaagatgttcttggaaaccaatgagaacaaagacactacatagcagaatctctgggacacatttaaagcagtgtgtagagggaaatttatagcactaaatgccatcaagagaaagcaggaaagatctaaaattgacaccctaacatcacaattaaaagaactagagaagcaagagcaaacacattcaaaagctggaagaaggcaagaaataactaagattagagcagaactgaaggaaatagagacacaaaaaacccctcaaaaaatcaatgaatccaggagctgcttttttgaaaacatgaacaaaattgttagaccgctagcaagactaataaagaagaaaagagagaagaatcaaatagatgcaataaaaaatgataaagggggtatcaccaccgatcccacagaaatacgaactaccatcagagaatactataaacacctctatgcaaataaactagaaagtctagaaaaaatggataaattcctcgacacatacacccccccaagactaaaccaggaagaagttgaatccctgaatagaccaataacagtctctgaaattgaggcaataattaatagcctaccaaccaaaaaaagtccaggaccagaccaattcagagccaagttctaccagaggtacaaggaggagctggtaccattccttctgaaacaattccaatcaatagaaaaagagggaatcctccctaactcattttatgaggccagcatcatcttgataccaaagcctggcagagacacaacaaaaaaagataattttagaccaatatccctgatgaacatcaatgctaaaatcctcaataaaatactggcaaaccgaatccagcagcatatcaaaaagcttatccaccatgatcaactgggcttcatccctaggatgcaaggctgattcaacatacacaaatcaataaacataattcatcatataaacagaaccaaagacagaaaccacatgattatctcaatagatgcagaaaagtcctttgacaaaattcaacagcccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatactgttggaagttctggccagggcaatcaggcaggagaaagaaatgaaaggtattcaattatgaaaagaggaagtcaaattgtccctgtttgcagatgacatgattctatatttagaaaaccccattgtctcagcccaaaatctccttaagctaataagcaacttcagcaaagtctcaggatataaaatcaatgtgcaaaaatcacaagcattcttatataccaataacagacagagagccaaatcatgagtcaactcccattcacaattgcttcaaagagaataaaatacctaggaatccaacatacaagggatgtgaaggatctcttcaaggagaactacaaaccactgctcaacgaaataaaagtggacacaaacaaatggaagaacattccaaattgacaaatgggatctaattaaactaaagagcttctgcacagcaaaaggaaactaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatcaagaactagaaataccatttgacccagccatcccattactgggtatatacccaaaggactataaatcatgctgttataaagacacatgcacacgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattctcagcaaactatctcaagaacaaaaaaccaaacaccgcatattctcactcataggtgggaattgaacaatgagaacacatggacacaggaagaggaaaatcacactctggggactgtggtggggtggggggaggggggagggatagcattgggagatatacctaatgctagatgacgagttagtgggtgcagcataccagcatggcacatgtatacgtatgtaactaacctgcacaatgtgcacatgtaccctaaaacttaaagtataataataaataaataaataaataaataaataaataaataattaaaaaacattccatgctcacggataggaagaatcaatatcgtgaaaatggccatactgcccaaggtaatttacagattcaatgccatccccatcaagctaccaatgactttcttcacagaattggaaaaaaactactttaaacttcatatggaatcaaaaaagagcccacattgccaagacaatcctaagccaaaagaacaaagctggaggcatcacgctacctgacttcaaactatactacaaggctacagtaaccaaaacacacagtacagttaccaaaacagagatatagacgaatggaacagaacagaggcctcagaaataataccacacacctacaaccatctgatctttgacaaacctgataaaaacaagaaatggggaaaggattccctatttaataaatggtgctgggaaaactggctagccttattagaaagctgaaactggatcccttccttacaccttatacaaaaattaattcaagatggattaaagactcatatgttagacctaaaaccataaaaagtctagaaaagaacctaggcaataccattcaggacataggcatgggcaaggacttcatgtctaaaataccaaaagcaatggcaacaaaagccaaaattgacaaatgggatctaattaaactaaagagcttctgcacagcaaaagaaactaccatcagagtaaacaggcaatctacagaatgggagaaaatttttgcaatctactcatctgacaaacggctaatatccagaatctacaaagaactcaaacaaacttacaaaaaacaaacaaacaaacaaccccatcacaaagtgggtgaaggttatgaacagacacttctcaataaaagacatttatgcagacaacagacacatgaaaaaatgctcatcatcactggccatcagagaaatgcaaatcaaaaccacagtgagataccatctcacaccagttagaatggcgatcattaaaaagtcaggaaacaacaggtgctggagaggatgtggagaaataggaacacttttacactgttggtgggactgtaaactacttcaaccattgtggaagacagtgtggtgattcctcaaggatctagaactggaaataccatttgacccagccattccattactgggtatatacccaaaggattataaatcatgctgctataaagacacacgcacacgtatgtttactgcggcattattcacaatagcaaagacttggaaccaacccaaatgtccaccaatgatagactggattaagaaaatgtggcacatatacaccatggaatactatgcagccataaaaaagtatgagttcatgtcctttgtagggacatggatgaagctggaaaccatcattctcagcaaactatcacaaggacaaaaaaccaaacaccacatgttctcactcataggtgggaactgaacaatgagaacactaggacacaggaaggggatcatcacacaccggggcctgtcatagggtggggggctgggggagggatagcattaggagaaatacctaatgtaaatgacaagttaatgggtacagcacaccaatatggcacatgtatacatatgtaacaaacctgcacgttgtgcacatgtaccctagaacttaaagtataataaaaaaaatttcttttctatatttcccaaccctcacttctctctctccattacactgaggtaaaaaggacaactggattctaagtcttcttcccagatgccagaaacagttttctcgatatttgctttgaattggtagtttctgtattccagcagacttctcctcatcctttctagtcttatggtgataacgtaaatgaaaataaatcattctccaagaaaaagatttagttaatgtgatatgcaacaacatttctggttttttgtttgtttttttaacaggttctaatttctctatcaattcagacctatagaactacaattattgttaacacattaattgcaatccttagaattaaaggacactgtttttaattctccgtctctactaaaaaaatacaaaaaaattagccgagcatggtagcaggcgcctgtagtcccagctactctggaggctgaggcaggagaatggcgtgaacccgggaggcggagcttgcagtgagcccatcgtgccattgcactccagcctgggcggcagagtgagactccgtctcaaaaaaaaaaaaaaaaaagaaagaaagaaaattaaaggacactgtttttaattgctgcaaataaatattacattatgccaaaggagactatttgtttttaatgtgcttaaaaatatggataaagtaccagctaaatcatgtgttcgtggtgttaagatctgatctcctaaaagatggcaaccaatccatttctcaaattttcaccctcattcagagtctacacaacctagaccatctagtggtagggtttgttcaaaatattgatacaaagttccagcttaagcttgattgtcctgtccaaatcctctagctcagtagcaatgctgatgtcattaggctgatggtcatagtttgatataggttaagtgcatggatcctggaaagggaggacttgagtttacatctatttggaaaaactattgtatctttcaatacagttttctcaacagtaaattgtgggaaatttattcctgcatcataggattgctgagaaaattaaatgaaaaaaaaataatggttttggaatcagactttctggattcaaatacttactggtcccacatttaacttcatgactttggacattccacttaatgtctctatgcccagatgatttatttgtgaaatacaaatagtggaatcacttcatagggttgttgtgaggaataaatgagttaacatatgtaacatgcttagcatagggcctggcacagagtaagtaaaagctattgtttgtgaaataaattaaataaaggaaaaatgcttggcatctacaagagtttaataatagtaataattattactatcattattactgacatctaggtctcccaattggtctacaagtatttaaaaatgaaagttagaacaaataaatataattttattttaagcaatcagttaagtagtatttggtaggtcctaaacgtgataccgataatgaaaactttataggtcgtctgaaatgctacaaattgatcctaagaatatattctgacagttgcctttcttagtgcctcctttacatctctgttcctcagactatagataaaggggttcagtatggggattaccactgtgtaggacagcgatatcaatctgttctggctagttgagtaactggatttgggcatcacataaatgaaggtaatcgttccatagtagagagtaaccgcagcgaggtgggaggtacaggtggagaaggccttgtggcgcccctcggcggagcgcatcttcaggatggtgatgaggatgtagatgtaggagatggctatggcaaatactgtgaccacaatgatagatccagaagagatggaagggataatttcaggaatggagatatttgagcaggaaagtttcaacaaaggagagaaatcacagaaaaaatgatctatctgatttggtccacagaaagacagactcaataaacaactagtaaatgttgaggcattcacacatccacccaggtagcaaacccccactaagagtatgcagattatgggggacaagtgggtggagttcaccaggggtgagcagatggccacatagcgatcataggccatggtcgccagtaggaagcattcagacgtcccaaacatgactacagaacagagctgggcttcacagctagtgacagggagggctgttccacgtcttaggaatcccataagcattataggtgtgactactgtggcaagccctatgtccacaaaagccaagtggctgaggaacaggtacatgggagtgtgaagttgggaacagcttctttattatgctgatattgcctattaaggtgacaatgtagattcctagaaatatcacaaagaagatgtcacaaagtgtaggatcctcagttaaccccaaaataataaactctgtcactgtggtatggtttccaatctccatctttgtgaattgttcctgttgaaagaaatgtgaatattaatttgttataggattttatttcacacattcccagctttccttggctattccttagactcattcacagtaacttcatcctctgcctgatttgtaaatattgatatcccacaggattgtttttgttttgatgtgtcctctgcataaaaagagaatggttcaactcaactctctgggaaattagttacattcttttctgtatgtaataagcacattaaaatgcctctcatacctagacttgtagacagatctctcagaagatgtctagaccacaattcaatgatctattgggagtcttcagtggaaattccacaagtacctcaaacccagccttccccataacaaattcattcattcttttctttccttccatattgtgtatctggggagtgacaccaccatccacccagtctcttgtgtctgcaacttgtgagccctcctagtcttcttcctcttattttatcacaactcataaaatcttattgggcctatctacaacttaactcccaattttatctctttatctcctttttactattctcagcatccctacttcagtcaaggacctagtcgtttttcctttctattttattgacctatttacttcactgccttcattcttgttcacaacacatttgtgtaagtgatatcttggtaaataaaaagcagatgattcaaaagagattcatttcagtctttcagtactctctcaagccttcacaatgaaacctaacttgttagcaaagcatacaatatcatttatgttccagcatacgactctttgtctgtcaggatgtctccattcaccactcacactgactcaaacttcttgaactatttagagtcttcttgatgtactctaatttctctggcctttgctccactttttctcctgcatagacagctaccacctcccaccgtcattatcctgggtgacttctacacatctttcaagactaatttccctccaaagccttctctgactgccaggggtgaatcaggtaaccttcatttgtattatagacatcagcttttgccttcacttatactgggttatgatttttgttgttatttgtttttttactgttcattctcctcaatgaatacattgtcttccataactgcatcctatccctgtattacaaatatcgacttcttgtacataatgtgctgaaaaaaacttatccaatgaatgaatgcatgattacagtaataaattggctctgtgaaataagagataaagtttaggttctctgtccagagaaagcaggcctcataaagaaggaaaaaatgaagacattaattcatggaaagcactgtaataacagtataagtaaagaaagggcttattttatttctaaataaaaaaattatataagcaggctggggaaacacttgaaaattcaaaagaaacatttctgtcaaatctggctaccatcacacacatcaactattgaaattgggcacatgtgtttccgggagtttatctgctatggatatatttttatatgctttgtatcacattgtaaataaatttttttaagttttatttttagttggtaaataattgcatatattttggaatacaatgtgaggtttcaatggaatgatcatagtgcagataacgtgggcaaggccagaaatttaccaattgattgctattttgcctgcttctagggagggaagccatacatggcactgtaagacaagcctgaagtccatggtgggcttcctaaaagggcaaatgggagaaaatatggtggtaatgttcaagtaatggatatacctacaagggtccctactaaacacctgtgtttttgccaatagctgttgttcctgctacccatggcagctggtaatgtctttctatactgggctgtgactacagcagctgtcagcaaccagtctggttgttaagtatacgaatatctccctctatcaaatgataatggtacactttagaatattctgcctttctcctgacagaactggagtgaccagttcaacagcaccgataatgcaaccccggttcactggtgattgtctccacctggaggcccaattgccaacatactggagacctaaaaacatgtgcccttatagacactacctgttgcacctatatcccagatgaagtgaataatgtcacagatgttttacattatttttttggtccagatccatgatataacccaattaggttcctttgacttattctcaaattagttacacaccctacctacacgttgaagtatgttttgctaataggcattataattgtagttagcttctgctttttatgctgttgtgtatgcagtgtgtgctttttatgctattgtggatatggcctgtatgtaaaagccatggctatatattataaattcatatgtttcttcccgtcttaccccactcagggacttttgtgcaagattgcagaaagaatgtaagagctgggggagagggtgggctgtaatgtgacaggtccccaaccaggttacttaaaggtgtatgtcggctggttgccaaaagtgccaaggaaaatcatttatatttcaacaaattgtgctgagacaattgaacatccatatgtgaaaggaagaatttatgcagttacctcatggcacacaaaacaattaattcaagataaatatagacataaatgcaatagctaaaactacaaattgtttgaaagaaaacacaaaagaatgtctgtgatcttgggtatgaaagctaagtttttttttttaactacaataccaaaagcacaatacataaatgaaaaatcaaaaattggacttctcaaaatttaaaacttttgcttttcaaaagaccccaccaagaaaacgaaatcaagccagacttgtagaaaatttttgaaaacattgtattggataaaaagatgtatacatgaaacagaaaggttcttacaattcaggagtgagaagaaaaataacctaattttaaaatgtgtaaatatttgaatagtcatttcaccaaaggagatatatgaatggccatgttcaagtaacccacaggaaggcagggaaagaaagaaaaaagaaacaaatgagagaacaaatagaaaacaaaaaaataaaatggcaaacaagccataatatatcagtaattactttaaattcaaatgtttcaacatcgttagacgtcaggcatttacaaattaaaattaaaattttacaaattaattttaagactaaagttaatttttacaaattaatttgtaactttaaaaaattaatttttgaaaacaaaaaataaactggcaaataagccacaatatatcattaattactttaaatacaagtgtttcaacatcattaaacattaaacatttacaaattaaaattaaaatctcaaaaatcaatttataaagtttacaaattaaaactatgatgagatactactacacatttattagactggttatattaaaaagaattggcaagaccaagtggtggcaaggagatgaagcacctgtgattttatacgtcgcagatgggaatgcaaactggcatagtcactttggaaaataatttggtagtttctcatcaacttaaaaatacatttactatatgatctggcaacactactccaaggtatttattctagggaaatgaaaacttatgttcacacaaatacctggacaggaatgtttataacatcgctattcataattgtcaaatactggaagcaacaaaaatatcattcaagtgaatgataaaccataatacattcatgcaatggaatactactaagcaaaaaagggaatgaatacaaacatatggataaattttcaagtcattgtgctgagtaaaagaagctagtctccaaagttatctaatgcatgatttaatgaatatgacattctctaaaagataataatatacaggagaaaaaattagtgtttgcccagggtttggagtggacagaggtgaagctacaaaggggtagcacaaagcagtcttttggagtgatgcagctattctgtatcctaattgtgatggtggttacacaaatctataccttcattaaaatttgtgcatctgttcactaaaagggtcatggttactgtacattaattttaaaataaaataaacaaggggaaaatgatctagtaactctacaaactggatcaagcctaaggtggagatcatgtcaaaatacaatacattttaaaatattcccattactcggtatttttcttaagacaataggtaaaaagaagtatattctgtgctccaaggtaagcaaatccctatgatttgcaataatgaaaatactaaaccaaagtgctccctcttgatcattgtttcgttgcattcttgcctatgttttcattaaggggcttattgccttattcagatgttttgccattgtgttgtggcaaaggcaaagcttctgtgtttggaggtaatcataacaaagcagaattaataataaataatatgaaaagacagataagtttctgtagtccaatgtaataatttcagggcatactaaagattcagtgaaaattagaaaaaaaaagcatattcatcagaatcagaaaatagaagtgaggaaataatttatgttaaagcatacagcatttgacagagtcaatgtcttttcttgccattaacttcagctaaacagcaatcgctttaggtaaattctacagatttataaattctttttgcatatactttattttaatgttttgcatatttaacaactaaagaaagaatcacctacaaatccttaactttaatagtgcctcacaatccattttgatttattttgactttgaggcatatataagtagtactcacatatttgtaatcatgtatatatttaacatatattccatttttaaatttatatttctacttagtattatcaataaggtatttcccactttccagaggaatacttataactgaaatactgatggaatctatgtcaaacttcttagcatgatatacatggagcttcataatctatcttcaattacttttctaaatgtatctccctattacatatccttccttgcaacttttgtagttttcaagagtcatattaacatgagattgagattttctgctcaatatcactagttatactattaataaaaacacaattttctactaacaatgttattgctgttcttaaggtttgaaacatttacctaaataataaatattagtaccaatgtcttcaaattcctaaaattataatttatttttactttggaataagaattaattttctctgatagtggaactgaattctttgactatgtgaattctgagggataataaaccaatagttgagaacctgtagctcatgaaagaatgtgttccatctcttccttaattgatcttcattaattgcacctcaattactctagtgtcaggccttattgcctttggtgttggttctgttattaaaatctattttttaaacttcccaattggtcccgcctgagtttaatggtgcaaaccatccaatatctatataaaaatgttaacatatttgaccccctatgatgcctcttctaccttcctttttctaaatttaaactctcatagttcctttggccattccactgtgaaataccatttagatccctcacaattctctttgtcactctctgaacatactctgatctgaggaatgaagccaaatactgagcaacatttatgctctttgcctcctgactgaggcagagttcagtggagcttaccttgctttcattgtgcacaccacttgagcttcaatctatgctgatcacagagtcatggagtgactagagtcaaataattagatcctgggcctcctgccaaacagctgtattattggtgcataatgtctctgactctcagtttttgcatttgtgaaatagaaataattgtccctaaaatacagctttgttatttgacttaaaggaatgatgatacctataaagcacccataggtgtttggtcatacatcagggctaagaacctaaatttcattaagtaaaaatgaagtattggtatatgattatttattcattttttatgagaagtaaattgtctttcaacacaggtcgggggattttcacctcaaatccaatataagacaggaagtacagtatctggtgccttcttggttctggactatgccatttagatatataacatgccaactgattgttgccttcccttcctctccactggacgcctaaggtcctctctagagttcttcattttggcatccattcatgcttgtctacctgggtcagggactctaactactcaaatattctttcaatacttaaatgcctgggtcacttttgatgatgaatcgagggtataggactgggagccccacccaacctgaaaatcagactgcttctttaagggagaccctgatccactcctcatctttggacaggaccttccaaccagggcctccaaccaccaccacccatattctctggctaacagttttgatttctccctggaattgagtgcctgtagggaggggcgggccaccatttttactgtttgggcaactcagccattccatcctgctggctttggagagttcaaacagattgggtgaagataggattccccaacacagcacatctgctctaccaaaacatagccagactgcttctttaagtgggaccccaatctcttcctcatctctgggcaggacctcccaaccagggcttccaaccacccctgcctgtattctccagccaacagtgatttgatttctccctgggactgagctcccagcaggaggggcaggccaccatctttgctgtttgggcaactcagttgttccagtctgtgggctttggagagcccaaactgaccagggttgaagcggtaccccagcatggcacagctgctccacaaaagtgtggtcagactgcctccctaagcatgtccctgatctattccttcttgctgggtaggacttcccaactagggcctccagccgctctcactgatgttttctggctgtcagaggtttgaaaacttcctgggacaaagctcctagacagaggggtgggctgccatctttgctgttttggcaacttagccattccagcctccaggttttggagagcccaagctgactaagggcagaattagtaccccagcacagcacaactgctctatgaaagcatggctagactgcttctttaagcaggtccctgatcctgttcctcctgactgggtgaggcttcccaacctgggtctccagccacctcctacaggtgcatttgggctggcaacgggtctatacccctctgggatggagtccccagaggaaagagcaggctgccatctttgcttttttgcagccttcactgctgatactgccacatactgaaaaatccataggcaactaggggctggagtggaaactcagcaaaacccacagcagccctatagaaaagtggccagactgaaaaaacaaacaaacaaacaaacaaacaaccaccataagctcacaaagatgagaaaaaatcagcacaggaacactgaagattcaaaaagccagagtgatctcttccctccaaatgaccacatcacctctccagcaaaggtctagaactgagcagaggctgagatgactggaatgacagaagtagacttcagattctggataaaaacaatcttcactgagccaaagaagcatgttctaactcaatgcaaggaagctaagaattatgaaaaaacattgcaagagctaacagacaaaatagccagtatagagaagaacaaaaccaacctgatagagctgaaaaacacactacaaaaattccataatgcaatcacaagtattaatagcagactagaccaagtggaggaaagaatctcagatcttgaagattgttttctgaaataggacaggcagacaagaatagagaataaaaatgaaaaaatgaacaaaacctccgataaatatgggattatataaagagactgaatctaccactgattggtgtacctggaagagatgaggagaatgaaaccaatttggaaaacatatttcaggatattaaagaggagaacttttccaacctagctagacaggccaacattcaaattcaggaaatgtagagaaccccagtaagatactccatgagaagatcatcaccaagacacataatcatcagattctccaagataaaaatgaaagaaaaaatgttaagggtagccagagagaaagcccaggtcacctacaaagggaaacccatcagactaacaggggacctctcagcagaaaccttataaggcagaagaaattgggggcctatattcaacattcttaaagaaaagaaatttctacccagaatttcatacctggccaaactaagtttcataagtgaaggagaaataaggtccttttcagacaaggaaatactgagggaattcataaccaccatacctgccctacaagagctcctgaaggaagcaccaaatatggaaaggaaaaaccattaccagccactacaaaaacacactgaagtaccacagaccagtgacactataaagcaaccacaaaaacaagtctgcaaaaaaaccagctagcatcatcatgacaggatcacatccacacataataatactaaccttaaatgtaaatgggctaaattccccaattaaaaaacataaaaaggcaagctggataaagaaccaagacccaataatatgctgtcttcaagagacccatctcatatgcaatgacacacataggctcaagagaaagggatggaggaaaatttaccaagaaaacaaaaaaacagaaaaaagcacgagttgtaatcctagtttctgaaaaaacagactttaaaccacaaagatcaagaaagacaaagaaaggcattacataatggcaaagggttcaattcaataaggctaactatcctaaataaatatatatgcactcaacgtaggagcactcaaattcagaaatcaagttcttagagatcttcaaagagacttagactcccacacaatactagtgggagactttaacactccactgacaatattacacagatcattgagacagaaaatcaacagatattcaggacctgccatcaactctggatcaaatgaacctgaaaaatatctacagaactctccaccctaaaacaacagatggtacatttttctcatggccccatggcacttactctaaaattgaaaaagtaagcagaagtaaaatactcctcagcaaatgcaaaagaactgaagtcataacagtctctcagaccacagtgcaatcaaattagaactcaagactaagaagctcactcaaaaccatactattacatggaaattgaataacgtgctcctgaatgacttttgggtaaataacgaaattaagccagaaatcaagaagttctttgaaactaatgagaacaaagatacaacatactagaatctctgggacacagctaaggcagtgttaagaaggaaatttatagcactaaatgcccacatgaaaatgctagaaagatctcaagttaacaacctaatgtcacaactaaaagaactagagaaccaagagccaacaaaatccaaagctagcagaagacaagaaataatcaaaaccagagctgaactgaaggagattgagacacaaaaaaccattcaaaagatcaacaaatccaggagctgtttttttgaaaaaattaataaaataggtaaactgctagctagaataataaagaagaaagagagaagattcaaataaacacaatcagaaattataagggggatattaccactgaccccacagaaatacagcctctctctcctcctgcaagccaagatgtcaaaaggaaagaaggccaaggggaagaaggtggctctggcccctgctgtcatgaagtaggtggccaagaaagtggtgaatcccctgtttgggaaaaggcctaagaattttggcactggacaggacatccagcccaaaagagacctcacctgctttgtgaaatggccccactatatcaggttgcagtggcagagagccatcctttttaagtggctgaaagtgcctcctgcaattaaccagttcacccggccctggaccaccaaacaactactcagctgcttaagctggcccacaagtacagaccagagagcaagagaagaagcagaggtggttggcccaagctgaaaaggaagctgccagcaaaggggatgtccccactaagagaccacctgttctttgagcaggagttaacactgtcaccaccttggtggagaacaagaaagctcagctggtggtgattgcagatgacgtggatctggacgtctactccacaggaagacctgcaccactgtcgccttcacacaggttaacttggaagacaaaggagctttggctaagctgttgtaagctatcaggaccaattacaatgacagatacgatgagatctgccatcaatggggaagtaatgtcctgggtcccaagtctgtggctcacattgccaagctcaaaaaggcaaaggctaaagaacttgccactaaactgggttaaatgtacactgttgagttttctggacataaaaataattaaagtaatacaaattttccttcaaaaaaagaaatacaaacagccatcagagaatattataaacacctctatgtacataaactagaaaatctagaagaaatgaataaattcctaaacacatacatacacccaagactgaacaaggaagaaactgaatccttgaacagatcaataaacagttctgaaattgaggcagtaataaatagtctaaataaataaataaagcccagtaccagacagattcacagctgaattttaccaaatgttcaaagaagggctgataccatttctactgaaactattccaaaacattgaaaaggagggactctttcccaactcattctaggaggccagcatcatcctggcaccaaaacccagcaggataaaaatcacatgatcatctcaatagatgctgaaaatgcatttaaacaattcaagttcctttcaagattaaaatgctcaacaaattacgaatggcaagaatggtcccttaacacaataaaggccatatttgacaatcccacagaaaatccttagatcccacagaaaattctgattttctccacaatcaggagcaagacaaagatgtacactatcaccacatttattcaatgtagcaatgaaagccctagccagagcaatcaggcaagaaaaagatataaacgccatccaaaccagaaagggagaagtaaagttaccccatttgcataacacatgattaaacatatataagaaaaaaataaagatgtcagacaaaaacaaaattttacaactaagaaataaatttagctaagttgcagaatacaaaatcaacatgcaaaaatcagttgcattttttacaccaatgacaacctatcagagaaagaaatcaagagtttgctgaaagaaataagatctggactggcatggtagctcatgcctgtaatcccagcactttgggaggctgaggcaggtggatcacgaggtcaggagttcaatatcagcctggccaatatggtaaaactccatctgtactaaaactacaaaaattagccaggcgtggtggcactgtagtcccagctacttcaggagactgaggcagaagaattgcttgaacctgagagatggatgttgcagtgggccaagactgcaccactgcactccagcctgggtgacagagtgagactccatctaaaacaaaaaacaaaaaaaacaaggccaggtgcagtgactcatgtctgtaatcccagcattttgggaggacaagctgggcagatcaagaggtcaggagttcgagaccagcctggccaatatggtgacaccccatctctactaaaaatacaaaaattagccaggcatggtggcatgtgcacgtagtcccagctactcaggaggctgaggcagaagaatcgctggaacccaggaggcggaggttgcagtgagccaagatctcaccactgcactccagcctgggtgacagagtgagattcagtctcaaaaaaaaaaaagaaaagaaaaagaaaaaaagaaataagatataccattagataggtcagtagggcagtagagtgactgtagtttacaataatctattgtacacttcaaaagtctagaagggaattcaaatggttttagcactaaaaaaagacaaaatttaaggtgatggatattccacgtacactgattcactgatttgacctttacaaacgatattaatctattaagttattacatgtaccccaaacaatgtacatctattatggatgagttaaaaagaggtaaaaaagaaattaaaaaagcaaactcatttaggatcacatcaaaaagaataatatacttagggttactttttttttttaatttttcttgagacagtctcactctgttgcccaggctggagtgcagtggtacaatatcagctcactgcaactgccacctcccaagctcaatcgattctcccacctcagcctcctgagcagctgggactataggcatgctccaacatatccagctaatttttgtatttttagtaaaggcgggtttttgtcatgttggccaggctggtctcaagctcctgacctcaggtgatccactcccctaggccttccaaaatgctgggattataggcatgagccactgtgccaggcctacctagggttacttttaatcaaggagggaaaagacctctacactgaaagctacaaagcattaagaaagaaattgaagaaaacacagataaatgaccccaaatagtaaaacaattttaaacaagaaaggtaaggctgggggcatcacactttctgatttcaaattacattaactaagctatagtaatcaaaatagtatggtgctggcacaaaaataaacccacagaaatgcaaatcaacaccgtagtgacttatcacctcacaccattaggatgactactatcaaataaaaacagaaaataacaaatgtggatgtgcagatattgaaacccttgtgcattatttgtaaaaacgaaaaatggtgcaggcagccactgtggaaaacaacgtggcagttcctcaaaaaatcaaaattagaattatcatataatctagcaatttcactttttggtatatactctcctaaactgaaaaacaattgggtatatacccaaaatattgatgtatttgtacagctgtgttcatagcagtattcttcataatagcccaaaggtgaaagcaacccatgtgtccatggatagataaatggataaacaaaaaatgtggtatatatatatataagaaaatatttttcagtcttaaaagggaaggaatcagtgtgaggatgggtggattaaaaacaaaaagaaggaaggaaattctgaggtatgctacaacatggatgagccttgaggacattatgctacatgaaatgagccaatcacaaaaagacaaatactgcatgattctacatgtagaagttacttagagtagtcaaattcatagagacagaaagtagaatggtgatttactgaggctgaaagtgagaggggaatgaagagttactgtttactagttacagtttcagtttcaaaagatgaagcgttctgaagatagatggtggtgatggttgtataacaacgtgaatttttttttggttgtttgtttctttgtttatggagtttcgctcttgttgcccaggctggagtgcaatggcacgatctcggctcactgcaacctccgcctccccagctcaagtgattctcctgcctcagtctcccaagtagatgagattacaggcatgtgccaccacatccagctaatttgaatgttcttaacatcactgaactttacacttaaaatggttaagttggacatttttgttatatgtattttaccacaattaaaatcaattttaaaaagtatatatccccagaggtcaacagaaagactagagagcacagaaataaacccatgcatatatggttaactaattttagacaaggttactgagcacacacaacagcaaaaggataatctccatagtaagcacttttgggaaaactggatatgcacatgtaaaacaaagaaattgtactcattttaaaccattctcaaaaaccaactcaaaattgattaagaccaaaacatgatacctaaaaccgtaaaactcctagaggaaaatacagggggaaatctgcttgacattgaccttggcaattattttttggatttgacagtaaaagctcaggtgagaaaagcaaaaataagttacagcaaactaaaattattctgcagaacaaaggatacaatcaacaaaataaaaaggcaacttatggtttgggggaaaatatttgtaaaccacatatctgataagagattaatatccaaaatatataaataaagaacttacacaactcaatagcaaaaaaaactccaaataactagattaaaaattgggcaaaagatctgaataaacatttttcaaaagaagacataaaaatgaccaacaggtatatataaaaacatgcttaaattactagaaaatctagaagaaatggataaattcctcgacacatacacccccccaagactaaaccagaaagaagttgaatccctgaatagaccaataacaggctctgaaattgaggcaataattaatagcctaccaaccaaaaaaagtccaggaccagaccgattcacagccgaactctaccagaggtacaaggaggagctggtaccattccttctgaaactattccaatcaatagaaaaagagggaatcctccctaactcattttatgaggccaacatcatcctgataccaaagcctgtcagagacataacaaaaaaagagaatgttagagaccaatatccctgatgaacatcagtgctaaaatcctcaataaaatactggcaaaccgaatccagcagtacatcaaaaagcttatccaccataatcaagctggcttcatccctgggatgcaaggctggttcaacatatgcaaatcaataaatgtaatccagcatataaacagaaccaaagacaaaaaccatgtgattatctcaatagatgcagaaaagtcctttgacaaaattcaacagcccttcatgctaaaaactctcaataaattcggtactgatgggacgtatctcaaaataataagagctatttatgacaaactcacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtttgcagatgacatgattggatatttagaaagccccatcatctcagcccaaaatctccttaagctgataagcaacttcagcaaagtctcaggatacaaaatcaatgtgcaaaaatcacaagcattcttatactccaataatagacaaacagagagccaaatcatgagtgaactcccattcacaatttcttccaggagaataaaatacctaggaatccaacttacaagggactagaaggacctcttcaaggagaactacaaaccactgctcaacaaaataaaagaggacacaaactaatggaagaacattccatgctcatgaataggtagaatcaatatcgtgaaaatggccacactgaccaaggtaatttatagattcaatgccatccccattaagctaccaatgactttcttcacagaattggaaaaaaccactttaaagttcatatggaaccaaaaaagagcccgcattgccaagacaatcctaagccaaaagaacaaagctggaggcatcatgctacctgactttgaactatacaacaaggctacggtaaccaaaacagcatggtattggtaccaaaacagagatacagaccaatggaacagaacagagtcctcagaaacaacactacacatctacaaccatctgatctttgacaaacctgacaaaaacaagcaatggggaaaggattccctatttaataaatggtgctgggaaaactggctagccatatgaggaaagctgaaactggaccccttctttacaccttatatgaaaattaattcaaaatggattaaagacttaaatgttagacctaaaaccataaaaaccctagaagaaaacctaggcaataccattcaggacataggcatggacaaggacttcatgtctaaaacaccaaaagcaatggcaacaaaagacaaaattgactaatgggatctaattaaactaaagagcttctgcacagcaaaagaaactaccatcagactgaacaggcaacctacagaatgggagaaaatttttgcaatctactcatctgacaaatggctaatatccagaatctacaaagaactcaaacaaatttacaagaaaaaaacaaacaaccccatcaaaaagtgggcaaaggatatgaacagacacttctcaaaagaagacatttatgcaggcaacagacacatgagaaaatgttcatcatcactggccatcagagaaatgcaaatcaaaaccacaatgagataccagctcacaccagttagaatggtgatcattaaaaagtcaggaaacaacaggtgctggagaggatgtggagaagtaggaacacttttacactgttggtgggactgtaaactagttcaaccattgtggaagacattgtggcgattcctcagggatctagaactagaaataccatttgacccaacaatcccattactgggtatatacccaaaggattataaatcatcctgctataaagacacatacacacgtatgtttattgcagcactattcacaatagcaaagacttggaaccaacccaaatgtccatcaatgatagactggtttaggaaaatgtggcacatatacaccatagaatactatgcagccataaaaaaagatttcatgtcctttgtagggacatgggtgaagctggaaaccatcattctcagcaaactatcacaaggacagaaaactaaacaccacatgttctcactcataggtgggaattgaacaatgagatcacttggacagaggaaggggaacatcactcactagggcctgtcgtggggtgggggtagtggggagggatagcattaggagatatacctaatgtaaatgacaagttaatgggtcagcacaccaacatggcacatgtatacatagtaacaaacctgcacgttgtgcacatgtaccctagaacttaaagtataatttaaaaaaaagaaaaaaaacagacttgttgatattgctattcatcaaggaaatacaaatcaaaaccacagtgagatatcacctcatacccattaggatggctattataaaagacaagtgataacaagtgtttgtgagggtatggagaaaaaggaaccttgtgcactgttggtaggattctaaactggtgtagacattttggaaacagtaagaaagttcctcaaaaaattaaaaatagaactacatatgacccaaaagtccctttgctgggtatatactcaaaggaaataaaatcagtgcctcatggagacacctgagccaccataaatggataaacaaaatggtgtgtgtgtttgtgtgtgtgtctgtgtacacacacacacaatggaatattattcagccttttaaatatacatattaaatattcagccttttaaatatatattatatacatacagacacacacacactacacacacatgcacacaatggaatattattcagccttttaaaggaaggagatcctgccatttgccacaacatggatggtcctgaggacattatgctaagcaaaataagccaaacacggaaagaaaagtattgcatgatctcatttatatatacgaaatctttttacaatgtcaaatacacagaaacagagagcagattggtgggtaccaggaggagggtgtagtaggtaatggcagatgttggtcaaaggctaaaatgttgcagctgtttaggataagttgagcaatctaatgtacaataggaagactacagctaataatattatacccacaaaatttgttaagggagtagacttttttgtttctttatttttcacttttatgggtgcatagtaggtgtttatatttatggaatatattagatattttgatacaggcatacaatgtgtaataatcatatcagggtaaatggggtattcatcacattaagcatttatcatttctttgtgctacagattccaattctactttttaagttttattttaaaatgtacagtaaattattgttgactatagttaccctgttgtgctgtcaaatactagatcctattcattctgtttaactatatttttatacccattaaacatgtccccttccacccaccttcactactcttcccagcttctggtaaccatcattctgccaagagagtaggttttaggtgctccaaccaagaaaaaaaaagataactatgtaagatgatgcatgtgataacttgcttaattgttacagttatattatgtacatgggtaacaaaatatggtgtataacttaaacatatacaattttttaactcataaaacagaagaaaaatgttgtaccacttctttctggttttatagttttggatgagaaactcattgtctttcaaaatgcttttctcttctaagtaatatgtcctttccgtctggctgctttcaagatttttctgtctttatttttcaaaagtttaattaggatgtgtcttgttgtggatttccttgggtttatcctatctgagatttgctcaccttcctgaatctgtagctctatatatctttgaccaatttggaatgttttcaatcattacttctttgattacttattgaatacccctttccttctgagattctcaggatataaatattagctctcttttactgtctcataggttcatgtgttctgttcttttttattgttccaatctattttgtttattgttcagaacaggtaaattctattcatctttattcaagttcactgattttgtcctctgtatctctattctgctactgagttcatccagcaagtttgttgttttttaatatttctatgagtatgttttgcagttttataatttccatttggttcttatttgtaacttctatttatttgctgaaattctctatttttatttctttcaagaaaattaattattgcttcttgaatcattttttatggctgctttaaatctttgttagaaaatttcaatatccgcttcatcttagtcttagtgttggcatgtattgccttttctcattcaagttgtgttttccttggaatgaaaattgatatttgaccatatcatggacattctgaatatcatattatgagactctaaatctctgaatcgtgcccagtctttttcagcagtcatccttgttgagctgtagctgaaacttccaggtatgttccagtctgctgaaaatggagagctgactcatactactttcttccagatgggtgaggggaatgttcagctccccactgctctgttgacttcatcccagtgaagggcattgatttgtatgcctccttacctttcaggtcctgcttcctgttgggaccaattgaccctaaggaaaggtgaggtggctagctggttcacactacctcattgcagggagggttggaagctcagctcctcactggaccaccactcacattggagcaggagagtcatgatgggggctgtagaataccagctagccctacctcacaccatctcattaagtcttgttgctgccaggtgacagtggaggctcctttctccactgaaccctgctgacattaccctggcaggggaatcagagtcggggcaaggtgaagatcagcatgagatggaacagggactcctcttagggatccatgggccccctcaagcatagaaataacagaaaaaaaaattgagttttttcaagggaaatttcagacacctagctagctctgagaagtaaatgagaaacttgatatgaaagaaagtaatagtggcgtaaaacaatagccaaggaagttagaattacgggatgtttggttctcctgtagaaacttaagatagcatcttaacaacatatgtccctgggttgtttttcagaaacctggacccccaccagatgaaaaattccatctgctggcacatagacctcagataaggaggaaatgaggactgaagtctgaccacagccatgctttgctctaaatttcttcctgatgggcatgggaggggtcacactccaaggccagaactaatattcttttctgctaatcccaaagttttaaacaaagttttgcctcctgaaccaactgcaaatcagaaaatcttcgagtccacctatgatctgttccctatctccacttcaagatctgccacccttttaggtcaaaccaatgtattgcctccatattccgatttatgactttgcctgtcaactctgcctccccacctttaaaaatccttacttgcaagccattggaaagatcgggacttgagcaagggctgcttgattctccttgcttggcactctgcaaataaatgctctcctttctcctgctataaacctggtgtagatgtttggcgttattgtgcagggcaagtggatcccagttcagttggaaaacaggctccctgattggccccactgaaacataatttttccattggtttttgtctagagtaaggcaggaagtgcctaaatgttttcttttctctccaggccacccttttcccagttctttgaccaggagagaacagtcttttcttacagttgttttttgttttttgcttttgtctgtgtctgttggcagtcctaagttggaattttctaaaggatcctgtcctgggtatgtggaagcaataaggaaacctcaaaacttcattgctatgttgtttttcaagtccaatagttcctaggcagttaaccctttttattccacctttgaaagtcttcctacttgtttttgtgctacatatagggattttttggtaataagaggaagggcctggaagaaatggggctacttcagcatcaaggtaatcaaaaatctatgccttcaaacatgtagaaatatgcagtttcttatgtatttcatgccacaaagttggtgtaatacaaattagcctgccatatccagatatagaagtctctatacttactgtgaacagaaagggtttgctagaaagaaatgtgtcagagacaaatgaaagttcatggtgaagtgttctcaaattgcccttcactccacaggaagtatgtgccttaaaaaaagccaaagtattatgagaatatttgtgccattgatcttttgcttaaccttacgtgcctcagttacatcctttgtaatacaataatttttaaaaaaactttaaagagttattccaagaaataattaggttaatactttacttgtaaacagtgataacagtgcccagaatgtagtagacagtttaatcctgttactactattactaacatttgacttctagatcttttagctctccaaccatgcaaatgcataaaggagcaactatttagtaaagtgtgaattcaaaccttttagtaaactaggctgagattctagttgctaatctaggttataaaagtgtcaaggaagtgatgtagatgtgctgaggatgggtttgttgtaaaagcctgtctctgttatagcaggatctcacctaaacattcagtcacttgaatcaggcagaagcattcagctgatcagtggccaggattcaaagtcagcagagtcagcagttcaagcaggaacaaatgcttcattcagccatccattaattcattaattttttctttatctctccattttaaatatgcaagtatgcttattaagttctagaaactgtttgaaaattaggtacatggggagaagaaaagatgtggtagattctacatgaaactttcaacactgtcaagaaagcaaacactaaatctgtatctacacgtgcattgagtattctcaagagaagagatagggttctatgtaatatcattatttgaagttctactaaaataacaagcatcatgagaaagtatttttctaacaagctctctcttcagagcccccttaatctccttgttcctgaggctgtagatcagggggttcaacatgggaatcaccactgtgtacaacacagacaccaccttgttctggtcagttgagtagctaaaattgggcatcacataaatgaaggtaatggtcccatagaacagggtaaccacagtgaggtgggaagtgcaggtggagaaggccttgtggtgcccctcagtggagcgcatcttcaggatggtgatgaggatatagatgtagcagacggctatgacacacacagtgaccacaatgatggatccagaagaaaatgagagaacaactgtggagacactgatatcagaacaggagagttcaagtaagggagcgaaatcacagaaaaaatgattgacttgatttggtccacagaagagtaaaaaatagaaggaagtagtataggagacagcaatgagaaaaccagctatgtaaactactaagagtagctggacactgacttgtgtggacattttggttgaataaagcagtggactgcaaattgccacaaagcggtcataggccatggcagccagaaggacgcattcgactgttgcaaagaaagccgctgaaccaagctggatggcacatccaaggtaggagactgtatttctctccaccaggaagtttacaagcatgttgggtgtgacagaagatgaataggccatgtcagcaaaagccaagtggctcagaaagaaatacataggatgatggagctgagaagaaattctgataagaataattatgctgagattaccagataggatgatcatgaagaggatgactcgaaggattggatcatctgttaagcccaataggatgaaccccgtcagagcggtgtgattcccgtccttcagggaattcatgagacgaagtagctgctgactaaatgaaccctaatgagaacagcacattaaaatgttataaatttgatggcttcatcttcattaatatatacatgaaggttaatatgaacagatgtatcattcaaggaaagttcagacttttttttttttaccttagggtttcattgtttatgtatttatgtgtaatcagtctttctatattttaaaatctgttttagaacaccaaaaaattgcttcaaataatgtatatccttttcaatttgtatttttaatgaaatatatttaaagttgctttaaagagaaagattttaaaacataagacttataagaataataaaaggtatggtacatataacaaaaatgattaaaatatattaatgtaagattaatgaacacaaatattagctaacatttactgaatgcctatcaaattactggctcagggttaagaattttatctatatgcatataatatataacatattattgtattatatacattatatatacagagatacgtattttaatttccataaaataatatgaagcacttttattattaccattttatagatagggaaactaagtttgcaaatgttaagtaatttacctaaggttacacagcaagtggtagaatctggatcagaatcccacatagtttgaatccagtcaatttccataataactatgttattaatgtaatttgtataaaattgtataatttgtataaaattgtaaaaccattacatttatagcatagttggagaatttttaccatgaaatctggtacacttgaaaatcagtagataacagattaacatttcagttctctgaaatgtacaactgatgtataaaagagacgcctagctagttacatagtttacaatgtttatcagttaaacaacactagttttttaaaagagacatacaattttcttcataggacagggaagaaatgggaatttcaagttatgcttatgaatgaagtcacctagtataaattgattaatgacttttattatttccaattaaaatattattatatcaagtaagttgaaataccaatttaaccattatgcaaaatgttgtatgattaatattcagaacataattaagatatttagtcaaaccaaatcttttcctagtgtaacaatgttaacaaattgaagtattatagaatcaaataatattattttggacataatatacagaagaacaaagtttcagcctagaaatataaaaagtttaccaagggccactctgttgatggccagcttgaccctcatctccaagttttctggccttatagccttatctttctccgaaatgtctagctgggccagccatggtggctcacatttgtaatcccaatactttgggaggccgaggtggacagatcactggagtccagaaatttgagaccaacctgtgcaacatggcaaaacttcatctctaaaaatgagccaggcacggtggtgtgcacctgtagtctcagttacttaggaggctgaggtgggaggatcacctgagcctgggaggtcaaggctgcagtgagccatgattacaccactacactctagcctcagtgatagagtgagaccctgtctccaaaaaaaaagtgtcttgggccaggcatggtggctcacatctgtaatcctagcactttgggaggctgagatgggtggatcacttgaggtcaagagttcgaggccagcctggccaacaccgtgaaaccccatctgtactaaaaatacgaaaattagctggcatagtggtgcatgcctataatcccggctactcgggagcctgaggcaggagaatcacttgaacctgggaggcagaggtcgcagtgagccaagatcacagcactgcactcccagcctgggtgacaaagtgagactcacacttaattaatttatattagcattacagctgagtgccaagtttagacggcagtgaaagaccacgtgagtttctgttcttatgggtggataaatgaagaatcttggtaaattgaatcatgcctgttaactcacactaaattgatggcagaaacttaatttaattcactaaagttacttgctagctgactgcaagattacatctgttttgtttcttaattatgacttgtgtgtacacatacaactttagagaataaagtgttctcaaatgaaactcattacaccagattcacccacaaatcgaaagtcttacctcatgaaataaaaatttaatcatctggccgggcgcggtggctcaagcctgtaatctcagcacttttggaggccgagtcgggcagatcacgaggtcaggagtttgagaccagcctggccaacatggtgaaaccccatctctaaaaatacaaaaattagctaggctcagtggtgcacgccagtagtcccagctacttgggaggctgaggcaagagaatcgcttgaacccgggaactggaggttgcagtgagctgagatcgcatcactgcactccagcctgggcgacagggtgagactccaactcaaaacaaacaaacaaaaaatgtaatcatcttacacttataaatttagattccttgttattatatagtagccacactgtattattttttgcctttggggataaatctctgaagagtctagagactcaaatgtgaattaaaagcagcaggaatcattatcacatcctcaagtgaatattgagcagttcaactcacaaaaacacacatagtctttaagaggttgtcaattctcagatgatcaatttttttcattttgtctgaggggtggtgcactttcatttgatagttaatgggagtataatataatgcattatctcacagccaaatattggttctaagtttactttgatacttcaggttaaagaatactaaactgcaaatataaaacagtaaacagtttcattcattcaacaaatgttcattttctaagtattttgtagtgttagagaacgttcaaataaacacaattaggaacaacaaaggaaatattactactgaccacatagaaatacaaataatcatcagagacttctatgaacacctctatgtccacaaactagaaaatctgggaaaaaaatggataaattcctggacacatacactctcccaagactgaatcaggaagaaatggaatatctgagcggacaaatagcaacctcaaaatgaaaacagccaactatgaaacccacagccaacatcatactgaacaggcaaaagctggaagcattgcccttgaaaactgtcacaaataaggatgccctctctcaccactcctattcaacacagtatcggaagtcctggcaagagcaatgaggcaagagaaataaatacaggacattcaaataggaagaaaggaagtcaaaccattcctgtttgcagatgacatgattctgtatctagaaaaccccaacgtctcagcccaaaagctccctaatttgataacttcagcatggtctcaggatacaaaatcaacatacaaaaatcactagcattcctatatgctaacaacagccaagctgagagccaaatcagaaaggcattcccattcacaaaaagcataaaatacctaggaatatagctaaccagggaggtgaaagatttctacaatgagaattacaaagcactattcaaagaaatcagagatgacacaaacaaatgcaaaaacattccacgctcatggataggaaaaaatcagtattattaaattggccatgctgcacaaagcaatttacagattcagtgctattcctattaaactaccaatgatagtctccccagaactagaaaaaaattaattcatatgtaatcaaaaaagagcccaaatagccaaggcaatcctaagcaaaaagaacaaagctggagtcatcacgttgtaatactcgaattcagactatactacaggactacagtagccaaaacagcctggaactggtacaaaagtgacacattgaccaacagaacagaatagacaacccacaaataaggccacacatacaaccatctgatctttgacaaagctgacaaaaacaagcaatggggaaaggactgtctattcaataaatggtgctgggataactggctaatgatatgcagaagattgaaactggacccctttcttacactacattaaaaaaaacttaagatgaattaaagacttaaatgcaaaactataaaaaccctggaatataacctaggcaataccattctggacataggagctgacagagatttcatgacggaaatggcaaaagcaaatacaacaagagcaaaaattgacaaatgggatccaattaaactaaagagcttctgcacaaaaagagaaactatcatcagagtaaacagacaacctacagaacgggagaaaatatttgcaaactatgcatccaacaaaggtctaatatccagaatctataataaacttacacaaacttacaagatgaaaacaaaaagcccataaaaatgtgtgcaaaggacatgaacagacacttttcaaaggaagacatacaagcatatggaaaaaaagctcaatatcattgatcattagagaaacacaaatcaaacccacaatgagataccatctcacaccagtcaggatggcaatcattaagaattcaaaaaaaccagatgctggtgaggttgcagagaaaagggaatgcttatacactgttggtgggagtgtaaattagttcagccattgtggaaagcagtgtggtaattcctcaaagaggtaaaacagaactaccatttgacccagaaatcccatttctgggtatataccttgatatggtttggctgtgcccccacccaaatctcatcctgaattgtagctcccataatctccatatgtcatgggagggatcttgtgggaggtcattgaatcacggaggcaggttttttccatgcagttcttgtgatagtgaataagtctcactagatctgatcattttataaagggcagctcctctgcacatttgctcttgcctgccaccatgtaagacacgcttttgttcctcctttgccttctgtcatgactgggaggcctccccagccatgtggaactgtgagtttattaaactcacagttttctttataaattactcagtctcgggtatgtgttcagagcagtatgaaaatggactaacacatacccaaagaaatataaactattctatcataaagacacatccccatgtgtattcattgcagcactagtcatgatagcaaagacatggtgatatggtttgactgtgtcctcacccaaatcacatcttgaattgtagctcccataattcccatgttttgtgagagggtcccagtgggagataattaaatcatgggggtggtttcccctatattattctcatggtagtgaataagtctcataggatatgatggttttataaggggtttccacttttgcttggttgtcattctctcttgcctgccaccttgtaagacatgactttgctcctcctttgcttccaccatgattgtgaggcctccccagtcatgtggaattttgagtcaattaaacctctttcctttataaattacccagtctcagatatgtctttattagcagtgtgagaacagactaatacacatggaatcaacctaaatgcccatcaatcgtagactggataaagcaaatgtggtacatatacaccacgaaatactatgcagttctaaaaaagaacaagatcatgtcctttgcagaaacatggatggagctggaggccattatccttagcaaactaacacaagaacagaaaaccaaatgtcgcatgttctcacttataggtagaagctaaatgatgagaacacatggatgcaaaaaaggagaacaacagacactgggggctaccttaaggtggaaggcggaaggaggaagagaagcagaaaaaaagctattgggtaccaggcttagtactggggtgacaaaataatgtgtacagcaaacccctgtgacatgagtttacccatataacaaacatgcacatgtagctgaagctaaaataaaagttttaaaaatatataaatgggccagtcatggtgactcactcctgtaatcccagcactttgggaggccaaggcaggtggatcacttgaggtcaggagttccagattagcctggccaacttggtgaaaccccgtctctactaaaaatacataaattggctgggcttggtggcgcacacttgtagctccagctactccagaggctgaggcacgagaatctcttgaacctgaaaaacagaagttgcagtgagccaagatcatgccactacactccagcctgagcaacagagcaagacttctgtctcaaaaaaaaaaaaaaaaaaatatatatatatatatatacacacacatatatgtatatatacacacacacgaataaacaaataaatttacaaaaaaattgttaattctcaaaaaaatgacctatgtagtccatgaaacttttgtagggattgataaactacatataagatttacatagatatgcctactagctggaataaataaaaccattttagaatggaaggaaaatgactactagctggaataaataaaaccattttggaatggaaggaaaaagttttaatatttgcaagacatgatttcaagacttttcataagcctacagcagtcaacactgttatattggtgaaaggttagatatatagttcaaaggagcagaaaaaatgatgtaaaaatagacacaagtataaatgatcaattgatttcagataaatgttaaaagaaattctaagaatagaaagagtctgcaacaaatgttactagaacaactgcatatacacatgaaaaatataacacctacccttaactcacaacataaagaaaattaactcaaaatgtaccatagatgtaaatgcaaaaaaataaaaaaaaatttctagatataaacataggagaaaatttttgcatttgggaaataagattttttggcattacacaagaaccacaaaccataagagaggcaaaaaaaattatactttggttatgaattgaatttttgtgtcccctaaaattcacatgttggagccttaacttccaatatgatggtatatgaagatgaggctttggggaggtaattggggatataggaggtcatgagaatggggccctggcctgatgagatcataaccctaaagaagagacctcagaaactgaccatgctggcatcctgtttctgtagaattataagaaaataaatgtctattgtttaagcccccagtctaagtattttttatggtagcccatgctgactgatacattagacttcatcaaaatttaaaacgtttgttcttcaagtgacagcaaaccaacacagaaaaggatataatatttgcagtacatatatctcacataggccttatgttcagaaaagagaacaaaaaattacaaactttcgctgaccatctgtttgtttaaataaagttttattgaaatacaaccatgcccatttgtttacatattatatatgattgcttgtgcattttagtgacagagatgagtagttatgacagattgtttggccaatgagcccaggatatttctctctggcctttaagatcttgccaactcttgaacaagaatatacaaagaactcttataaataaataagaagtaaaacagcccaatgttaaaaacagatgaaacatttgaacagacattatatatttaattaattttttcctgcttgccgtctgtaaactacttttaaacccatctagttattttatctttgcagtgactgtattttttcagctatagagtttatccttttttatatagtttctatttttctgattagatctatgttggtttgtttatgcattttttaagcctttgaacatattacaataccttctttgaaatcgttgtctcctaaatccaacaattgttatttggagtgggtctcaattgaccaccattttttattgacatggcttatactttactgcttcttttcatttttttagagacttttgttcaaaaataggacattataggtaataattgtaatgactctgaaatctgttatattcttctgatggttgttggttttatgttgtggtagatagctgtcttctctatacttatactataaagcatatagtagactcttttccgtttgttttgcaacacgtgatctatttgttcaattcatttggcttccagctgctgttcttttaacctggcgtgtaggggaactctttcatgattgtgaatttgtcaataatttaataatttgggcagtttattatcagtttggagaacagggttcagcctgtctgcatttagttcccttgcatgtaggtgcccatcaaatttccagctgctctttttttcccaagctctgtcatctgaccattcaagtcattaatgttaaatttttatctgatgcctgggcttacaaattctatccgtcaaaagtgcaacaaaataggggccaatatggctgattagaagcatctcttactcacctcctttaattaaaataaccaaaatagtgaagagataatcactctttgaatagatcatccaagagaaaacactggaattcaacagagaagtggtgacaaacacctaaagcaagggaaaggcagggagcaaggcagtctgcttagccaagatcagtggggaaccagaaaagactccctaatgcagggaaaatgtaaatgagagatttccagtggtccacattcccaccaagaaatcctataatcctagccaatggagagctgcatgacccttgcaggccccgagaataacatagggagtccctggaaaccacacaaaggcattgcttcagaaagagaggtcatgctgggtcccacaagccctgaagtcctgggcacagcaacaagatgccattttgagagcccagcccacaccagactgcatcttgtcctgcaacctgggccaatatggcagccaccagcgcgattctgccccacccctgcagagggctgcacattctcacatatcctgaggatgagttctgctgcctgcaactgctgtaggtgtagactgctatgggctgaggtacactaaaagcccacacccccagctgcctgcctatgtctgcccccaggaaaagcaactccaccctctacagtagcacacccactgcctcctccacctgagcattctgtcagaggccttgggcttaccctactactgcacaccatagccaatgtgtttacacaccaacaaggggcctgaggacacaggcaggcctggttgcccccatcccaagtacctgagcacagcatccaggaacctgggactctcacagtctagtccactactagtggcatctgagctcttctcctagagtctaaagctggacccactcaacctgccactgccaccacagctagcacctacctccatatgccacgtgtgggtctgttaacactgttaacaccagtggggaccacctgggtcccaaagtgctgtttcaccactgctactgccattgcccaagcaacacccactctttaggggctcaagaacccaccccacctcccaaccctccactgatattcccaacaatagagcaagccacctggaggcccaagaattggcctgcctcgacccactaatgctggtgctctggggcccaaagacaggcacactcagcccaccgctgctaccactggtgtctgaagactggtctacctggttgtccagtccccagcaaaacttcagcaaaaccttcactaacaactacaccttgagccactgaggaaattacagacgtcattgacactgtttacagccaaagaaataatacagagactacactattaaatgcacccagaatcaaagctaaagtgtaatacccaagcagcaccatagatatatcttcaggaaaaaatccttctctccaaagacaaatttaaaaaaatgtaaaaagcaactgttaaatcagatgtgcaggtatcaaagtaaggacataggaagaagaaaaaacaaggatatatgacacttccaaagcaacacaataattctccagcaacagatcctaatcaaaaagaaatttatgaaatctcagaagaaagaattcaaaattttgatgctaaagaagctcagtgacatataagagaattctggaaaacaatacaaagaaatcagaaagacaattcagaacatgaatgagaaatttaccagagatagatataaaacagaaccaaacagaaatcctggaagagaataattaattgaatgaaatacacaatgcatttgaaagtttcaacaataggctagatacagtaagaaaaaaaaatcagaatgtgaagacaagtcttttgaaataatccagtgagcaaaaataaaaataaaaaagaataaatcccttatgacatatgagatcccataaagtggcccaattttcaaatttcacctaaagaaaggtgaaacaaagggcacagagccacctctctgtacatactcagtaaactggtcaaaaccagtctatagccagcagtcatttagcaaaaaggaatgctttgtagacaaggagaactgcaatgctagaaccatgaaaacaaaaggagtggtgtcaggtggtcaaattaaataagtggaggtgttttcctgtcttttgttctcccaagctggcttttgagaaaatctggtaataataagtaaggggaagccaagagtgggatataaccaatctgtctcatcatggccaggaactcaaaggttttggggtattttagcctagtgggttgtattagtccattctcacactaattttatgctaataaagacacacccaagtcttggtaatttataaaggaaagaagtttaattgactcacagttcaggctagctgaggaggcctcaggaaacttacaaccatggcagaagaagaagcaaacacgttcatcttcacttggcagcagcaagaagtgccaagcaaaaggggggaaagccccttataaaaccatagatcttgtgagaactcactcactatcatgagaacagcagcatggggtaaccacccccaagattcagttacctcccaccaggcccctcccacatgtggggattatgggaactacaattcaagatgagatttgggtggggatatagccaaaccataccaagggtccattagtgtgtcgatggggtggggggttgaacctttgtttcagtcttcaaatggagtgaagaacaaaaattatatagtcatctcaataatgcagaaaaacgtgaaaaaaattaacttccctttatgattaaaactctcaacaaactacccatagaatgaacatacctcaaaataataagaccttatatgacaaactcacagctgacatcatactgaatggggaaaaatggaaaaccatttctctaagaactggaacaaaacaaggatacccacattcagctctactattgaacatagtactggaaatcctagccaaaacaatcaggtgagagaaagaaataaccatccaaattggaaaagagaaagtcaaattgcctctctttgcaaaccacatgattttctatttttaaaaaccaaaacatgtcatcaaaaaaactcttagaactgatgaaacaaattcagtaaagttgtagaacaaaaaatcaacatacaaaaaattaataccatttctatataccaataataaaattggaaaaaataaatcaagaaggcagttcatttataatagctatcaaaaatacctagaaataaatcataaatactacaatcaaatggaaaaacattttatcctcaaggataggaagaatcaatattgttaaaatggccatactgtcataagcaatttacaattcaacgctattcctatcaaactcccaatgacatttttcacagaattagaaaaaaaaactattctaaaatttacatgaaaccaaaaaagaacccaaatatctaaagtaatcctaagcaaaaaagaaaaaagctgaaggcatcacactatttggcttcaaactatactatgaggctacagtaaccaaaacagcatggtactaattcaaaaacacacacatagagcaaagggacagaatagagaacccagaaataaagccatacacgtataaccatctgatttttaacaaagttgacaaaaacatgcaaaggaaaaaggcctcactattcaataaatggtgctggaataactgtctaaccacatgcagaagcctgaaactgggccctttcttttcaccatatacaaaaatcaactgaagatggcttaaagacttaaatgtaaaaactaaaactataaaaaccttgtagaaaacctaggcaataccattctggacatagaccctagtgaagatttcatgatgaagacaccaaaagtaattaccacaaaagcaaaaattgacaaacaggatctaattaaactaaagagcttctgcacagcaaatgaaactatcaacagagtaaacagacaacctacagtatgggagaaaatatttgcaaactatgcatccaatgaaggtctaaaatccagcatctataaggaacttaaacaaatttacaagaagaaaccgaccccataaaaaggtgggcaaaggacatgaataaatacttctcaaaagaagacatacatgtggccaacaagcaaataaaaaatgttaacatcaccaattattagagaaatgcaaatcaaaaccacaatgagatacccatctcaaatcagttagaatggctattatgaaacattcaaaaaataatagatgctgctgaggctgtggagaaaaggaatactaatgcactgctggtaggagggtaaacttgttcatccactattaaaagcagtttttagatttctcaaagaacttaaaacagaactaccattcaattcagtaatcccatatacaatttgatacttacccaaagaaaataaataactctagcacaaagacacatgtatgtgtatgttcattgcagcactgttcacaatagcaaagacatggaatcaacctaaatgcccaacaatggtgtattgggagaacctgcccccaatacttcaaagtaggttctttctattttctgtaagtgtcagctggatgagaaataaagagagacagtataaagagaggaattttacggctgggccaccaggggtgacatcacatgtcggtaggaccatgatgcccacctgagtctcagaccagcaagtttttattaagggtttcaaaaggggagggggtgtaagaacagagtaggtacaaagatcacatgcttcaaagagcaaaaagcagaaccactgataagggtctaacaaagatcacatgcttctgagagaacagggcaaagggcaaaagcagagccactgataagggtccaagaaagatcacagggcaaaaggcaaaagcagaacaactgataagggtccaacaaagatcacagggcaaagggcaaaagcagaaccactgataagggtctatgttcagcagtgcatgtattgtcttgataaacatcttaaacaacagaaaacagggttcaggagcagagaaccggtctgaccacaaatttaccagggctgagttttcccaaccctagttagcctgagggttctgcaggagaccagggcttatctctgtccttatctcaactgcacaagacagacattcccagagcagccatttatagacctccccccaggaacgcattcttttcccagggtattaatattaatatttcttgctaggaaaagaatttagtgatatgtttcccacttgcatgcctgcttataggcactctgcaagaagaaaaatatggccgtttttgcccaatcccgcagggcagtcagaccttatggttgtcttcccttgttccataaaaatcgctattattctgttttttttcaaggtgcactgatttcatattgttcaaacacacgtcttacagtcaatttgtacagttaacacaattatcacagtggtcctgaggtgacgcacatcctcagcttacgaagataacaggattaagagataaaagacaggcataagaaattataaaagtattatttgagaactgataaatgtacatattaagatgaaatcttcacaatttatgttcctctgccacagctccagctggcccctctgttcggggtctctgacttcccataacatagatggactaaataaagaaaatgtggtacatatacaccatggaatactatgcagccattaaaaaacaatatgaataggagtggtgagagagggcatccctgtcttgtgccagttttcaaagggaatgcttccagtttttgccattcagtatgatattggctgtgggtttgtcatagatagctcttattattttcaaatatgtcccatcaatacctaatttattgagagtttttagcatgaagcgttgttgaattttgtcaaaggcctttactgcatctactgagataatcatgtggtttttgtctttggctctgtttatatgctggattacatttattgatttgtgtatattgaaccagccttgcatcccagggatgaagcccacttgatcatggtggataagctttttaatgtgctgctggattcggtttgccagtattttattgaggaattttgcatcaatgttcatcaaggatattggtctaaaattctcttttttggttgtgtctctgcccggctttggtatcagaatgatgctggcctcataaaatgagttagggaggattccctctttttctactgattggaatagttccagaaggaatggtaccagttcctccttgtacctctggtagaattcggctgtgaatccatttggtcctggactctttttggttggtaagctattgattattgccacaatttcagatcctgttattggtctattcagaggttcaacttcttcctggtttagtcttgggagagtgtatgtgtcaaggaacttatccatttcttctagattttctagtttatttgcgtagaggtgtttgtagtattctctgatggtagtttgtatttctgtgggatcggtggtgatatcccctttatcattttttgttgcatctatttgattcttctctctttttttctttattagtcttgctagtggtctatcaattttgttgatcctttcaaaaaaccagctcctggattcattaattttttgaagggttttctgtgtatctatttccttcagttctgctctgattttagttatttcttgccttctgctagcttttgaatatgtttgctcttgcttttctagttcttttaattgtgatgttagggtgtcaattttggatctttcctgctttctcttatgggcatttagtgctataaatttccctctacacactgctttgaatgtgtcccagagattctggtatgttgtgtctttgttctcgttggtttcaaagaacatctttatttctgccttcatttcattatgtaccaagtagtcattcaggagcaggttgttcagtttccatgtagttgagtggttttgagtgagattcttaatcctgagttctagtttgattgcactgtggcctgagagatagtttgttataatgtctgttcttttacatttgctgaggagagctttacttccaagtatgtggtcaattttggaataggtgtggtgtggtgctgaaaaaaatgtctattctgttgatttagggtggagagttctgtagatgtctattaggtctgcttggtgcagagctgagttcaattcctggatatccttgttaaccttctgtctcgtggatctgtctaatgttgacaatgggatgttaaagtctcccattattattgtgtgggagcctaagtctctttgtaggtctctaaggacttgctttctgaatctgggtgctcctgtattgggtgaatatatatttaggatagttagctcttcctgttgaattgatccttttaccatcatgtaatggccttctttgtctcttttgatctttgttggtttaaagtctgttttatcagagactagaattgcaacccctgcctttttttgttttccatttgcttggtagatgttcctccatccctttattttgagcctatgtgtgtctctgcacgtgagatgggtttcctgaatacagcacactgatgggtcttgactctttatccaatttgccagtctgtgtcttttaactggagcatttagtccatttacatttaaagttaatagtgttatgtgtgaatttgatcctgtcattatgatgttagctggttattttgctcgttagttgatgcagtttcttcctagtctctatggtctttacattttggcatgattttgcagtggctggtaccagttgttcctttccatgtttagtgcttccttcaggagctcttttagggcaggcctggtggtgacaaaatctctcagcatttgcttgtctgtaaaatattttatttctgcttcacttatgaagcttagtttggctggatatgaaattctgggttgaaaattcttttctttaagaatgttgaatattggcccccactctcttctggcttgtagggtttctgccgagatatccgctgttagtctgatgggcttccctttgagggtaacccgacctttctctctggctgcccttaagattttttccttcatttcaactttggtgaatctgacaattatgtgtcttggagttgctcttctcgaggagtatctttgtggcgttctctgtatttcctgaatctgaacgttggcctgccttgctagattggggaaattctcctggataatgttggaagttctggccagggcaattaggcaggagaaggaaataaagggtattcaattaggaaaagaggaagtcaaactgtccctgtttgcagacgacatgattgtatatctagaaaaccccattgtcccagcccaaaatctccttaagctgataagcaacttcagcaatgtctcaggatacaaaatcaatgtacaaaaatcacaagcattcctatacaccaacaacagacaaacagagagccaaatcatgagtcaactcgcattcacaattgcttcaaagagaataaaatacctaggaatccaacttactagggatatgaaggacctcttcaatgagaactaaaaaccactgttcaacaaaataaaagaggacataaacaaatggaagaacattccatgctcatgaataggtagaatcaatattgtgaaaatggccatactgcccaaggtaatttatagattcaatgccatccccatcaaactgccaatgactttcttcacagaattggaaaaaaactactttaaagttcatatggaaccaaaaaagagcccacattgccaagtcagtcctaagccaaaagaacaaagctggaggcatcatgctacctgacttcaaactatactacaaggctacagtcaccaaaacagcatggtactggtaccaaaacagagatatagatcaatggaacagaacggagtcctcagaaataacaccacacatctacagccatctgatctttgacaaacccgattaaaaacaacaactggggaaaggattccctatttaataaagggtgctgggaaaactggctagacatatgtagaaagctgaaactggatcccttccttacaccttatataaaaattgattcaaaaaggattaaagacttaaatgttagacctaaaaccataaaaaccctagaagaaaacctagccaataccattcaggacacaggtgtgggcaaggactagaacaccaaaagcaatggcaacaaaagccaaaattgacaaatgggatctaattaaactaaagaacttctgcacggcaaaagaaactaccatcagagtgaacaggcaacctacagaatgggagaaaatttttgcaatctacccatctgacaaagggctagtatccagaatctacaaagaacttaaacaaatttacaagaaaaaaaaacaaccgcatcaaaaagtaggcaaaagataggaacagacacttctcaaaagaagacatttatgcagccaacagacacatgaaaaaatgctcatcatcactggccatcagagaaatgcaaatcaaaaccacaataagataccatctcacaccagttagaatggtgatcattaaaaagtcaggtaacaacaagtgctggagaggacgtggagaaataggaatgcttttacactgttggtgggagtgtaaactagttcaaccattgtggaagacagtgtggtgattcctcaaggatctagaagtagaaataccatttgacccagccatcccattactgggtatatacccaaaggactgtaaatcatgctactataaagacacatgcacatgtatgtttattgtggcactattcacaatagcaaagacttggaaccaacccaaatgtccatcaatgatagactggattaagaaaatgtggcacatatacacctggaatactatacagccatagaaaacgatgagttcatgtcctttgcagggacatggatgaggctggaaaccattattctgagcaaactatcgcaaggacagaaaaccaaacactgcatgttctcactcataggtgggacttgaacaatgagaacacttggacaaagggcagggaacatcatacacaggggcctgtcatgggagcgggaagggatggcattaggagaaatatctaatgtaaatgacaagttaatgggtgcagcacaccaacatggcacatgtatacataagtaacaaacctgcatgttgtacacatgtactctagaacataaagtataataaaaaaattaaaaaataaaaataaaaaaagaaaatacacagaggagatattaggttggtgcaaaagtaattgtggcattcttatagaatatacaaaatagcctcaaaaggacaaatctaagagttattggccttaaacagggggtagagaaacagataggggaagaaagtttattcaaagggataagaacagagaacttcccaaaactagagaaagctatcagcattcaagtacaagaagattatagaacaccaagcagatttaatccaaaaatgactaccttaagtcatttaataatgaaactaccaaaggtcaaggataaagaaaggattcaaaaagcatcaacagaaaaaaaaaataacttacaatggagttctaacatgtctggcagtagacttttcagtggaaaaggctaggagagagcagcatgacatatttgaagtgctgaagtaaaaaaaaaaaaaaggttaccttgcaatagcatatctggtgaaaacatcttcaaacacgaagaagaaataaagactttcccagcaaacaatagctgagggatttcatcaacagcagacctgcactacaagaaatgctaatgggagtacttcaagcagaaataaaaggacgtacatgagcactaaataatcacctgaaggtactaaactcactggtagtaactacacagaaaaacacagaatattataacactgtaatcatggtatgtaactactcataccttagtagaaaaacaaaatgatgaaccaattaaaaataataactgcaacaacttttcaagacatagacaataaagtataaataaaaacaacaaaaaaattaaaaagcaggggagatgaagctaaactgtttattggttttctttttgtttatttgtttatgaaaacagtattaagttgttatgagcttaaaataatgggtaattacaagcctcatggcaacctcaaaccaaaaaacatattatagatatacaaaaaaaagcaagagaataaattatatcaccagagataatcaccttcattataaggaagacaggaagacagaaaagaaggaagagaggaccacaaaacaaccagaaaacaaataacataatggcaagagcaaggccttacctatcaataataacattgaatgtagtggactaaactctccaatcaaaaggcgtaggctgaccaaatgtatgaaagaacaagacccattggtctgtttctgccaagaaacacaccttacctataaaaacacacatagactgaaaacaaagggatggaaaaagtattccatgacaatggaaacccaaaaaacaccaggagtcactatatttatatcagacaaaatagatttcaaaacaaaaactgtaggagacaaagtgtcactatatagtgataaagaggtcaattcagaaagtggattatagcaatattaaatatacatgcatccaacactggagcacccagatatataaaggaaatattattagagctaaaaagagaaatagactcaatacaataatagctggagacttcaataccccaatatgcctgatgaatattgatgcaaaaatcctgaacaaaatactagcaaatcaaattcaacaacacattttttaaaaatcattcatcatgactaagtaggatttgtcacagggatgcaaggatggttcaacatacgcaaatcaatccaatgtggtacatcatattaacaaaatgaaggacaaaaaccatataataatttcaactgatgctgaaaaagcattttataaaattcaacatcccttcatcataaaaacatttaaaaaaactatagaaggagcatacctcaacataataaaatccatatatgacagacccacaacaagtgtcatactgaatgggtaaaaactgaaagcctttcctttaagacctagaacatcacaaagatggccactttcaccactgttattcaacatagtactggaagttgtagctagagcaaacaagagaaaaatataaagggcatccaaatcagaaagaaagaagtcaaattatcattatttgcagataatataatcttatatttggaaaaatcaaatgactccaccaaaaaaactattagagctgataaacaatttcagttaagttgcacaatacaagatcaacattttaaaaatcagtagcatttctatatgccaacagtgaataatataaaaaagaaataaagaacagaatccaattcacaacagtcacaaataaaattaaataactaggaactaaccaaagaagtgacagatatctacaaagaaaactgttaaacactgatgaaataaattgaaaaggacacaaaaaatgggaagatattccatgcttgtggattagaagaatcaatactgttaaacggtccatactactcaaagcagtttacagatccagtgcaatctctatcaaaataccaatgacattcttcacagaaatagaaaacacaatcctaaaacttatatggaaccagaaaagagcccaagtagccaaaactctcataggcagaaaggacaaaactggaggaatcacattacctgacttcaaattatgctacacggctatagtgaacaaaacagcatgatactggcataaaaatggatgcatacaccaatggaacagaaaagagaacccataaacaaatccacacacctatagtaaactcatttttgacaaaggtgcaaagaacatacactgaggaagagagaacgtacactggggaaaagacagtctcttcaataaatcatgctgggaaaactggatttccacatgcagaagaatgaaactgacccctgtttctctatatatacaaaaataaaatcaaaacggatcaaagacctaactctaagacctcaaattattaaaccactacaagaaaacattagacaaagtccccagaacattggtctggacaaaaatttcttgagcaataccccacaagcacaggcaaccaaagcaaaaatgggcaaatgggatcacctcaagttaaaaagcttctgcacagcagatgatacaataaacaaagtgaagagacaacacacagaatgggagaaaatatttgcaaactacccctctgacaagggattaataaccagaatacataaggagctcaaacaactctttaggaaaatatccagtttttaaaatgggcaaaagatttgaatagacatttctcaaatgaagacatacaaatggcaaacagacatatgaaaatgtattcaacatcatttgtcatcagagaaatgcaaatcaaaactacaatgatatatcatttcaccccagttaaaatggcttttatctaaaagatgcaataacaaatgctggcgaggatgtggagaaaagggaaacctcgtacacagttggtgggaatgtaagtgagtacaagcactatggagaacagtgtggaggttcctcaagaatagaattaccatatgatccagcagtctcactgctgggtatataccccaaagaaagaaaatcagtatatcaaagatatctgtactcccatgtttgttgcagtaatgttcacaatagccaagatttggaagcaacctaactgtccatcaacagatgaatggataaagaaaatgtacatagacacaatgtagtactatttggccgtaagaaagaatgaggccctgtcatttgcaacaatgttaatggaactgcagagcatcatgttaagtgaaataatccaggtacagaaagacaaatatcacatgttctcacttatttgtgtgatataaacatcaaaacaattgaactaattgagatagagagtagaaggatggttattagaggttgagaaaggcagtagagggttggaggggaagtgaagatggttaattggtacaaaaaaatagaattaatgaataaaacctagcatttgctagcacaacagggcgactacaatcgataatattttaatcatacattttaaaataactaaaagagtataattgggttgtttgtaatacagaggacaagtgtttgagcggatggataccccattctctatcatgtaattattacacattgcatgcctgtatcaaaacatctcctataccccataaatatatacacctactgtgtacccataaaaatttaaaaaattttaaaaggaaataaaacttttgcttttattttgtttttccatcaatattgttaaaaaatctctagtattgataatttatttttattttattattttctacataaacggtcatcttgtatgatactttatttctttttttctattgttatgccttctatttccttttcttgttatagtgccctggctagtgtcatccataccacgaagaatagaaatgctaacaatggcatctctttctcattctcagacatgaaggaaaagctttcaaaacatgagtagtttttcccagatgaagtaattacactatttcaattttgctaaggctttttaaacacaaattgatgataaaaattatcaaagtcttttttgaatcagtggctgtcatgttttttttcaagaaaaaataatatttttattctattcttttttatactttaagttctggggtacatgtgcagaacatgcagttttgttacataggtacacatgtgccatagtggtttgctgcacccatcaacctgtcatctacattaggtgtttctcctgatgctatcccttccctggtcccccatcccctgacaggccctggtgtgtgatgttctcttccctgtgtccatgtgttctcattgttcaactcccacttatgagtgagaacatgtggtgtttggttttctgttcttgtgttagtttgctgagaatgatggtttccagcctcatccatgtctctgcaaaggacatgaactcatccttttttatggctgcatagtattccatggtgtatatgtgccacattttcttaatccagtctatcattgatggacatttgggttggttccgtgtctttgctattgtgaatagtgccgcaataaacatacatgtgcatgtgtctttatagcagcacgatttatagtcctttgggtatatactcagtaatgggattgctgggtcaaatggtatttctacttctagatccttgaggaatcaccacactgtcttccacaatagttgaactaatttatactcccaccagcagtgtaaaagtgttcctatttctccacatcctctccagcatctgttgtttcctgacttttttttttttttttttttttgagatggagttttgctctgtccaccaggctgcagtgcagtggtgcgatctcggctcactgcaagctctgcctcccaggttcacggcattctcctccctcagcctcccgagtagctgggactacaggtgcccgcaaccacgcccggctaatttcttatatttttagtagagacggggtttcaccatgttagccaggatggtctcaatctcctgacctcgtgatctgcccacctcagcctaccaaagtgctgggattacaggtgtgagccactgcacccagccttcctgactttttaatgatcaccattctaactggcatgagatggtatctcattgtggtttgatttgcatttctctaacgaccagtgatgatgagttttttttcctacttttgttggctgcataaatatcttcttttgagaagtgtctgttcatatccttcacccactttttgatggggttgtttcttgtaaatttgtttaagttctttgtaaattctggatattagtcctttgtcagatggatagattgcaaaagttttctcccattctgtaggttgcctcttcactctgatgatagtttcttttgctatgcagaaactctttagtttaattagatcccatttgtcatatttggcttttgttgctgttgcttttggtgttttagcaatcaagtctttgcccatgcctatgtcctgaatggtattgcctaggttgtcttctaaacaaatttctctcagagccccatacttgacacacagaggaaggggcctatttcccaaataacattattcatggctcttaagtcctgcctatgattcagtatggaattctaaacagtgcatttgttcagaattctatgtaaatagtgtattgcatttaagacccccagtgccatgtcctttgacttctttaaggataaattttaccatgagtgaacttcctatttctcctaaattcagacaaaacttaaatgtcaggtgtgttacatataacactaaaatgtttatgacaaaaatgattaattgtaaattctatccatacagggggccagtatattctattttatactttatatttccttgagtgcagtgattcttattgctgtaaaaaccttgcagggaccctggaactaaacactatactaaacactatgtagactatattgattccagttaaggtcatgaggcttctaagtaggctggctcctctgcctgtgctgctgcttgggatttctatgtgaagaccaatgaggattatgctcaccaaatagaaatgcctggtgtaactctactggcgtggtgaatttttcaagtatgatgttctaaataattgcatacatttagtcattatttttggttttctgtgattgtacacatttcaaatagtctttttattttgaaacaaagcaatattatagtctgtaattattcatttccatatgttaactcttagttttgtttctgttgcctgtcgcttccactggctttcatgcttggtaccttgtttccttttgtgttggtcattatttttcactgtgtgttggttactgattttgaataattaccagtaggactcattgaggtatgggtttgttgtttgcttattccgttcaccctgactcagaccacctgtccctgaccatgttatattcaaattcaagcactgagcttctcaagctctccagggctgctaacctgtgccagtcttggttacttcaggttttcccttatcctgaggatatatgtgaggtgtataaatcagacttctcacctggatatgccataggctttgatttgtggccctctcatcccaaaagaacactaaagctacagctcaggataataacaatcttctgacttgtcaaattctctctcggcaaaagcatttttgagtattgggcctacttctctaggttatcacactttctgataagacaatcccttattatcctataagttctaacgtgaaatttaagatatatgtaacattttatcatgttttaattgtactcaccatggcactgattaaaatgaccaattctgccgctgttggaacagaaacctcaaaagtaaattacatgcgtgtgagtgaagattagactcctggagctgttacacaggtaacaccatattcaacatgaactgtcctcacctttggcagcagttgttcagatgttatgttcccagtgagacctgcagtgactcctccctgcccctggcacatcaaccttccacgtactcttccactttttctttctccatagcactcattcccttctaatagtaggtatcacttacttgttagttttattgtctgactcctatgttagaagacaaattccatcacgacagacatctgtggctattagtcacttatatcctcgtctagggcagtgcctacaaggatcaccaaataggccggcggcagtggctcatgcctgtaatcccagcactttgggagggtgaggtgggcggatcatgaggtcaggagatcgagaccatcctggctaacaagatgataccccatctctactaaaaatacaaaaaattagccggatgtggtggcgggttggcctgtagtcccagctactctggaggctgaggcaggagaatggcatgaacccaggaggcagagcttgcagtgagccgagatcacgccactgcactccagcctgggtgacagaacgtgactccatctcaaaaaatatatataaaataaaataagaatcaccaaatatagctttatttatttattattattatttttcttgagaaggagttttgcttttgttgcccaggctgcagtgcaatggcgccatctcggctcactgcaacctctgcctcctgggttcaagcgattcttgtgcctcagcctcctgagtagctgggattacaggcgcccatcaccatgcccggctaattttttttgtattatttgtagagacagggtttctccatgttggtcaggctggtcttgaactcctaacctcaagtgatcccactgccttggcctcccaaagttctgggattacaggcatgagccaccgtgcccggcctcaaatatagtttttgaatgtacaaaataaaaaataaatgaatgaagtgattgataccctatgattctattgacagaatgttgggattgttgtctgaaacactaaagaggggacaggaaagagaaataaatctggtagtggtcagcatgcagaggttgattaagcctctccaggggcagacatactttcagaggagaggcagtctagtccccttgagtttcctaagtaagatgaggctctgaccatgaatgagtcactccaaaaggttgttcctcacagccacaatgtcacactataagctggattctcctcttggaagttattgcctgatttttttttccactcagtctctaaggagttcagaaaccctgctcattcccacagaagtcaccggttttgacctgacagagaaattcataggttagtcaggggcctctaacaggttcttctctgggaccctataaccatgctggagacagagaatagaaacgcagcccagattgttgtgggtctcccaagctcattgtcagcaggcaacctttctggaagaagaatatctccagcaattttactatggttcctttgtcattttctctcacaatgtactcagtaacaactatagatatcaggcatgtatctcaggataagctgatgttgacaatggccacagtctgaaggtttaaaggtatgccttaacttatggcagaaaacaactcttgaaaaaataagaataaaatttttaaaggattttcagcagataaagcatttttttcatgtgaaactatttgcattctcaattataaatttaattaaattttattaaaggtaaagcaagatggacttctaatttcctattctatctgaaaatcttccctcctgattgactaaaaagctccacactgggtaatggtctatggacagataaattttgaccacaaacactcggtgtcttattattattatatatagaatattaatatatcagattcttcaaactaactagtttcatcaagaaaatatttttattctaagctctctcttcagagcccccttaatctccttgttcctgaggctgtagatcagggggttcaacatgggaatcaccacggtgtagaacacagacaccaccttgttctggtcagttgagtagctggacttgggcatcacataaatgaaggtaatggtcccatagaacagagtgactgcagtgaggtgggaggtgcaggtggagaaggccttgtggcggcccttggtggagtgcatcttcaggatggtgatgaggatatagatgtaggatatggctatgacacacacagtggccacaatgatagatccagaagagatagctggaattatttcaaaagtaaaatcatgggaacaagcaagcttcaaaagtggtgaatagtcacagaaaaagtgattgactttatttggcccacagaaggacagtcttaataagcagccaatgaatgtccaagcattcacacatccacccaggtaggacatgcccactaagatgatgcagactccaggggacatgcaggtagagtagagcaggggtgagcagatggccacatagcgatcataggccatggcagccagcaggaagcactcggccgtaccaaacgtcactacagaacagagctgggccacacaaccagcaacagggagagaggtttctttccttaggaagctcatgagcatgacaggtgtgactgatgaggagtacccaatgtctacaaaggccaaatggcagaggaaaatgtacatgggtgtatgaagatgatgacttcttctgatcaatacaattatgctgatattacccattaaggtgacaacataaattcctagaaacacaagaaataaaatagcacaaactgtagtatcctcagataaccccaaaagagtaaactctaccacagtggtgtcatttccagtccccatctatattgggaatggtgccaactgaaagaaaaacaaatgaatattataatgggattaaatgctataattgcacacttatttttccaatatctatttaaccaaaaagtataacaatttaggcactcatgtaaatttgggaagaaaatgctttcacacacagtatcttatgtaagactttaaaacataaatgttcactgatgtaaggtcaggaatactcagaaaaatctttttttttttttaacttaacacactcaactcgtattggatggttaatttaggtgctctctgagcacatttcagagatgaccactagaatatataaagaatccagtaactcaatcttctaaggccaaagacgtgattgaagggagacataaatgtcagaatagaccaagactcatggaaaagaacagctgttcaaaaggatgtttgaggtatcatctattgtatcaaagatgtgtagtcattaagaattccgaattccaaacagaggtcaaacagattagctgcatgctaatccacaggaccaagaagaggtcagtaactcaacactgagctgtggtccccacccagagatttcacaattgaggaaaagtacaccaaatatccaggaagtctggaccgaggcagaaggtgaagtaatgcactcacactataaacaagtaaacagaggaagactgaggtttgaaagaggagatgagatatctcctaattatctcaggatcaagctatctgattcatgatagtgagccaatctagagaagacatgatcaggttactcctggaaggctccaaagatacaacttatacccaagactctgcataagctggggctaggttgctaacagaagattccagccttctacagaacacaaatatccagccctatctgaatagttgctgtctgaaaaaaattgcatctgtaggtcaccttctggaaggccctcctccataccaactcgcttgagaaaaatcaagaaaatgcaagaaaagcaggagagctttctcacagcttcaaaaggtcctagaaataatccactcgattctctcactttataaaattataaacggagatctaaaaaagatagataatacacaccattgtccaacataactttagatcaaatggctttctggaaactgagctaaaatgaagaaccatattcttggacttctaattcatttactatctttatttcacatattatacatcttttctatgatttctaaagaagactatagactatcagaaagtatatttggttcattacatatttaaaaaggttttaaaattatgctaacatataaataatacatttactcttgaaaggggaattttgcagtgcagtaattcacataaagatgcggctgagagataacgacaattctttgaggcaggtgatagtctccttcagtgcccagcacctagggaattgatatgcttttgttttcagctgaacagttgtgagtgcctgatagatgaggggtcaaatttcactaagattttcttttttctgagcaacgaaagggacagatatggaatgttagggtatatgcaaggtagagagtaaaataaccactacatttaagctaggcaaagatgaagtgagtacctgagatgggtaaaatcaacaaaatggttctagcctttctgcaaggattgaaaatttgctataattattctaccagtgaaaacaagcaggaaaaacaagaaatgatggtagttacagtttggggtgcttaaaaatgagattacggaaaagctacagttattggcaaatgctaatgtctaaactctaacaacgggagagacaggttttagggaggaaaacaaattttttttgaagatatgtcaagaaactaagaagccaaaatgttgaaagcaacctctatgtggaggtattaaagccaccaggaatagtgacagaaataatgtaagaaaatgagtgagccagagccaaaaatcttccaaagatgcggagacatgatgctagccagttgatgactgcaaatgcataaggagagaaaggtaagattggttagtatagtctgatgacataaaactcaactatgggtatttgtaggtaggaaggagagagaatgtccacaagcagcaacaagggaaatggaagatcctatccatcaccaggttcggggtaaaagtggtaagagaaaaaaaagttcatcatttgagaaggctgcagagaaaacattgtcctcagggacagccaagtgtctgttgaaaaggacagtaagggaaatggaatgttcaaaaccaatactgaggacataagaaattttgttgataactgtgactgcagaagggcacaggaaaaaggcttcaagagttaaaaagagatggatatgggacctcttgattcaagagaaggcttggatacttgaaaataacctttcttagctccagctgaatagagatggcattctgagagagagagtacagaagataatacacacaattgtctaacatacattagttgctacaatttaattgctgaatagcagaagggagggtgaaagctaatcccaaagttgtgaagattgtgaggaaggggtaataggtaaacaactcagctgacctggagtgacttaacagttttgaggcaatcccagtatctcacccaaggaaaagtcatccctattgaagaatttaaaaccaatgagaaacactagtaggtaaaatcaaagggtcaaaaatcctggagttaaaaaaacaaaaaaactggattctggtgatagtcatttctgagattactgcagtggtgacttcacgtagatccaaaactgccattgctagtcatggttacttttatggagtatgcatctggaatattacatatggtctgtcaagactttcatctctacctatgctgttatttcatatagggtttcaaaaaattggctagaaatagagaacatcttactaggacagggaagaatgaagatgaacagatattatacaaaatgtttaaactgaacgtggagatataagaaagaaaatttccaaaatgagaagttgatttttatgaaggagagaaaaattaccataaaaataaaatgtatgcttcatcataaatatgaaaaaatatttgaaaatatatatttgtgtctgtatttgtagggtctcatgactttatgaaaaagcaacctttttgggtaatagaagttgggattacagcatagaaagaccaatatgcaccaaagggcatcagcaagatggggaagaatgttgcagtggctgctacaaaaatagggttgctgatacagaaattccatgttgattggttgggaatatgagtaaagagaaacagaagatacagagttttaaagtgaatgaaggaacataagcaatttatcttgggcaagaaatggctcctgaaggaaattaacttttatcttatttttttttttactactccagtgctttttagaagtctgaggatacacaaaataactgctcaatacatgggagaatcatcaagcagtcacaattgtgcccagttggaatgggctgcaaattggtgacagcactatgaaagagattcaggaattacaggtctacctgagctaatgtgatgctgtgacattttaaaatgatattctaggattcagcatagtaaattaatccactatagtctatactctacacatccatatgaagataatgcgtgaactttctcaatagattgctttcactctggagtctgcaaacactttgctctttgcttctatgtatcttaagtatccaattgatgcctctattagaattaagaaaaaagagaagcaaaagtgtttttttaaaaaagtagagaggaatgaatgaaaggcagaggaatatgaaaggcagaccatacagagggagccaaaagaggtgctatagctgataagataaaagagggaatttttatttcacatgtcaacaatttaattccatttttatcaatgatatcttcttctatggaagaaaattaagataattcaatgttttcctacatcatttaatataaggtttatttactcttggaaacttccattctttattgctcctcaacaatagcaaccacaaaaattcccataattctctctttaaagatcaaccaaaattaaggaataatgtatttttctttaaagaatttgctctcaagcagactgaacgctcttgcacacatgcactgctgtctctttctctctctcacacacacaccacatgcatacacacacacacactggcatcaaagtcatgtgctcatccagccacattattttcacacttttattctgaactgagatgcttgaataatttcacgtctgaattaactgatcaatatcatgctatgttaagaacaccatgcaattacatgtttgaactctgaagtcctatcttccttatctttgtacagggctttattaagtggcatggacccaagaatgaatgaatgcttaaaattttagaaaagatagatgtgtataatagaaattcagagtcagttatacatgctattatggcatggaagcaatgtgttggacagaaatgccatgagctttggagacatacggccctgggattagattcagctttgtcaccagcaatctatggaatcttggaaattttacataaactgttcaactcttcattacgttatttgtttaaaaaaatacttcacatgattcttgtgttgaataagatgatgtacatgataataccaagtatggatcatagaaataagtgaatgttcaacaaatgattatttcctttaaaaaactataccttaacttctaatacaaaaatgagaaacaaacattcctgtatcaatagaaaagggaaattattacctgcagatgaatgtacatcagcaataataacaaattgcaaagaactgtcactgtataggaaggtgatatttatgagatttggggtcctttgggatatagcctcttgagtacactacttgtttataaaaatttcactgaaaattcatcaagacaatggaaattacaggtacatatgctcataaaaatatgtgttgctgctgggcatggtggctcacacttgtaatcccagcactttggaaggccaaggtgggagaattgtttgaggccaagagttcagacaagtttgggcaacataacaagaccccatctctacaaaaaaaaaatataaataaataaaagtaaaattagccaggtgtcatggctcatgcctgtagtctcaactactcaggaggcagaaatgggaagattgattgaagtcaggagtttgaggctgcagtgagctagaattgcaccactgtactccagcctgggcaactaagcaagacctcaactgaaaaaaaaaagtctaaaaacatctgtaaatttatttatttttagtatgcattagaatttttaaataaaactttttgatgaactgctaaatcccctgtaactatattgagatttataggaataagcaagagtacagtgtaccagagtaatttctcttcaaaataaaaattcttctgggaaaaaataaatgtttatgttttctgtatgtttctagatgatactacctttattttttaattaaactttttactttgagattattgtagatttacatgcagttttaagaaatgaaattaatacagagagatcttatatgccctctacccaatttcttccaatgaacgcattttgaaaaactgtagtgtaatatcacaacgaggatactggcagtgatacagtcaagatacagaacatttccatgagcacaataacccctcacattactctttcatagccacaacaacttctgtcccatccccatcccttccttaacttcaggaatcctctaatatgttctctgtttctacatttttataatttcaagtattttattattatgtaacatccctttctgcctctagtaattttctttgctctgaagtctacgttattcaatattaatatagctactgcttttcttttgattaatatttacatgctatgtctttttcattattttactttcttttttggattttgttttggtttttttgagatggagtcttgctctgtcacccaggctggagtgcagtggcacaatctcggctcactgcaaactccacctctcgagttcaagagattcttttgcctcagcctcccgagtagctgggattacaggcgcctgccaccacgcccagctaatttttgtatttttagtagagatggggtatcaccacattggccaggctggtctcaaactcctggcctcgtgatccaaccaccacagcctcccaaagtgctgggattacaagtgtgagccatcacacctgacccattattttactttcaatttgcctctattattatatttgaagtgactttcttgtagacagcatagagctgggtcatgtgttttagttcactttgctgggtgagggctcaaacagaaacaaggaacatgctgttttgaaactggagaaaaagttatccttgttagatagtgacagaaagtctagcttaattttgacctacagttacatggaaagcagaacttgtaagtgatgaacttggatgtttagataagcagatttacaaagttttgaaggtacagcctattgttgtttactcaatgtattaaaatgtgagaacaaattacttaaaggtgaaggaccctcttgtctaatgatgtgaatagtcataacatacatgggagaaccaggttttcaaaaatgatatagtttcagaaacaccaccagcttgtgctaaagggacagagacagaacaaaatgaaagaaggctgtaagactcataaaattctacaagcaggaaaaggctgataaaactaatcagctacaaatatgtgctacctatcaagaaaaagaaaggataacttcaagaacaaaccctttggcccaaaagctggagccttgggtctaggatttagagccatggtgcagaggttggagcagtgcacacagaaaatattagtctcagacccagagcatggagcattgagtcactaagtgttattcataggccttgaaatgccgtgtttgccctgatgaacttcagaattgcttgggtctgatgaccttttccctccttccacttccccccttttagaatgtaaatgtctattactgttacatcatgatgcctgtatcatcattatatttggggaacagatatcttgtcttcttgtttcacaggtccacagatggagagaaattttgccccaggatggatcatacacagtatcctacctatatctgatttaggtaatttagataatgagatttaggactttcaagctgatgatatttagatgatattttgggctttagttgatgctgtgttgggttgaggcttttgaggatttggaggtgggatgaacacattttaccgtggaatgaacataaatcactgggggccagagagaagactgtagcagactgaataatggcccccaaagatatcaggccccaatccatggaatctataaatgttaccttactttaaaaatggcctttgcatatgtgattaagaatcttaaaatggagtaatggagtgattatcctagattgtctgggtgggccctaaaagcaatcacaagtatcattataagagagagacagagggagaatgtgacacaaacagagaaggagaaggcaatgtgaccaaagagaaagagattggagtggtttggccacagcaaaggaatgccagaagccagcagaagctggaagacacaggaaatggattccaccttggagcctccagagggagtatggctctgttgccaccttgatttttgcccagtgatacttattttagacttctggcctccagaactgtgaaataataagtttctgttattttaagcttccaaattcatagtaatttgttacaatagccacaggaaactaatacacatgataacaaatgatcactctctccagaggtcccagggtatttgtcaaatgaattcatttattcattcattccaaaatatgcactgaatactactatatcccaagcttccttgggatgtagtgataaacaaatcagaaaaaaaatcactgaactcatagaacttacattctagtattctagtgttgggagataacaataaatcatatatatgaatgaaataaggaagtaaaccatgtaaaggtttagggggaaagcttttcaaggaggttttactccctttaaatttgagtaatgcaaaatccacgagaagaataagccactgaggctagatcacagtaagccaacattcaaatgattgtatgtatctggtactagcaaattacagggggaaaaggtacttttatacattatgaaaaatatatgaattttctaaaaacttttggaaaatatcgtggcaaattttatttaaaatttcaagtgctgtactccaaaatttcactttgaggaattaatcctagaggtaataataacctgaaaaaatacatatacaaaaagatgttcatcacatgattgcttaaacagcagaaaaattgcagtgtctagtgtgcatcaacaaaagaattgttgaaaaaatgatggcaccttcatcctatggattactatgtggacattaaaaagataaaatgtccccatatgttcagcttctgaaacaagcccatgatatactcttacatttccaaagtctctaatatgtttttataacttattcttaacgtttcataatcatattttcttatttttatatagcactttctcctgaatcattaaaaagattatatttattttaatgtgaattttatcatgatagctttacaaactctctttacttggatttatgttctgttgccttttttcttttctttacttctggtttttgtttttattttgctgttgtcttttgaatttgtctctcttattttgtgattctagtaatcctaaaagatttggggggcgggttactataagtgcatttttataatggggattttctgctgaactgcccactgattcttacatgggaaaggtgcaaagacagtggtactgctccctgtttcgttaggcagggaaataggtaagatgaacagctaggaaaggtacctcagccacctgtcttctgggttttactaccatacctcgactctgcccaaagcactgtttctgcttagagacagacacctcgatcactgctgcctcttcctttggaagaggtattggaatagaaacaggaataaactagcctggcttctctccctacttatatccttgtgcatagtctggagctcctctgtgttttactcctttttgaaaggaatattcctggtgttttagtaaaccctccatgtgattctgatccacaccaaagtttaagaatcacgacctcagtgttctcaatcttggctgaatatcagaacaacatggaaaaattaaaagaatactgcctgaaccctttcccaaagattctgttttaattggtatagggtatggcccgtgcactgggatttataaagactcctcaggtgattttgatatccaggtaactttgtgatccactgctcttatcgtttccaaatgcatggatgaaatatcactgtatgcagagtcccgtctgttctgtctagatgtttagatgagccggttagtagaaattcattctggagtcaagatcattgaccaaccttactattcacagagctaatgagatatgtgcatccattttcatgagtatttcagagggaagactgggaggatcctgaaacatgtattgtcactttctattattgtaacccaaagtcttgaagtaataccttacttggaccacaaagtattttaattattcattcattcattcatttggcagatatttattgaacattaacagtgtttcaaactctcttctaggcactcaggataaaataatgaactaggcagacaaggttcctgccctcatggagcttatattttagtaggtaaggcagatagtaaactataaacaaatgcatgataacataatgaccaattataagtgctacagaagaaataaacaggaatttttttataagttaactttctgtaatggcattctaaattcactcagaagcccaagccttcccatgacagatcatatatatctaaatctatatctatatacatataatatgtgtatgtgtgtttgcttaaagtatatcaaaaagactctctggtcctcaaagtaaaatgaacacagagaagttaaaaaaatctacctgaaatcacacagaaaatgctgagactgggatttgaatgttagcgctgtagtctggttctgaagcctgtatttataactccctcacaacctttttttttttttttttgagacggagtcttgccctgtctctcaggccggagtacaatggcgcgatctctgctcactgcaacttccacctcccggtttcaaacgattctcctgcctcagcctcccgagtaacaaggattacaggtgcccatcaccacacccagctaatttttgtgtttttagtagagacagggtttcaccatgttggccaggctggtctcaaactcctggcctcatgatccgcccgcctcggcctcccaaagtgctgggattacaggcgtgagccccagcacccagcctccctcaccacttcttagtcaactgtaccttgggataaaatattaatatgaaatatccttttttgtcccttttaacagtttttaccttgaaatctattttgtactctcttatgttgttatgctttctttattctgttataatttttcctggtaatatcttttgagaggaatttattttcaatcttcctcttccaagttcaaaccaacctaccgaattgccttttccatttttccatcatggatgggtcttttgctccatttttttacctcataggtagttgagaagatataaaccctctttctattattctaatattatcttaagacaaagggtgatcaagttaacataattctgagaaagattttatatatatataaaatctgtttatatatatataatctgtttatatatataaaatctgtttgtttatatatatataaaatctgtatatatatatatatatatatatatatatatatatatatatatatatataatctattccacaatcattctttctgataaggaatggaaaagaaggtatttgccagatcaattgccccataccacgtatttgaggctgtaataatctctaagcaaagataccacacatgtagcacagcagctgcatttggggttaatgctttgttgaatttgtaggatctttccggtttttgtaggaactacactggtgaattaaacgaaacctttaagaacctaatgataccaccaccctagtatcattaggttcttaaagatggcattgatatctgccatttccctttgagattagatttttattttttagtaatttggccaggaaatgggcagtttcagaggcttccactcaggcttcactactatgatggctcttaaagctaataaatcaatgtggatattctgcccattactactattctaccattttgttcattccatataccttttgagaacaaagaaatagcactggatgggtccatgcattcatggacatacataggccctggatcccatttattatctggccctcctataccctaaaagtggccacgatgaagctttaggtcataggtgtcaatgtcaattcaaatttcgcatgttataagccttgataagtttggatatttctgtttccccaggatttagttactccagtaatgaccatagttctctttgaggaaaggctatatatatataactccactggccaaaggcaaaaatatatatataactgcactttcagggtccttgatcataggtcctggcctcttcttcagtcagagggctctgagtctgaaaactggttcaggtgtggaaactgggcaagagatcacctgtttttgtttgagcagctataatcacccccctctaatctctatccttgatttcttttaattgtgtagattgagcatgttgttgttgtctacccatttgtcttatctcagaaacatcatttacttttattctgatgccatatcatctccatttctatcaaaggttcacttctgtaatgacatcattacaatcagccctatcctacagaggatagccaccactgagcttctcagtgacattggtgtccttctcaccagcatattccttttgtttagtaaacagaatgtcctctgggaccttatatggagcctagttatctggtggacttttcattttcacgtatttattctagcaagtgctcttctctaagcttttctatccctccttctactgtcttccacagcagttctgacatttctacttagtgtgcgtcaccaatttctgcaagtttctaaaagccatcgtagcagcttctttgcatcatatgctgtgatctttaccaagatattaaatcctatagtaagggagagggctccaacactgataaattatctcttatccaatttgatgtctgaccctttgattcagcatgtactcttttcagctcctgattctacatgttgactaggtcctacagctcccatagcagactcagccttttccctgttaggttatgttatgatttacccttagttataatcaagtggttaagaaaaggtagggacagagtttaaggagaacatatgttgttttgcaagatagcatcctctgttttatctttatctacgggtggaacacaaacatttaacagggaagaatccagagggtttagaagaatctagtgattcaagatttttaaatgcatcaacacagatacccctattccatgactcagtgtctcattctttcctaattaagatcttgaacttagtagtcaagctgcagtggcttaaaattctaacataatgtctacttctctcataatcaagtcttaagcctgattcctagccttttacgttacaggctacaggagatgctagactccaaatgctataaggagggactgtggctctcaaatttaacttttagttggtaattaatcaacttcagcctttcaaagtctttctcaaaaccctctactgtttctacaacagacatccaattccattgcccttataattactatttcccttttatgtctcaaatacttaatacatttaatctgccagtgccttcttttctactagtatgtcatccctatttaccaccggataaagtgttaataattatagcactaagggctgctcaaactccacttaccaccagtgatggagtcctcatttccagccagctggtgggtgatccagctccaaactccaattttatattatattttttactacctgttatgagctgaatgtgtcccttcaaaaaatcacacgttgaagctctaacccccaatgtgatggaatttgaaagtgaggcctttgggaagtaattttgtttctattagatcatgatggtaggatcctggtgatttgatggtattagcgcccttataagaaggaaactgatctctctctctctctctctctctctctctatctctctctctctcaagcttgcaccaaagaaaagccctaggaggacatagtaagaaggtgactgcctacaagccaggaagtgagccttcctgagacaccaaatctgccagtatcttgactttggacttcacagtctccagaactgtgaactgtgaataataacagattaacaggttaatctatccagtctacggtattttgttatagctgagaagcagtctgagatagagatttgtatataagatatttattaggaagtgttctcagcattcactcctgtaaacactgaagcagaattaggtagagagagaagctggcctacagtgcaatcacagcaacggcttcagcagatctcacagggaacacagtcactgggatggccctgcaagtggtttccaacttaagcaatgtgtttgggcctttatgccagtgcatcgactagcctcaaattggagcaagggggaatgacctacttcacccaaagacaattgccagaagagcaatggggaaaatggttcaatcccagaatgctgtggacagcataccacagcatccatcttagatgtaaaatggtacctcatttctctggttcttcccaagataatgtagcttttcatacgcttattgaccactttgtgggttgaataccgaggttacacattgcctcatgaaatgattagcaaactttgtctctttctctattcttgtaactaattattaaaagagaaacactaactgtgcctcaaatttttagtaaaatcagctggttaacagtgtggggttttcttggggggagggcgctgacatagttttgtgggggttaatgaaacggttctgattctaggattctgagccactcactgctccagctgtaacagatgcctctgttgctcactgctttgcactagcaggaacagaaagaatgtctgtatcccgtcactgcttctattagagcacaaaccactgcaccaaccacattttaggcagtccgtcctgtttcccaaggctaccaccttgcagaaatcctcttacagatacattttggctaaagtttcttctcaggaaattttctcctgctttcatttttcagggattcttttataatttttggttctccaatggtgctttagcatttggaggaacagtagagaaaggggtaaataggttttgagaaccaaacaaacaggtcctgacaaaattacattatggagcaacaaagaaaaatagaaattgcaacgttgctttattttctatagttttactatgtaaacgtttattgctgaatgccctagctttgcctgcttttaaactttatgtagctagaatcatacattttttttcttttgacttatttaacattgtttgtgagattcatccactttgtgcatatatagtttattcactttcactgttatatagtagtccattgcataacattatgtatttttctattgtactgattatgtacatttagattgtagaggtatctttaaatatcctccactaaaatggaagatttaagatgatagatttatctatgtctccttacagttttgttagtttttgctttatatatttcagagccatgttattagatgtatacaaagataaattgtatcttcttgctgggttaacccttttatggtcacaaatgattgcttttttatctgataaacattgtcagagcagttttttttcaatggagttatacgattttgttttacatttatgtacaatttatgtacaacttttttacattcaggggttacgtgtacaaattcgtaaatggatatattgagtgatgctgaagtttgagcttctattgaacctatcactcaaatagtgaagatggtaaacaataggtagatttcaacccttgtccccctccctccttccatttagagtccccagtgcctgttaattctgtctatgtgcgtgtgtacccaatatttagctcctattatacatgaatatgtgttatttggttttctgtttcttcattaattcacctaggataatggcctccatctccatccttgttgctgcaaagaacatgatttcattcttttatggctgcatagtattccatggtgtatacataccacattttctttacccaatccactgttgatgggcacatagggattgattccatgtctttgctattgtgaatagtgctgcaacaaacattagaccgcatgtatctttttggcagaatgatttattttcccttgagtgtgtacccactaacgggattgctgggtaaattgctatctttagttctttgagaagtctccaaactggtttccactggagctgaattaattaatttacattcccaccaatagtgtataagcattcctttctctctgtgaccttgctaacatttgctaaaaaatatatataaatatatataatatatttataatagccattttgactagtttgagataatatctcattgtggttttgatttgcgtttctctaatgaatagtgatgttgagcattttttcatgttttctgacaatttatgtcttcttttgagaacggtctgttcatgtccttttccaactttctaatggagttatttggtttttgcttcatgattttttaaaattccttatagactctggatattagtcgtttatcagatacatagctcacaaatatttctcccattctgtaggttatttaccttgttgatagtttatttggctgtgcagaagctcttttgtttaattaggtcccagttgtcaattttggggtgtgctgcatttgcttttgaggtcttagtcataaattcttcaccaaggccaaaagccagaagaatattttgtaggttttcttgtaggattgttatagtttgaggtcttacacttaagtctttactccaccttaagttaatttttgtatgtggtaagagggtagggattaaggttgattcttctgcatattgttacccagttttccagcaccattgattaaatagtctgtcctttccccattgttctttatttctgagttctctattttgttccattggtcaatgtgtctatttttgtaccagtaccatgggttttggttactgtagccttatagtatgagacaccatctcacatcagtgagaatggctactattaaaaagttttaaaaatatcaaatgctggttaggctatagagaaaaggtgatacttatacactgttgataggaatgtaaattagttcagcctctgtggaaagcagtttggaaatttctcaaagaacttagaactatcattttacccagcaatcccattactggatatatatatacccaaaggaaaataaaccattctaccaaaactacacatgtactcatatgttcatcactgcactattcacaacagcaaagacatagaaccaactcagcaaagacacagaaccaactggataaagaaaatatagtacatatacaccatggactgttatgcagccattaaaaaaataaaatcacattaatttgagatggattaaagacttaaatgttagacctaaaaccataaaaaccctagaagaaaacctagccaataccattcaggacataggcatgggcaaggacttcatgactaaaacaccaaaagtaacggcaacaaaagccaaaatagacaaatgagatctaattaaactaaagagtttctacacagaaaaagaaactaccatcagagtgaacaagcaacctacagaatgggagaaaatttttgcaatctactcatctgactaatatccagactctacaaagaacttaaataaatttacaagaaaaaaacaaccccatcaaaaagtgggcaaaggatatgaacagacacttctcaaaagaagacattaatgcagccaacagacacatgaaaaaatgctcatcatcactggccatcagagaaatgcaaatcaaaaccacaatgagataccatctcacaccaattagaatagtgatcgttaaaaagtcaggaaataacaggtgctggagaggatgtggagaaatagcgcttttacactgttggtgggagtgtaaattagttcaaccattgtggaagacagtgtggcaattcctcaaggatctagaactagaaataccatttgacccagtgatcccattactgggtatatatcgaaaggattataaatcatgctactataaagatacatatgtttattgcagcactattcacaatagcaaagacttggaaccaatccaaatgtccatcagtgatagactggattaagaaaatgcagcacatatacaccatggaatactatgcagccataaaaaggatgagttcatgtcctttgtagggacatggatgaagctggaaaccatcattctgagcaaactatcacaaggacagaaaaccagacactgcatgttatcactcataggtgggaattgaacaatgagaacacttgaacacagggcagggaacatcacacactggggcctgttgtagggtagggggctgggggagggatagcattaggagaaatacctaatgtaaatgccaagttgatgggtatagcaaaccaacatggcacatgtatacctatgtaacaaacctgcacattgtgcacatgtaccctagaacttaaagtataataataaaaaagacacaaacaccccaaataaagagattaatattactttaagaataaaaaataaataaataaaataaaatcacatcctttgcagcaacatgggtgcagctggaggccattatcctaagcaaattaacacagaaacagaaaaccaaatatcacatgttctcacttataagtggtagctaagcattgggtacacatggacatcaagatgggagcaatagacactgaggactactaaggaggatgagagagagtgaagaaatagctgaaaaactacctattccttactatactcactacttgggtgatgggatcacgtgtaccccaaacctcaaaatcaaacaatatagccatgtagcaaacctgcacatgtcccccacttggccatgtccataagtgtctctttaccaaatcatccttgcaagggtaaaccatgctgctcatgttctcacacctaggccttatgggtggccaagggatggccacttgcaggagtgtaaacagagcttatacattcttgcttggatgtctgtgcaagtgcagtcatgtgggctagcaaccagtcctcctcaccaacactgccttccagtctggaattccaaggatcccaagaattcttccttccagatattataaaggatagttgttaaggaggtaggataaaatgtgttttagtaatttgttatcttgatttttaacttttaaatatttaggcatattgtacgtgagccttcatttattattcttgccctgggccctgccaatgccaaaggcaggtttgctcctaggaagcctgctttctaaccacaccaaatatttgtagttatttaacgcctggacttcctcaaacctcagtaactttgcacaggctattccctctgtctagaatgcctgagaatttccttgtacttatgaagcatccttcaagaggataaaaggtaaaaattaccaccactgttactgtatattaacattgctctggaagtactaaccaatacaagtagagaagaaaaaggaacaagaatacgttagagaaatgagaaacgaaactcacatcctttcatattgtatgattatgcagttaagaaacccaagagaatcaaccagaaaactatttttaaatgataggaaactattgtaaggaagagagttataaaattaatttataaaaatcagtagttttgctatacacaaataatacttgaatagaccacaaaaaactctttttaagatttaatttacaatagtaacaaaaagataaaatatctgtgactagaatttaaagaaatacataggatgtatatctgtaaagtttagagaaaactctaaaactctaggaaattatttaatcaataaaataaataccatagttacagaaaagaagattcagttgtaaaaatgtcaattttcccttaaattgacaaatcaatttaatgcaatagcgttccaagtacaaacaggatttttttggaacttgataaaataatgttagaatgcatctggaaaatgtacatgtgagaatggccagaaaaattgctactagatagtaaaatgaattatataactatttaatttaaatgtgtggtcctggttctagaaaagactacaaaaaaatcataaattgacccaagtacttcaggatgttttagtattagcataggataagtctggagttttaaataaacaaaaccagcaggaaaacaatttcacaaataagttgcattagatcatctggctagccatttgaagaaataagtaaaaatacagtcatgcagtgcataatgacatttcaatcaacaacagacagcttacaatggtggtcccataatattataatactgtattttactgtaccttctctttgtttagatatgattagatacacaaataccattgtgttacaattgcctacaatattcagtacagtaatatgctgtacaggtttgtagcccaggagcaataagctatgccatatagcctagatgcatagtaggctataccatttcggtttgtgcaagtacactctatgatgtttacacgatgacagaatcactgaacaatgcatttctcagaatgtattcctgtctttatgtgatgcataactgtagttgattgcctcattccttatatcgaaattaaatttccaggaaaatcaaagtttgtaatataaaattgaaatgaagtaagtctctggactaaaacaggagataattttttaaataattttaaatcgaagaagtttcatttaaccatgttgcaaagatcagaattcaaaaggaaaaggattgataaatttgaaatcaaacaatgcaaacctcactgcatagcacacaaagtaattatcacaccaatgttaagggacaactgacaaactgaaaagtaatttgcaatacatgcatcagacaaagagctggtttccttaataaacgaagacctcctagaaataaaatgttctagaaaatcaatcaacctaatagaaaaattcacaaaggaactgacagttcatagggaaaaaatatacatacaaataattgtttgaaaaatgctaaaccctactcataaaaacacacaaaactgcaggagctaccaatgtccactatcacagtggcaaaggcttaaaacttaataaaactttggataaaagtatgggaaaatcagtgttcttgcacaatctcgttagaagcgagtttgactcggtgaaatttacttggaggtcaatttgtcaatcacgatcaaaaaagtaaagtgaatatatacattttgacccaaacttcacttctagtggtttatctttttctttttttttcttttgagatggagtctcgctgtgtcaccaggctggagtgcagtggcaccttctcagctcactgcaacctctgtctcctgggttcaagagattctcaggcttgagcctcccgagtagctgggattacagtgggattacaggcacgtgtcaccgcacccagctaatttttttttttttagtagagatggggtttcaccatgttggccaggatggtctcgatctcctgacctcatgatccgcccacctcagcctctcaaagtactgggattacaggtttgagccaccatgcctgacctagtggtttatctttaatccacacacatgcttagacatatgagcgcaagctttatttgagatagaaaaaaaaaaacaaaattgtaaacatttaaatatccattaagagagaacttattaataaattatgatacagttatgaaaatgtcatggatttctatgaactactttggaaatacgtctttaacttttattttaagttcaggggtaactgtgcaggatgtgcaggtttgttacataggtaatgtgtgtcatagggggttgttgtacagattatttcatcacccaggtattaagcctagtattcattagttacttttcctgatcttctccctcctcccaccctccaccctccaataagccccaatgtgtgttgttcccctctatgtatccatgtgttcttatcatggaaatatttcttaagtgtaagaagagaaaaggtacaaaactgtatgatttcatttatgtagaaaagtatgtgtgtgtgtgttttgtgtgtattgatacttgtttatacctaagcattcttagaagaatactaaaggaactgttaacattggataccattaattatattggaggtagaggagagaaactgttttttcatttatatccctttctcctattgataatttcaccaagtggatatattacatttataattttaaatatccagcctaaaatttaggacaattcagtgttgcctaagactgctgatcctccacccccacacacggttgagttaggagattcctctctttcagagcattacccacagtgaattgtaactagttacttacatgtatgtttctcctaccagcctgtgcattcattgaaggcagacatacgttttattcatgtttgggtcaccttcacttagcatagcatctggcacattgaagaggggcaatatgtgtttgataagtgaatgagaatgaatgaatgaagcttttccatttccaccatccacattcaatctctccctcctgtgaactcctacagcactctgcagctccaaaaatacttggctcacttccccttaggaatgttttacgaaccctccactagactccataagaacaaagacaatgtcattgtcatacccatctccagcccagcaccaagcatgctatctggccccacacaaagcccagaagtatctgttgagttgaactgaaaacaccaacactgttaacataaaaataggttctgtcctaggaaaatcgttctcctggttccaaaaagaaatgagttcagtcttgccaagtctgttttagcagaataaagtcccatagctaatgacagcctttaactattggaaatgtaaagccacattttttttttcgtatggtaatgcaacaaagaggtaagaagcgtttgtttttaagtatctaatcatttcttattttttgcagcaggcgagagaacatgacaaaaggcaatcgtaccacagtgaccgaatttgtcctcatgggattcacagaccgtcctgagctgcagctccccctctttgtggtgttccttgtcatttatctcatcaccctggtgggaaaccttggcatgatcctgctgatcagagcagactcgcggctccacacccccatgtactacttcctcagtcacctggcattcattgatctgtgttactcatcttctattgggcccaagatgctgcaaaatgtattggtgaagaaaaaaaccatctccttttcaggctgttttgctcagctgtacttctccggtgcttttgccactacagaatgattcctcttggccacaatgccctacgaccgctacgtggccatctgcaaccccctgatttacacagctattatgacgcagcgggtctgcagggagttagtgataggggtctatacctatggcttccgaaactctgtgatacagacagctctgacgtttcagctgtctttctgcaactccgacgtcatccaccacttctactgtgctgacccccctctcctggccctctcctgctctgacacccacaacaaagaaaagcagctcatgatcttctctgcagtaaatctcactgggtccctccttaccatcttcatctcctacatttgcatcctcttttccattataaaaatccagtcttccgagggcaagtgcagagcattttccacccgtgcctcccacctcactgtcgtcaccatcttttatggcacactatttttcatgtacctgcagcaaccaaaagcggggaattcatggaagccaaacaaagtagtctctgtgttttatagtcttgtaattcccatgcttaaccctcttatctatcgcctgagaaacacagaagtaaaggatgccctgaaaaaaatgctagagggcaaagagttatagtgagtgagttaatggaacgcagcatactgaaagtttgatatattgacaaggtaatgtctctaattaagtttacatttagcaggccaactgctgtccaatcaggaagcaaacagtaatccaatttgggaattttaatgaccaaagtactgggtcacttatttaacatagtaatgtttaatccaattatcgtgaactatcaaaattgacttacaagctagaatgtcaataactgtgtccttcatgtgctgaagaagaaatggcttactaccaattaaataataatataagctctatattaaaaaagatcctgaaaagcaacattctgggtgaaactataatttaacaaagctgggtacaaaacccacacatgaaaatcgatgttataagaaacacttttcagtttacaacaggctgtattgtagagagtaatttgttagtcttagaacatatttcttcataacactttgctacagacggtgattaagtttcaagaccagcttacaaaaaccttatttaatccaaatgtaattgaaatactgcatgctttaaataaacaatagaaaatatagtattgcagcaacagtggggggagaaaagaacaacaaaaaaaaaaccactgggattcaattagatgggggggttgtttagaaaagaaagtttaattaaaagagataaagagaaggtttaggaaacttttagagatgttaaaaatagtcattttttcaacagccagggttcaatttttctagtctctggaaagtggagccatagtgagttttttgggagggggtgaggggtgagtagggagaaaaaggaatggaaagagggagcatttggggaagtaatcaggcctgggtatatgtgaatgtttctaagaaacaaaattattgtcttaattaatttgaatgatctagagaaatactttagttttgcaacattttccatgttctttatttttgttttcacagatccagcattccaatttcttggaaataaggctatatgaattcttggtgttttgggggataggtgaaagaaaaatctctaattttttttcatttaggcaaaaatatgagcactctttgttttggggtttttttgtttgtttgctttttgtttttttgagatggagtctcactctgtcacccagcctgcagtgcagtggcacaatcttggctcactgcaacctctgcctcccgggttcaagtgatcttcctcagcctcctgagtagctgggactacaggcgtgcgccaccacgcccggctaatttttgtacttttagtagagacagggtttcaccatattgggcaggctggtctcgaactcctgacctcgtgatccatccacctcggcctcccaaagtgctgggattacaggtgtgagccactgcgcccagccaagcactctaccgtttttctaagcctcgattctaatacttctttcaaaataattcttaaggcaaacaaatctgccataaaaatgtttattttcctcctattttcaaaagtgattactgttaagtaatttttaatggtttgtaacatatactaccaattaattacaagtaagtttaaaattaatcaaaaaaactaagaggtccctgttgtccccaaattaactctgcagataataatatgggatctttgttttactgttgcttataatcagataatttagaaaaataaaaagttaaatatttacaacttctcctacttagttcagaaagcctttccagatagttgaggtataagttgtatcgctaagcatttgaagatggagtgttggctatggttgaaaaggaagacactagcaggataaaggaacagagggaagaaaagcaggaattgagccagagagggaggagcggttgcacaggtaatgagcaacaggggaacaggcaaagtggagaggataatgctgagggattataggagcctgggtattagaccaggagctcccccttgagaccaagcaaattatcttcttcactttgtaccccagcaccttctgcagttcctggcataaaatagatgcacaataactgtttgctgaactgaattgaactcgtttgtgtttattcctaactctcatgggtgggtagacatggtgcccagcaatggtcctgcggtttggaagtgacagagaaaaggaagccagtggggttatgactggaagactgtttttcaatattctcataatgaaactaacatccatgaggtgggaagacatacaaaggcaacagcgcaacctgaccagagaaagagaagttggtacattgggaagatggcacgagctggagctgtcgacagaccataacaatcaacgaacaactgctgcggaacaaaggttgctactaactgagataaagatgaacacggaccaacatttagatggaaaattgtgctttcaatcataagccatgtctatttcttaaacttatttctcaaactctctatgtcagtttaatttagaaagtgaaaaataaccatgcactagatatcacgtttcaatacatgcctctcagcaaatgaattctattcatgttttcaaaggaatattcggtctaaaagtttcatcagttttcagttcttttcaaggaaacctgaataaaatgttacaagacctccccataataccttcccagctgttgaatttgtacacttggctcaacacgcctccttgattactctgtaaaacaaagcataaaattgagaatattgtattcatagattgcaaagaatataaatctacattttactaaatttcccagaaactcgaaaagcaaataggcatgagaaaaggtcagaatcagctaatttttgagctaataattcctattttcttttcccattgagactcagccttatacatttatctccctgactctggccttatgaagtaagaaaggtctcaggtgaaaaattctcaaattaattatttgcgttaaaaaatagagtgctgtatatatgtatagtattaatatgataatatataatccacaagagaaacaaatataattatacacctttgtttccttataaagtgaggctgtttcagtcaatacgcagaataattacactaatcattcagcccaaagtaaatatcttctgaatatgtaaatgtcaccaaaataatggcagatttatcagaatttaagactgcaacattttgctgaaagtgaaaataaactcttctcacatgtaaataaacagcgtatttgtcttcctttgttaataatcctaaaactgaatgttatttgccagcattcgccacttagacttttcattaacaaatatgatatgtatctgaaatactcatttggacataaaatgctgaatttttcaactggtatagatttcaacttcttatttctcttcattttatactctattgatttgtcatgcttggaaacatgccaaatgaattgttttattattccaatcaaaataaggaaccatgagagggaaccatattattcttttccattttctttcatattatttgatgtattagaatttcagaaatgtaagcattttaaaaatctcaaatatgtgcccccaaattttcaactctgccctggatgtatcattctagcattctttggtgaacaagattgaatagaaaagtgctgattcagtgctcaagagtggctccacctgcaactaagtggtgcatccaccagcaataaagaggccactgatgtcagaacttcaggagtttaggctcctgggaaagtgacagatttagcctactcttcctagccagcttgctccaaaaatataaaccttttataaataactggaacttccatgtccggtaagacaggaaaaactagagaagggaaaagatcatctttaatttttaaaaactaagtaagtatctcttaggccttggcagaaactatcctaatagagacagtttccagaaggtcttattctgtggcctaaaacaaaaatgttttattccctcaagcttcctttttttttttttttgccaataacttaatagtttgttagtcaataatattacaaatattttaaaattatttaatataaatagttggcagcaaaccattccattacagagttaaattaccagtacaacagacagactggagatttagacacctggaagataacaataaaataagctaaaatatttagcaaaaaatttaaactgaaggcgtttacctagtgtccataaaagcacaagcttactttctttgcttgggcgtgttggccactcaggcacctggacacctacgaacctgcagcttctgctcctcattgaaaggcagtcttgtttgccagccacgttggatgtggcatgaggagaaggacagtcaatgagccagccaggctccagcactctcctgcccacctctgcctcaccctcagctggggatgctacgtgactacagctttctcatatttaggcaagagtacagagagctctcaggtccatctctgggtttctcctaaaagctttttatttcattgttattgtctttcctctttagaaagagccacttttaaccatttttattcttatcatgtcatatttcatgtgaaagttataaatagtatttcacttatttgctttggcaaaagtagctactagctttccttagacatctttcaaatggagaatttaaactagtgttaactgtaataaaggagcaaattgaaaggaaattctaattaatgttgcttgtgttggggagtagtcattttatgaagaaaggttgaaatgtcttcttaaaattttggactatcttttcttatatttaccacaaatcacggataattctcaagtgttcacagtctcaaaatagcaactctattagctttaatctaagaatacagttctctgctctgctttatttaattaggtgttaaaacacaatctgttaagcctttatctcctgacatattcctattttcctatatattaaattgttaaatttatcaaaagaaggctgtcggtatgatcacttcattaaacctgtaactgactcctgataatgcctatcagtccacactttagacatgtataatagagcacatcagtagacacctgcaaaccaagtaagcagaataaatcatgctgagcctgaaaaaaatgcatgttcttggaggtaaagattttgcttaccaaaaataaagtatggtctcaaaaagcagacgctcaaagcctgtggaagcagtggtgatgtactaggaagaggaatagattgggaaactcacagtctgatcttgagtcctttgtatgctctgacctgtggtatcagtcaagtggcttgacccgtctagccttaactttttcatctggaaaatgaggaaaattgtacctcaaagagctgccaaacagacaaaatagtctacggtatgctaaaacatattttaaacattataaaagtataaagcttttatttttaataaccagactttaccatgattagtgtttaacttttagagtctttgatttgaagtgtttgggaaatccttgctggaaaatgtttttatatctacctatgtgacaaaatatagaagttgcatacgtgtccaataatgcattttctttatgcatgactggaagaaattaatgcagcccatttccaacttacaggagttctggtcccactgtctgttcgcaagtcaacgatctggaacatggagactgtcccctggacacaaagttgtcttcttaactaataataaatgttcacagacatttctttgaccctaaaccactacagctcacacatttccatagcggacactagaaacgtttttcttgttactgctgcagttctgaaaggcagcatttgtcccccatgtctgtgactgctctgagcttctgctggtctcacccagcctctgaaaagacattagcggtaagctgtaggaggcaggccagggtgttctatggggaaggggtaagagtaagagaccttttccttggtctctgcttggactagcaataagcctggcagaagctgagggaaagtagcacaagagttaaggttctgcagaagcctcttcccctaccttctttcccttcctgtgctctctaccttccccaagcagggctgctaggatgagaattccaccgcctctctaactctaggaggagggtgatgaggagcctgagatatgaggatccaaggctgggtaggaggagagaaaagggggcagggaagagggccggggagaagatgatgtgctattctgagattctgtggagatgctggctattgctttactcttttgagaaagagtaaaatctctcaagtattgatgaaccatccaggaaaatgcagtgttgcctgttagagtaaataaagtagttacagtagatatgtaacaaaagttaactgaatctagacttaatctgctccctgcttctctctctctctctctctctctctctctctctctctctctctccccccccccccaccttcttccctccctccctccctctctccccaccacaccacagatactctattgggaccacaaactcaaaatcctaatgattaaattgatcatcatcttctacttcacagccaactactcctgctttccctatttttgtacatgacaattttccccagtcatctagttcaaaaactatgtagtttctccttattacctcatatttcaaagaggagacaagacttatctattattcatctatgcattcatgcaagatttcttgcactaatccttttccttttcattgctactagcagctttatcattactttgcacctggacctccctggtatctctgcatctaacctcttcacatcaaagatcctcagtagattcatgtatgtataacatataataatatcaccattccagatcagtgagggaaaagatggatttatcgtaaattagagaaaatgcaagccacaacacagttactttttcttatactctatatcaaaataaattcaacattgatcagatcttaaggtaacaaatgaaaccttaaaagcgcttgaataaaatattgctgaatatttgctaggcttggaataagaaaagcttttccaagaaaagaattaagttcagaagttgcaaataaaaagtgtgaaagatttgatgaaatcaaaaattttaatgtttattacaataattagtaaaaaaaaattaaatgggaaaatattcactatatatgacagaattaatacagacaaataagataaatcagtgaaagtatagttacaagatatgaatggataactcacaaaataggaaatataaatggcctttgatatgcaaaatatttcactctcgtaatcaataaaatacaaattaacataatatcattttcccctttcagactggcaaagatgttaacaaatattaataaccaggatgacactgtagagaaagaggaaacacagtgtaaactggcataaaatttccagagggcactttgacaacactcatcaaaagccttaaaattaagcatcctttgatctagcaatttcctttacaataatttgtttgatgaaagtactccaacaaattcatgaagatctgtgtatttagcatttactgttagtgattataatagtaaaaaaacagtattaatataaaaaaatcaatggaggattgattaaattaaggattagtgacataatagcatgtaatgcatcaattgatttatttattgttatgaaaatgctcatgatatatgtgcaaatgatttcaaattatgtgtatgatttttttaattacatatgtgaaatatgtaaagatacagagattgctggtagtggttggtgttggttatttctgggtgatagaatcccagacgctttttactgattctttatttataaataaacagaaattaagaaatcgatcccatttgggaaatagtcttaaatcttcagttgagattttaccctatattaactccaaagttatatataccctatattaactccaaactagggaccctcctagtgacaaatgtcaagcctacaggcaggggccaaattgaaaggttgctaccataatctaaatgtatagtgagcgaataatgctagtgaaagagacagacaatgagccaatacaggtgtcaaagttgatgctggagttttagacctgtctgactaggaggctgttggcccaaagaagagatggctaacagaaagatgctgggtctttaagtgcccaacacagagccttaaacatagcagccattcaaaatttttttaatggaagaatgtagttccagatgatttcttattatgatcagtatatatgctctgtacaaagtattttctggagattccaagaaggctctaatagaggcagtttgatcaacacaagaaacaccaaaatgggagtcaggagacctcttttacccatctcctagctgcatgtttctgagcaactcacttcaccctttaaggagtccgcattctgcacaggcatttgaatgctactgttttagagagatcttccctgatttccggtcctcaagaaaaagaaagtagctgagtcctcctgttctcacttgtctggttgtcagaatccagttggcgcctaggaattcacaaatctctgtccttcttgtctggacttgccactgacatagttagttcccttatcacgttttggacttaactgacataaagaatacgctaaggaacctgctcagaacatcgcaggatattgagctgggcctctacaaagggtcttaaaccctgcgcttaacattcattgggctcttactaccctttaggccctgctctaagcactttgcatacatgagtatatctcacttcatcattacttagcaaaagccgttctgattaaccataacacagataagtaaagtggagcttaaagaaacgaaatgatggatcctggatcacatagtgtggaaatggtggaggccagattcagacccaggaaggagactggcagaggtttaacaggtgcagacgctgcaagatctgcacaagaggccataagaggttttacagctttcttcactgaagtttttcactgtacttcattacacagtgtatacttatatcaagttattacattgtactccttgacaaatttttatttgtcaactaaatatgttttaagagaataaaaaaaagaaagaatgggaaatatagtgaactggctgacctgttataggagtgtggactaataatagcacaaatgccctctgattcatggtgtatgtctaaatgatggggctagattcaggctccaaattgcttccctggagcactgcggtgggctgtggcctattgttcctatgtccacagggattgtactgctccccactgtcctcaccagtgaaaagcccagagctgggcttggattgctgacagggctggcctaggcatcagcctgtttgcaacagggaccaatgcacagcaaagcttttcacactctgccatctgaaccagaagcctagcttgcttttgtcgagagtgttcttaggtacataaatataacaaggaattaaataaagcacatctgcagatttccttcaggctttacatattctcttccaaatacacgcctgagtctccaagggacaagcactggctcacctttcctgagccagctggtaaataatttgtatcagagtagatgtctgaaccctacaattcttgtcacttccatattctccatatcctttttttaaaaatattctccatattcttaagctgcagagtcaaattactgtcatgatgcaaaaaacaccacagtagacacaattttttttgacaatttaaatcctatttgaacctctcagttttggagtgaaaactaacttttgagatgtgatagatgagaacctaacaattgctaaaatcctggaatagaaataaaagaaaggaactgcctctaaaaccttacaaactttgcttaattagtaaaggagcaacaaacaattcataagcccctacaataaacatcacactaagaaaaaacattttacttaagagcctttaaaacattcaaaaaataatgttccacaataaacatacgtgggaatgtgtctttatagtagcatgatttataatcctttgagtacatacccagtaatgggattgctgggtcaaatggtatttctggttctagatccttgaggaaatcatcacactgtcttccacaatggttgaactaatttacactcccaccaacagtgtaaaagcattcctatttctccacagtcttgccagcatctgttgtttcctgagtttttaacgattgccttctaactggcgtgagatggtatctcattgtggttttgatttgctttctctaatgaccagtgaagaatgagttcatgtcctttgcagagacatggatgaagctggaaaccatcatcctcagcaaactaacacaggaacagaaaaccaaacactgcatgttctcacccataaatgggagttgaacaatgagaacacatggacacagggaggggaacatcacacaccagggcctactgggggtgggggcaaggggagggagagcactagggcaaatacctaatgcatggggggcttcaaacctagatgacgggttgatgggtgcagcaaaccaccatggcacatgtatacctatgtaacaaaactgcacattctgcacatgtataccagaacttaaagtaaaatttaaaaaagttcctagttttgatacctgaaaaaactttgcagaattcaaacacattagaataaaatttgattttaaaatattgatttaaaagttgagttgaactaaactgtccgatgtattacacactcctgatgatttcaagtctaatattttagacttccttgaattaaatatactacctacaaattatcattttaaaataactatttaaaaaatatctgtggcattgaagctagaagccacttacttccatgtttttgctatcttgaatgtgttgttatcaggttcacacagtggtataaatggggggagtttgttgaatctgagttttacataacttgagaaaatgggttcttgcaactttcctctgggatttaatactaatcctgttactgaggaaatgatgaggatattattcgaaaagtcacagcactgataccctcttgaaaaacatgagcactgtggccacagtgcattctattctttctagcctctgtaaactccaggtaactcacaggttattttcgctctcagtagatagttttatttgcataccttttcttaattataaaaggaacatcagcctgaaattacaagcccagtagaaagagtgttttaagcagagggaacagcaggctgaggggcccagatgacagagaatatgtactggaagaactgaaaatcgaggagaaaggtgctgaattagaaagtacaaactagggggaggagccaagatggctgaataggaacagttcccgtctacagctcccagcatgagcgacacagaagacggtgatttctgcatttccatctgaggtaccgggttcatctcactagggagtgccagacagtgggcgcaggtcagtgggtgcgcgcaccgtgcgcgagccgaagcaggtcgaggcattgcttcacttgggaagcgcaaggggtcagggagttccctttctgagtcaaagaaaggggtgacggacggtacctggaaaatcgggtcactcccacccaaatactgcgcttttccgacgggcttaaaaaacggtgcaccacgagattatatcccgtacctggcttggagggtcatacgcccacggagtctctgattgctagcacagcagtctgagatcaaactgcaaggcggcagcaaggctgggggaggggcgcccgccattgcccaggcttgattaggtaaacaaagcagcctggaagttccaactgggcggagcccaccacagctcaaggaggcctgcctgcctctgtaggctccacctctggggacagggcacagacaaacaaaaagacagcagtaacctctgcagacctaaatgtccctgtctgacagctttgaagagagcagtggttctcccagcacgcagctggagatctgagaacgggcagactgcctcctcaagtgggtccctgacccctgaccccccgagcagcctaactgggaggcactccaaagcaggggcacactgacacctcacactgcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagtgtctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacatgaagaatgcagaagcctcaggagtcaatgcaatcaactggaagaaagggtatcagtgatggaagatgaaatgaatgaaatgaagcgagaagggaagtttagagaaaaaagaataaaaagaaatgaacaaagcctccaagaaatatgggactatgtgaaaagaccaaatctacgtctgataggtgtacctgaaagtgatggggagaatggaaccaagttggaaaacactcttcaggatattacccaggagaacttccccaatctagcaaggcaggccaacgttcagattcaggaaatacagagaatgccacaaagatactcctagagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagacaagaattttcaacccagaatttcatatccaaccaaactaagcttcataagcgaaggagaaataaaatactttgcagacaagcaaatgctgagacattttgtcaccactaggcctgccctaaaagagctcctgaaggaagcgctaaacatggaaaggaacaaccggtaccagccgctgcaaaatcatgccaaaatgtgaagaccatcaagactaggaagaaactgcatcaactaacgagcaaaataaccagctaacatcataatgacaggatcaaattcacacataacagtattaactttaactgtaaatggactaaatgctccaattaaaagacacagactggcaaattggataaagagtcaagacccatcagtgtgctgtattcaggaaacccatctcacgttcagagacacacataggctcaaaataaaaggatggaggaagatctaccaagcaaatggaaaacaaaaaaaggcaggggttgcaatactagtctctgataaaacagacattaaaccaacaaagatcaaaagagacaaagaaggccattacataatggtaaagggatcaattcaacaagaagagctaactatcctaaatatatatgcacccaatacaggagcaccaagattcataaagcaagtcctgagtgacctacaaagagacttagactcccacacattaatgatgggagactttaacaccccactgtcaacattagacagatcaatgagacagaaagtcaacaaggatacccaggaattgaactcagctctgcactaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactacttggtacataacgaaatgaaggcagaaataaagatgttctttgaaaccaacgagaacaaagacacaacataccagaatctctgggacgcattcaaagcagtgtgtagagggaaatttatagcactaaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttatttgaaaggattaacaaaattgatagaccgctagcaaacctaataaagagaaaaagagagaagaatcaaatacacgcaataaaaaatgatacaggggatatcaccaccgattccacagaaatacaaactactatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaagtacacagaggaactggtaccattccttctgaaactattccaatcaatagaaaaagagggaatcctccctaactcattttatgaggccagcatcattctgataccaaaacctggcagagacacaacaaaaaaagagaattttagaccaatatccttgatgaacattgatgcaaaaatcctcaataaaatactggcaaaacgaatccagcagcacatcaaaaagcttattcaccatgatccagtgggcttcatccctgggatgcaaggctggttcaatagacgcaaatcaataaatgtaatccagcatataaacagagccaaggacaaaaaccacatgattatctcaatagatgcagaaaaagcctttgacaaaattcaacaacacttcatgctaaaaactctcaataaattaggtattgatgggacgtatttcaaaataataagagctatctatgacaaacccacagccaatatcatactgaatgggcaaaaactggaagcattccctttgaaaacgggcacaagacagggatgccctctcccaccactcctattcaacatagtgttggaagttctggccagggcaatcaggcaggagaaggaaataaaaggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccagcaacagacaaacagagagccaaatcatgagtgaactcccattcacaactgcttcaaagagaataaaatacctaggaatccaacttacaagggactagaaggacctcttcaaggagaactacaaaccactgctcaaggaaataaaagaggatataaacaaacggaagaacattccatgcgcatgggtaggaagaatcaatatgatgaaaatggtcatactgcccaaggtaatttatagattcaatgccatccccatcaagctaccaatgactttcttcacagaattggaaaaaactactttaaagttcatatggaaccaaaaaaagagaccgcatcaccaagtcaatcctaagccaaaagaacaatgctggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatacatatgtagaaagctgaaactggatcccttccttacaccttatacaaaaatcaattcaagatggattaaagacttaaaggttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacgtgaacagacacttctcaaaggaagacatttatgcagccaaaaaacacatgaaaaaatgctcatcatcactggccatcagataaatgcaaatcaaaaccacaatgagataccatctcacaccagttagaatggcaatcattaaaaaatcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgtggcattattcacaatagcaaagacttggaaccaacccaaatatccaacaatgatagactggattaagaaaatgtggcacatatacaccatggaacactatgcagccataaaaaaggatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaaaaaagaaagtacaaactagggaatggcaggaattgaggctatagatgctgtgaaggacagatgatgcaaggccatattaaggagtttggactttatcctaaaagcaatgtgaatttactagactttcaagcagaggactaacagacaaaaatgcattttagaaaggttagtctgaccagtgtgggaggtgaacaagacagagataagactaaaggcaaaaagaattattacagttatgctcacgtagcagtcatacaagagcaagatgatgggatgaacaataatgatgggatggagagacatggatttttttttttttttttttttttttggagacagtcttgctctgtcgccaggctcgagtgcagtggtgcaatatagcttgctgcaacctccgcctcccgggttcaagggattctcctgcctcaacctcccgagtagctaggactacaggcccctgccaccacgcccagctaatattttgtatttttagtagagatggggtttcaccatgttagccaggacagactcgatctcctgacctcatgacccgcccgcctcagcctcccaaagtgctgggattacaggcgtgagccagcgcgcccagccaggttttaaaaaaaattatgaattacttacatgctatatttttgccatcactttattgctaaaatttatcagttattttgctttagttgagtcccttgtaaacaccttatatttaaattttacttttgatataatttgagaatattcatcttttaattcaaatctaaattattcacatttatttttataaatatggcatttggtcaaactttatcatcatatttttctattagtatgttttcattttcctaattttacacttttttgctttttcttttttctaactttgcgctagtgattatctttccttcatattttacttgctagttactggttatctgtgattttttttgaaaaagggtgtcacccaggctagagtgcagtggtataatcatggctcactgcagattcaacctcacaggttcaagtgatcctctcacctcagcctcctgagtagctgggactacagacgcgcgccaccactcctaggtaattttaaaaatttttggctgggcacggtggctcacgcctgtaatcccagcacactgggaggccgaggcgggcagatcatgaggtcaggagatcaagaacatcctggctagcatggtgaaacctcgtctctactaaaaatacaaaaaaaaattagccggatgtggtggcgggcacctgtagtcccagctactcgggaggctgaggcaggagaatggcctgaacccgggaggcggagcttgcagtgagccgagatcgcgccactgcactccagcctgggtgacagagtgagactctgtctcaaaaaaacaaacaaacaaaaaaatttttagagatagggtctcactatgtcaccctgcctggtcttgaacttctgggttccagcgatcctcctgcctcagcctcctaaagtgctggggttacaggcgtaagacacctcacccagcctgtgattttaaacattgcatttgaatttgaatcactttccagaatacatcatgatttttacatacaccctataaaagaaacagtttatcacacgtttgcctcctcacttatctccctataaccccaagtcccaatgatctgaatattttagattcatatcacaattttttttaacaatgcatcttctcttttaaaaatcacagatgggctgggcacagtggctcacgcttgtaatcccagcagtttgggaggcctaggtgggtggattacctgaagtcaggagttcaagaccagcctggctaatgaggtgaaaccccatctctactaaaaatacaaaacttagccaggtgttgtgctgcgcacctgtagtccaagttactcaggaggctgaggcaggagaattgtttgaacctgggaggcagaggttgcagtgagccaagactgcaccactgcactccagcctgggtgacagaatgagactccatcccaacaacaatgacaaaaatcacttatgaacctatatgttatttcaaaatcacatgaacaggaattatttaaacaattatttcagaggagttattatttatcaccttttctttctaccacatctttcactttcttgagtcaatccttttttctaaatattttctttaattttgtttttgtctgacattcaatgagcctttctaacctgaagatacgaagttttcattagctcaggaaacatttattttatttatttgtatcattgattcccctaactgttctgttctttccttctaaaagaaaaaaaatttcaggaacatttactctagatttcaattttgctccaacatttattactgtcttgagaacctctatgacaatttaggtcaagggacaatttattcaaaaaagaacaaaccatctacaaattctcttatcatgtgagcctcactcccattccgcatccagtgtggtttcccacaaagatgtttggagaagagaatcaatggaggtggaaatctttggtccagcagttggatgagtcacaggaccttttggcccatctatttgtttcagaaggaacaagcataatatgtgtgtgcagatttcaacactacatggacaatagcacagctgttattgttgtgtattcttctgcaagaggccatgaacccaaaagccttgtggtgaggggttaagactaagattttatttcttctttgttagttgttctttgtttagtttcttctttgtgcttaaaaatatatgaagtcattacatgtgaaaaaaatagatgtacattattttaaggtcccattctgtaaaacgtggtacaaatatgcattaaatgagagacctcagtataatttaactatcagtgttcaagttcagttttttcaactctgtatctcctcattcttgatttaatatttggttcatttcttgccaaaataattatgtctttgaataactttcaatgaaatgtgcataaataattcattttcagaggccgtatttaagtgagactatatctattctcttatcacataaattgctggctcataaacatttcccacaaagttctttagacttcttgaaactatttgatttctgtcccttgtgaaattcaaaaacttcaccaatctgcctccatgtgggtctcttctcattattatttttgcctgaaatacagggaatattctcattctatagaatcacatttttttagtttatgaaattttctttaatctattatggcttctgattcacagtaaataaatgcttcctcagagatgcctattatctgtatgttggatcttcagactctgtactccttatttttcatcatctctctttcatcattttttgctcatattactttctgcattgtggaagagtctctcaactttgtgtatctagcactaattcaataatatgcaatacccatgtttcactttcacataattaaataagtttaattatgatctttttagattgcttttattattctttctctgttttagtcaaccagtcatttcaccatttcatttcatctaccatctccccactaagattttttttttttttttttttttttttttttgagacagagtcttgctctgttgcccaggctggagtgcagtggtgtgatcttggctcactgcaagttccacctcctgggttcacaccattctcctgccttggcctcccgagtagctaggactacaggcgcctgccaccacgcccagctaattattttgtatttttagtagagacggggtttcacagtattagccaggatggtctcgatctcctgacctcgtgatctgcccacctcggcctcccaaagtgctgggattacaggcttgagccaccacacccggccaagattttttatttttatctttcatgtattgtttcatttaacaatgttttggatttttataaataaaatgtatgttgtttctagtatgttttattttcttatcataaaatttagtatttatatttctgtgtcttcagtaattagccttacctagtccctgtaccaatgaaaaaatagaatgtgtccatccacctctatttctgcagcactgctctgtgagtcatgctgaatactattcttatttctgacttcctttgaaatcctcttgaacagaattgagcaagaggtgaggctaggaaggggtgcagtaataatgatggtagccaccatgcatttagagtgctctaggcagaagcagacaggaatgatagaattttatgtgactcatctcctcacagaaagtcaatgcagtgtgaagaaaataaagttaaatagagtaaatataaacacagtcaacagtgttaagcctttttaagcagaaaaaccctatttttaaaataaaaatgtcacatagatttccaataagaagaaaaggaaaaaagcacacttaacaataattcttccatgaacataaaagtcacacaagttgtatctgaaacttgcactccattcctgtgccctaccagggttaagtcaaagtatcatggagataagtatggaaataagggccctctccaatcagagctgtcctcagaaaaactgcataattattaatgctattattattatgcatatttattattaaacctaggaaatgaaaaacaaactgcacattcaactcagaaagcaagaagaacaaaatatataaaagtcaaagtaagaagttatgataagaagaagaaaactagttagaaaaacaggagtataataggatatacaactagttctaaaggctgggccttctattttaaaactcattaaacaggaaaatctccaaaaaatctaattaagaaaaatgcaaaaatttaaagacacaatattagaaataagaaaaaagctgtatagcagctactgaaactttaagaagtatataagaacacagtacttagcacttgcactgtgcataatcactattaaaaatagcagaagtgtgggagatgtggaagttttatttacaagatttccaaattcgttctttgagactaacatagccttgatgtcacagccagaaacacacacacacaaaaactataacccaatatcagttgtgaagataaagccaaaagttctaagtccaacacgtgccatttgaattcaatacattatgtattaaacagtccacaccatgaccaggtaaggtttatttcagagggtcagatatgaatagaaactatgtcaattaattaattctactaaggaagaaaaacgagaaaacatgttaattttagacttgaagcaataaaagcattctcaaaatgtaagaaaaaaagaaaggctgtgaccatgatcacagccatcaagcaacatgatctgggagaggctagctattgcctatgatgaaaaactaatattatcttatttttatgaatcataacaagtaatacaaggttattgttttaaaatattaaacaaataaatgatatagacttccacaactcactttctggagataaccactattgaaccactatacatgaaaatattcatgtattctcttccagggtatttttgttcctcaaacttttaattgcatcaataaatatgtggttatagaaactaaaatattttaacaatacattgagataaaaagtaaaaatccctcttactcctccctgctattacttacctcatggaaacaagagttcacaatttgatatgcatacttctgaaactcttctgcatttcatatataggatatgcaaatattatctttcttaaatatttgagatctatgatctataaatatgtatatatacatatacaaataacatatatatgcacacatattatatgtatatatatttctctgccttgcttttttcacttaaatttaaatctgaactctttatgcagctgaattagagaagcccagctggatttatgacctagcaggtcttttgacagtgcaaaggcttcccctgcaggtcttactatagagaacacagaatacattatctggttcgaagagagaataaataaatgactagtccagtctcttctgatctcaccaatcagataagtcatcactcttttcatgtcttcacatgtcattgtgagatgaagagaagtgtggaaaccattttcccctacttcttaaagggtgaatatttctgtttctagggccaaagcaggaaggtagggagaggaactaagataattccaaccacacgggacatagaatatagcacagaagtactacaatttatttaatcatttgcctattaacattttttgttacaaatattgccataataaacagtaggataatgaatgcttctggaataagactgctaaaagtagaattgctggatcacagagcatatacacttttatttttatatattgttttatattttaattctaaaaccaaaacatgaatatggctttaaaagttccaaaagtacagcagagtagaaaaattgaaaaccattatctccctttaaaatttctattggccaccataaaaactccaacatttattataccactattttcctgatttatcaatctaagatcttagttgctgcctcccagctataaaagataaaaaggcagtacatttaaactatgatccatcttctctcacaccaaagccaaaatccattctcaatatctctctctgaagtatataaaggatgtgatactaaaggttatgtaaatgcccaacagactgtctagaaacaaatgcatatcaaggcttatcattgtgaaacttctgacaaaggaggcagaaaatggattttgctagattccagagagaggaaaataaataccacaagctttattagcaatgagaatggctttaagactttcagtagcaatatgggaagctgaaagacaatggaacaataattcaaaatgcttttttaaaaagtgatttccaacttagaattttataaccatccaagggccagggtagaatgcagagctttttagatgaacaagatctgaaaatgtttacctcccacacaccctttctcaggaaacaacttgaaaatgtgcttcatcaaaataggagagtgaagcaataaagacattaaataccagagacactcccaagataaaggtaaagaagactccaagataatagctatgcatcaaataggtgtggaagcatgttaggaaacaccagtaaggaaacaccagggactctccaaaatgatgaaattcatagaatatctgatatgaagtaacatactgagagaatttttaaacaaccagaggagaagaatttggagattgaattagcagtatagtttcctacttaactatagaaaaaatagaaagttatttagttaagttggctcaggtaaaaaagagtcattatttactacatatctcggttctgaattacatacattgtcatgataatttaaaactaaatattgatctaatttatattaaagagtagcaatattaggagtgaaataacaagaaattagctgtgtagagtgggaaagagagaggaatgagaggtaaatactcatcttttataacaggaagtcaatggatagtgcttaaaccaaaaaaaaaaaaaaaaaagaaataataatgcaagcttgatttttaaagatataatgataaacaaattatccaactaaaaaataatttaaaatgctcaactgtggggtaggagaaaaaagggagaaaggagactgaatacactaatttttaacttttaaaattaaattaatattaaaatgtgcaattttgactttggtaaagacaaacattttgaaaattttaatataatgcataatgatcccattaatgataacaacaaatgcagcatcaaaagaaatattcaaaacttctgttaaaacaagcaagcaaacaaatgatatcactttacacacaaatgtaagtacctaaataaatagaaatgtgtttcacatgagaaaattcaatattacaaatataattatcatctatttcacttatatatttaaataatttctcattaaaattttacaacattttaacaaatgatgctgagataactgaatgtccatatgcaaaataatgaactgggacttctacctcacactatatataaacattaattcaaaatggatcaaagatctgaatgtaagagctaacactataaaatcttaaaagaaagcataggtgtaaatctttgtgatcttgcattagacaacaggtttttagctataatacctacagcacaaacaatcaaatatatacataggaatgcatcaaaactaaaaacttttgtggtttgaaggacactatcaagaaaatgaaaatacaacccaaagaaagggagaaaatatttacaaatcatatatctgatgagcttagtatctagaaaatataaagaaccattacaacagaagaataaagacaacacaatttaaaaatgggcaaaggatttgaatagacatttctctgaagaaagcatgcaaatgaccattggtcctttgaaaagcacatgaaaatatactaaacatcattaaatatcaaggaaacgcaaatcaaaaccacagtgaaaagagttccacttcctgcatgacagcatggtgagctccaaagtccaacccccgagcaaaacaagtgaaaattgtatttggaaacacaatgatttagtctctggaaatgcttctaagggtatacaacaagtttttttaaaaaatttattcaagaaaatctactaaaacttaataagaacagtaagattctgtggtattcaaaacaagacctgctccctccctcccctatcccagttcatcaagagacaaactctactccaaactgatgaggtcaagaactcagggctctctttcctcccagcttccagttggagagctaacctcctagaagaggggggatttcagcatttcttatcctatgcctagttctgaagctaagtttcaggtgagaggtcagttacagctgagaggtcagggctcccttgttccaccaagcccctacttgtgggatggaggatctaccttaggcatattattatcgtgaattatgaggccctgatcactcttgccctaacaaataagtcagtaaagaagaaattgaaggataaaaacatgcaagacatacaggatacaaaaactaaaatggcagacataaatccaactatgtcaataataacattaaatgtgaatgtattgaacaatccaatcaaaaggcaggaaatcacagactgcatttaaaaaaacacacacacaagatctaactctatgctatctacagggtatatactttaaatgtatatacaggatatatatgttttcaaagttcatccatgttgtagcttgtgtcagcacttcattccattgtatgcctgaataattgtctactatatagatatactacattttctttatatatctttaagttgaacatttggattgtttccatttttggctattatggatgatgctgctatgaatgtttatgtacaagtttttgtgtgaacatatatttttagttctttaaggtgggacttcagagctcaccatgctgtcatggaagtggaactcttttaattgtggttttggtttccatttccttaatgtttaatgatgtttagtatcttttcatgtgcttttcaaatgaccaatggtcatttgcatactttcttcagagaaatgactattcaaatcctttgccaatctttatattgcgttatttgcctttattattctgttataacagttctttatataataaatatattattccataatatagaaatatcagtgtatatacaggatatacactttaaattcaaaaattcaaatacgttaaaagtaaaaggatgtatcattcaaacagtaaccacaataaaattggaatggctacactaatatcagatgacacagactaaaacaaagcatgtgactacagggatattttataataaaagggtcattccacgatgaaaataaagcaattacaaatatatatgcatctaacagcaggacaccaaaatacatgaagaaaaaactgacagaatgaagggagaaatagacaattcaataataatagttgaaaatattaataccccacttttagtaatggatgaaacatctaggcagaagatcaacaaggaaatagaagacttgaacaacactatcaaccaaatagacctaatagaaatctatagaatattctacccaacaataacagagtatacattatcctcaagtggacataaaatattctccaggaaagaccataggtttaccaaaaaacaaacctcagtaaatttaaaaagatagaaattacaagatatgttctataaccacgatggaacactatgagaaaccaataacagaaaaaaaatttggaatttcacaaatatgtggtaaataacacacccataaataaccaaagggtaaaagaagaaatcaaagggaaattagaaaataattttaaataaattaaaattaaaatatagctgtcaaaatttatgaggtatagctaaagtagttactttagaaaagagtttgacgattcttcaaaaagttaaacatacagttaccatatgatccagcaggtccacccatagaactgtaccaaaaacaactaaaaaatacatgttcacacacacaaaaagtgtgcacattcatagcagcataattcataatagccaaaaatggaaacaacctaaatgttcaacctgtatatttaaaaatgtagtatatctatatatagtagacaattattcaggcataaaatggaatgaagtattgacacatgctacaacatggatgaaccctgaaaacattatgctaagtgaaagaaaacagagacaaaaagccaatatattatatgactacctatatatatgaaatgtccagaatagacaagtccatagaaacagaaaatacattagcaattgctattctggacatttcatatacatttaatcatataatatgtttctgtgaagatttgcaggtttacctttcaccaggatacaagccccagttaggggataaagttctgcttgctgggctgaagtagccattgacaacagggctgcttcagttacttaaaaagaatgataacagtacatccagcaagatacttttcttcattaacggacatgtatgatccatcagtaaactatgaaaattctgcatctggtatacgggtttcttgtaaatcagctctaggttttagtagctggtcagttaaatttagtcagttatgaggtgtctcgtcattgaataagagaaggcaatttgctggattatgattattgaaatgagaaagaataatatgagaagtcaacagcaagatctcataaaaagtgactctgcttgcagaaagatattgagtattatgagaattgattaaagcttctataacatgaggaacatagatttagttaaagccacagtgcctgatacagctcccatgcaggaagggagtcccttagctactgaatctaattgctggctgtaacatccaaggggtgtgtgtgttaatctccatgttttcagttaagaacccctaatgcactttcttctctttcattcactagaaaggaggaaggggagctgataaggggtgccctaaggcaggatgacttagaagtccttattttaattgaaaggagactctacaagcattctcttcccagtccggaggctccagcttgttaagtttcagaaggatatataatgatagagctattaagaaaaattagatacccagtttcaacagtactctgccaggcccaaaaacccttgtgactgtcttttagtctgaggttgaggaaagtttaaaatgctttcgtattagtccattctcacattgctacaaagaaatacctgagactgagtaatttacaaagaaaagaggcttaattgactcacagttctgtgggctgttcaggaagcatagcggcatctgcttgtcttctggagaggccccaggaaacttacagttatggctgaaggcaaagagggagcagacatgtcacttgggcagagcaggaggaagagggtgggggacaggaaggtgctacacacttttttaaacaaccatatcttatgaagactcactcactatcccgaggacagtatcaagaggatggtgctaaatcagtcatgaaaaatcccacccccgttatccaatcacctcccaccaggccctaccaccaacactggggattacaatttgacatgagacttggtgggaacacggatccaaaccatacaagcttttaagtctatcaggatccaagagaggtccctagtttagtatcaagtatctgaaatatttgacattccttggtaaattggaattttctctggaaactttatggcctttgtctgctagaattttaaggatataaacgctatcatgttcacaagcctctttacaaggaaaacaaaggttatcaacctactgagagttgacccttggggaaaataaatgtccgttaaatctgtcttcagtacctgtgaaaagtgagaggggccttcagtacatcctcgaggcatttctgtccaggtatgttgttgtcctttccacgtgcagcaaataaaaattgtctctcagtgtccaccagaaccagtgcctttaaaaagcactacaaatgtctatcactgtgaaaaatttactttctgtggagatgaaagtcaggaaggtacatagatttgtaacgacagtgtcgaataatgatatcgttatcaatggctcttagggcctgtgcaaatctccaccattgccaagaggtttctttacaggaaaaacaaaagtattacaggagctaggaaaaagcggtacaagcttctcaccgtgtgaaagaaaatgaagtaattaaggctaaggctttaaagtggagacaggagattgcaaggggattgcactcacacctgctaaaggattacagaatgttccagctgacttggataacaactgaattcagtgtctgcagcccttcaacatctctcagctgggagtatcctaattaaccaatcagaatgggtttgtattttaggatttctgcctagccaatgaactgcctcaaaaattaactttttgtggaagtcacctagaaataaaagtatagatcaatgaaacagaacagacccagacaacagaccaaagtatatctaggagctaaaaataagataaaagaagtatttcaagttattgcagaaaagatgttattcaaaagtggtgtaagactagactattcttttggtaaaaaaaaatactggatatctagcttataccacagccaaatgtaaatgtgtccgtgggaaaaattggaaaatgtgttttaatgaactttaggttggatagatttttctgcagatgacaccaagaacacgattcaaaatgaaaatggtgacatatttgatcccatacatgttttaaatatttgtatgagatattggaaagaaactgtaaggtaactaaaaaatacttgaaatctattcaattcaatctagtatttatattatataaaaagtactcacaaacaaaaaaatccaatttaaaatatatataaatattacatattatataatataaatatataaatataggatatatattttaatgggctgtatacatacataaattcatttaaaataaaatacatataggataaagggctcaactttattcatgatcaaaataatgcaaacaaaataatagcgatatattaatttttacctatcaggttagccaagatttaaaatgtaagcataaaccccccccccattgctagcaaggctaaggaggaaagggaaatttcatacatagtaggagtaaaatgtttctggagggaaacctggcaacatttagagaagttaaaaatataattttcttttataaaaagaattgcactcataagaatttattttaagaaataaatcatgtaagtgcaaggatattcatttgcgtattctgtataatagtggaaaaaattggaaaccacttacttgctcatccaaaggaggatgtgtaagtaaatccaggaccattcatatcatgagatactatctgtagttgcatagaaaaaatgcccatggtcgtctattaaattacaaataaaaggattcaaaacagtatatataagataatttaatttctataagtaaaaatatgtatgcataaaatttgcagggactataaacaaaaaaaggaaactgggaaagtgtacaactagatattatatctctaagctgatgggagtatggatattctccttgtttttattgcttgtctgtattttctagccttttaaagcatttatttctctgttaattttccaaaataaaaattttaaataggaaaaagaacaaagaaagaaacttttctttgctagatttaaaatgtatcctaacaataacaaagtaataactaaaacagtgtagtgcactggcccaggaaaataataagcacataaaggaaaagaaatatgatataaatatttataaacacatatagatgaatatatttttaaaatatgtggatatttcaataaattgtgcaataaatatagggtttttttggaaaagtcacaaagtaccagaaatgtaggtgaaatttataaacccttaagggtaggaaaattctttctaagcatggtatcaaaggcagaatcatgaaggtaaaacagatttaatgcacaatttaaaagttctgtggccagacacagtggctcactgtgcaattccagtactttgggaggccaaggcgggaggattgcttgagcccaagagtttgagaccagcttggcaatatagcaagacctatctctacaaaaagtaaataattggccagtcaaaagtcatagtggcacacacctgtagtcccagttactcatgaggctgtggtacgaagatcagttgagcccaggaggtcgaggctgcagtgagccctgattgcaacattgcactccagcctcggagacagagagagatcctgtctcagtaaataaacaaataaataaataaataacatgttctatgtacttaaagtatacccaaatcaaaaataaaatgaaagttttgaaaaatatttgttaagaaatgaaaaagacaaatgctcataatatatagttttcacagaataaaaatgtagctatgattatatctctattgcctagtgtttttcacatccacagtccacatcagaaaacagcaatcctgggttgattcttctgcctcaggtactataattttcaatatattgcatataaaacacaccctgtatcccggccccaactgagtggaacaagcaccagtgtgtgctctggttatcctttttctgacctggtaacaatcttttcttgcccttcgctgatcaactctgctctgtgccccagtgggctgcacacacgcatgcgcacacacacacacacaccacacacactgcaccacccaggctcttagatctctgcattctggttgggtctagccgattgaaagcaccagcgaaaggttggaagtgtgggaagagaggttaggggatgtagtctctggtttcctccctgctcccccttgcactgtggttctggcagtgtctagtgcctctaccattagtgctctaaccaggcaaccccctgccacacgtccgccactcaggtgacactaattccttatcaccatttcaagcctagggtcttaatggctttatttttagttaatgttgttactagtctctgagtgcctcaacatccctcatgattccccttaattctgcccataccttggtaaacagcctcttcattaaattctctccaaaatctccacgagttcaccttcatttcctatagtccctgcctgagaaagtggatgaacgcaatgctatcaaaaattggcaaggaactgcaacctcctctgagttggcttagtaagattgtatacctaatcagaatgatccccattaagatgacgcatctccctatttatatctcctttaggtgaactcagaggaagtgggtcactgagttccagctgtatctggatgaccctaaactcttgtaactctctatgatgccaatgcactggaagccctgggagtcatagggggcttgttgttataacccagatttcaacaggcttttctaactccttgagacctagaaaagtctctgaaattttagccaacatcagacttatgagactataaatattggaacaaaacaggtaaattatcattacttcctgatgatgctcatgaagcccaagaaaatcaactaaaaagaatactatgtataaataatttttccatagctgactagttccatatttgtcataaattattttttattcttgatttttccctcttcctaatgtcccattgtaatgggatctttggggtgtcactcttctggccagaaacctctgtggctggctggtgacacctttgcccaagttcttgtcctatgtccagaaagaatgaggtatgcaaacaagtggaagttgaacaagatgaagaggagctttattgagtgttatgacagctcagaggagacccacagagggtagctcctctctgtaggcaggtagtcctgtcaagtgttcagctctcagcagagaggagggcctggagaaggtagctcctctctgcaggcaggtagtcctgtcaagtgttcagctctcagcagagaggagggcctggagaaggtagctcctctctgcaactggtcatcctgatatctgcagctctcagcagaggaggccctggagagggtggctcctctctgctggcaggtcatcctgtgatctctacagctctcagcagagagggtagctcctctctgcagctggtcatctcattatctccaactctcagcagagacagtatctcctctctgcggctgatcatccagtcctctctccatcctctgctggctcttgctgagcccgtggcttttatggacctcagaggggaggaagtgtgtgttgattggtccatggcggccatgggtggcaggtcctggaaaaggcaccagaagcccccactccagtttgcgggactggcggcccagcccccagaattcaggccctccctggcctgaaggtggggccttactgggactgccctcttctgcccaggaacctgtttgcctcctgctgccattcatggtgccaaagctcacccagacttctctaagatctgagcaggtaccaacagcaggggagaagccaggcaggcagtgggagcaggcacttctgagtctacaagggcaggggtccttctcagcccccaagagttcagggatgcagggaaagggggagggtctggctcctgctcctgctcctgctgcacgaagtgggaggcccggatctgtagccactgatccggttgttgcagctgcacctgggagggtggggctcctgcctgttccatgaagcaggaggcccaggtctacagctgcagtgtgggtagctgcagggcaccctgggagctccaaccccaactcggaacaggcagggctcccgcttgtccaaggatcccgccagctccatggagcatgcagccctggcaatgcctccctgctgctgccatcaccatgacctatcagtcactaagtgagcaattctatgtgatatttcttgaaattctccatctgactccatttttattttgactgcccagactatccagggtcaacagcagtcaaggcctctttgccatggcagcaacccatgagtcagccaagatgagcagacaggctgcctgaagagcccaccgggacaggggcttctgagctccactcagaagtggagcaggtaaatgatcaaggtggcagcaggtaaatgatcaagtgaactgattcatgaacattaaaatgaagcagaaaacactagatgtgtgtgtgtgtgtgaatgcatgtgggtgagtgtgtgcttaactttagatcccaatagggacacgtgcttttcaaatgcttatgacacacacaaattggccatagattcagctgcaaagaagtttttaatagatttccaaagatagaagtcatatagagtacagtgtttatcgaaataaattaaaactgaaaatgataacagaaaatagaaaaaaaaattctaagcacttaaaaatgaatacctcttataaatatcttgagtttttaaatatattccttttatggcataactagaaatggatcactatcatcaaaggaatgcattgtatatcactatttgtccaaagtggtaaactgaagaaaacttgtagccttaacactatttaatttaaaattagggtgatttataaaatgaaatattcaatcaagggggctagaaaaataccactaatcataatgcaaaaagtggtggaaatgaattaatacatataaaagcatgaattaaataaattacagaaaaccagtatacttgatttaatgaggaaatatctacttctttgcaataaccaataattggcacatcctggataagtctaccaaagggagaaaagaaaaagaaagagatgtaagaaaagaaaggaaaaaaacataaaattaaaataaggaaaagatgtataaccacaaattaaaataatttgctaggttcagcttgatactataaccattttataacaaataatttgaaaaagctaaatgaaggaattgttttcccaactgttatagagtaatacttcccaatatttttcacaccatagaattcttggaaaatgataatgttgcatggcacagtagtgtgaaagaaaaattttacttgtgcctagaagcaatagccattaaaattctggccatctcagcacatctgttacccacttatggcaggctggttggaagttgtattgtaaaagtcctagtcaagacaatatgccaagattagggggagacaatgaggaagaaaatgctaaaatgaagaaacacaatcatcaaaattatgattttttgcagatactattatgtaattaaattgatagaagaaaaaatagggaaaacctcaacataaaatcataaacagaagagttaggagtggaactctaagttcagaatcagtggatacaagcaacaggaagaagcaatggagatagtcatcagaatgattaaataaggtattgccaatagttgaccaatcccttttcctctgcttatgctgagcacaagctcattccctgtgaaattaaagtagtgagtgtggcccctaggaacagagactcagggcaattttccaggtagggtgggcaaaccaagatgaatggattgcgccaacaatcaaaaaaaatttttttaattattgacatactcacatggcatgttctactcctccaaatgataaagggaagctcatcagaaaccacatacataggtaaatacagagaaattatcagtccaaaggtgagatggcaatcaaaaaccaccaggcatttgaggaaattttacgccttaaaagagagaaaccagacaggtgcaatggctcatgcctgtaatcacaacactctgggaggccaaggcaggagcatcacttgagcccacgagttccagaccagcctgggaaacatgatgagactctatctctacagcaaaaaaatttttaattagccaagcatggtggtatgagcctcggctactcaggaggctgaggcaggaggatctcttggcccagcaggttgaggctgcagtgaaccatgattgcaccactgcactctagcctgggtgacagagtgagaccctgtctcaaaaaaaaagaaagaaagagagaaacttaatttcattaacaagaaataatacctaataaaacagatcataaacaaaaaaagttaaaattacttcaattaatagaaacatacattactaagaagattatttaattatgtactttaaatacttgaaattgtgatgactgaaaaatatttgaaacttattagataaaagaatgggctgaaaaagggaatagacatgattgaagaagggactgatggactagaaaactaaactttgttttcaccacctaaaagcagaacagaaagaaaagatttggaaaataaaaaagtggacatgcagaagatatattcagaaactcaagccctatttatttaaatagagttccaaaaggagaaaatagaatgaggagagaaaacagtcaaagataactttaagaacatttcacacagcttaagaaacacaaaagtcttcagatttaaaagtcccattgagtgacaagcatggtgaatgttacagaggcacaaatccagattcctcccatggtaagtttcagagcaccaagaatggagtgtaatattacaaactttgggcgcgggaggagaacataatttgactctaaagaaataaaaagattaatcccatgcttttctttagcaacagtttgtgatagaatgcaataggctttcctcaaagttctaagaaaagtttattttgagcctaaactacatctagtcaaactagcattgagatgaagtacaaaacaaagcatttcaaacatgcaagatttcaggaagtttattgctctcaggctctctctgaaagaaaccccatctctactaaaaattcaagaaattagccgggcatggtggcaggtgcctgtagtcccagctactcgggaggctgaggcaggagaatcgctttaacctgggaggcagagcttgtagtgagccaagatcacgccattgcactccagccagggcaacagagtgagactccgtctcaaaaaaaaaaaagaaagaaagaaagaaaaagaaaaaagaaaagaaaagaaagaactattccaggatataatccagcaaaaaaaaaaaaaaaaaaagggggatttcaagtcaaagggaaatcacacacgcagacacaagtgaagtaaaactcaaggaaatcatataattaacctcaaacaattattgacgcaggctgcaaaaaaatgagtttggaaagaaatctcagcgtcaacaagagagattataatacaaggcaagagagtgggtttgggggagaaggaaataaaagtgtactgaagttttacctttttttttttttttttttttttttttttttgagactgagtctcactttgttgtccaggctggactgcagtagcgtaatctcagttcactgcaacccccgcctcccgagttcaagaaattctcatgcctcagcctccggagtagctgggactacagacgcgagccaccacacccagctaattttcgtatttttagtagagacggggtttcaccatgttgaccaggctggtttcgaactcctcatctcagatgacccgcccgccttggccttccaaagtgttgggattacaggcgtgagccaccaggcctgacctgaagttttaatcttgttgagggaaaaggatatagtgaatagatgtattgattaattatataaatcaatctaaaatatttaacatttaacattcttaaaattaaaattccttaattgtaattttaaaattctttgaaattgtgtttctattttaatttggttgtacttttttcttaattcttgagataatcactaaggatagatacttttacccctagaaatactgtttcactccataagagattatttcagaagttatcttcagcccccatggcaccctctcactccccttaaccaatccatcactaatggtcatgccagtttcatcccaatacctccccagtctatctgtctcttttgtaaccaccacagttcagcccatcatacctcttacctggacagcctcaatagtcagctaactggaatccccgtatcaatgtctgtttcccattgcctacactgcaacttctcaaagatcttttcaaaatgcaaatctgttcatgtctgctcttggcttaaaactttttgatgtcattagatgtatacgagagacttcaattataatcaagttcatattatttaaaagcattatccaattatagtattatatttaagttagtagtagttacatggaaatgtattacattatcctctgtcatctatatatgaaacatttctcacatgagaaaaacagccaaaaagttcaaaacaaacaaaaaatcaaaatcaaaatatagcaagagatttttcaattgcatccttaatgaagtattaaagttttctatatccaatccttgcacatgggccatgctgatcttctctgtatccaattttagtacatgtgctcccgaagtgagcactatatgtctaaacttaacacctcctcagttatgatattaatacttctcatacttctttgagttctttgtctgagatttctttttgctacagaggctttgttgtttctgcccatggctctctctgccacctactctctacaaactccctggttaattcctatttaaaattcagatttaaatgtaaatatcactttcttggagatgtatttcttaacctgtccagcctagatcaaggtagatagatcaatagatagatgatagatagatagatagatagatagatagatagatagatagtcttattggtttgctttacatattcctccaaacacttattggcttgtgatgatgcgctgatttatgtaattattttatgtatgtattttgccgtctactataagccccatatgggcaggaacaatgtctgttttggttccttattttcaagtctagcatggagtgaccccttggtaagtgtgagttgaatgaagaagaaaagggacatgctgtgcctgggatacggtcaaaacttagaacctggagttaaagggaaaggtagtctattgcctcttctgccacttagctttggacaatgcatttgagccttcccagctaggtttcttcatgagtaaaatgaaggtaatagtagtgcctctgctacagggctgttaagagcattaaatgagaaagcacaaagagctcagcagagtgcccagctcatagtagacactcaaatcattattcattatattttcatgcttctatatttttcttcttttgttacaaaattttcacactgaaatgttctccctctctgctcatgctcttcctactgtgatgtgttgatcttttgtgtcaaactgaaactgctttccatttcaggtcatctgcagagcatttgaatgataggaggaggagatgatggcgctgccatttatctgtcagatgtgtcactctctgtgaggggctggcctctcacagacctggggttccacgggctgcagggaacccacccgaggtagagacctctgggctgggccccttgttctttcctttcactctgtcgaatccttggcttttatttttcttcagggaaaacatgacggtgtttttcttgtagatttgttttgttttatttttacttcagattcatgtgcttatattggacaaatcttaaagcttccacatgttatccagggaaaaatgtattgctttttattgagttgagactgatcaagctatcaaaaattcacacttggctgaggctgtcttaagtttggtcaacttctctaggttcagcaagattttgtaactattactgaagtctgtggtggcaaaggggctccgtgaagggaaacatctggatttaaagtagactttaattacatctcacacccctgctctagaccaatgtttaaaaccccagggagaagcttaaaagtgtgactccgtttgaaactcaggagtcattttaacctaattgctcccttatagcttaaagctaacacctaagcctttaagaataaactcatagtccctgattcctgactgtatttgccctgagtaagtgctcccacaggatctgcacactatcgctaatttcagtaaatgttttcacggtcttggctgtagagttaatgcctaacaagttccagaggaaccaatttcctgctggaggaaacttccttaccaagtttcctaattattcccagtcattgccctgtagaatccaactggccaggggaggctgttaataggccacaggtgacagctacagttaggttaccaaggaaacagatcaaccatgcagagagcgatgtttgacacaaggagaccagggacccgtaaatacatgtatttcctgctgcctcttgtttcctgaggtggggggaatcaggacatacatccttcctctcaaagtcattgagaaattgactatagtgaattctcccagccaacattctgaaactttttggtctcaagactcctttatacttctaaaatttctagaaaaccccaaagagtttttgtttatgaagattatagcaattcatatttactatattcaatattaaaactaagacatttaaaaacatttatttaactcattcaaaaataataataactccgttacatgttgacagaaataacaattttgatcaaagatatttaaaaggatgttattgttttacatttttgcaaatctctttaatatctggcttagaacacagctgaattctgtttctgcattcaatctgttgtgatataatgcatcatgtagcttctggaagactactgtacattcttgggcaaatgagagataaaaggcaaataatatttttaaattactatgaaaataattttgatctcacagtactcataaaagtgtctcagggtctcccagaggccccaaaaccaactctcaggacaactattctaaacaaaaccgcactaaaagatggtcattgaatagctttatctgaatgaaacacaaagcaaagcaatagaccaagagacaagtttacaattatgaaagtgggagcatctgtgctctgctcttcatatttctgctactttcggccatcctgacctacaaggacttccagcctcttgtccagacatccttataatgacatctggccctaacaccaaaaatagatttactacaattttcttttgaaacagtgacttgaaattctataaactaccaagtatcagcagtccatagagttttttagcaaaggctacaatgttagcaaaaagcaggtaatatttggcaacaataatcacagagactgaacaaattttcattcgtaataaacgcctgattttccccacctttataaaggcctgtctgagaagccaaaagataggggaaacacgaactttctaaaaagaattgcccttatgtacttcccagaagtggttgtatcttatgcccaaattgcatacgctgatgggatggattctttggatgccaaaagagttgcacaaggacacgtgatgatctcaggcagtgtgtcagacctccaagaacatccagtattgatttgaacaactctgcccacaatctctgcttaagacctattattccaggcatacagtctacccaatctggccacctctgtaaggctgtttgagcctgagctacatattggagacaagatcttagtgcacagtcactaacgcaatgcctggggcacttaagcccaacatgggggtactttcagttcctgttcttttatcacatgagagacagtagaatacacctactagtcaaaagcacaaactctgaagtccaagaaatctgtgttctagtcctaccctgtcacaaaataattttgaatatttggacaaattatttagtatctttcagctcctttgtcaaatggtattgttgtgaagattaaatgagttcatacacgtaagggacttagtaaggtatagagtattcaataaatactggctatttttttaagggacggggtctccctatgttgcccaagctggtctggaactcctgggctcaagagatcctcctgcctcaacctccaaaagtgctgggatcataggcatgagccaccatgcctatagagataaatgttggtaaaccataagcaagtttaattccctggactttcagccgtgagagtatagcaattacacactgtagccattagatggcagtaagaatttagtctatcttttggcataaagcgccaactatttcctggagtttttattcatctagggcttggaggcttcaccctcaagcttcttcttagatccacttcctttgtccttgctaccctgtcccctggtctcttaatttgaactgcttggtctctggaagccctgtaacatcatgggtctctactcttccctctggtttgcacatactacatccatttgtgtctgtctcttcctcagatacaaaccacatcagcacagggcctgtgccacactgattcaatctctctcctctattggatttttttcatgggacttcaaacattctgcaatctctccagcttaagaagatcctccctggatcaggcagccctctctaggtattgctttctaactctgtccccacaattcagacctccgttttgagcctgacctatataccccagctatctatttgactgatttcatgcaggcatctgacaccttagtcattcaaaactggatttcacccccaaaagccctctcttccagcaatccatatctcaacaaatggaacccccatccactctctcctccaaccagaaaggtaggcttatccctgacacctttctcctaccctctccccacatataatccttaccaagtcctgtcaatttgatttcttaaatatgggtataaactttcacattgctgcctttccactgcagaggtgtcagggataagcccacctttcttgttggagcagagagtggatgggggttccatttgtcgaggtaaggaacactggaagggaaggcttagtccaagctaagctaaggtgaaagtcctactctcagctgggccacagcaattgccactgccttgtctattatcttctcagcagccagaatgatgttttaaaatacaaatttggccatgtgactactcagtgttaaacctttccctggccacctattgctagtaggtgaagttcaaagttcttattgtacctacaaggctttgcacagtctgccttcagcttatcgctccaccctactcctccctctccctctccagccctctcccgttcctgaagtggcatcaagctccttcatattcataccttcaaacactttattccttccagatgaactgctccctcctccacagctgggcctggctaactcccatcatcctttaagactccatttaagtgttactttctcagggaggccttctctgtcctcagcaccactcctctccctgccacccctccaggttagataagttcttcctattataatctcaaggtattttgtgttttttctttataacagttatcacaattataattatgtttcgttatgtatttatctaataatcctctctctcattagactatcttgcttatctttgtgttcccagcacctggcacagtgcctagtacataaaaatcattcaacaaacattgttggttaaagattaaatggctttttttcctcaaactggccattctcactctcacagtgtcttggcagaaactgctagaaagtaacagcccaacacacacacacacatacacacacacacacacacacgcacacagagaaagaaagagagacatgcaccaaatatagtctctatacaaataacactcatccttcactacttaattcaaatgtcacgtcaacaatgcaaccataagaaaaaactaaaagtagacattggctttgggatgggagaaaggacagaatcagcaagcatcttgaggatattgctgatgaaagtttgaagagcttcaaggagacggttgatatagaacttgcagacagtgaggaaaatgttatcagatgctggattaaagaacacccaaaagatgccttggccaaacagttaacaaaatcatcactgcagcaatgtagaaaataaaaaaatatatcaataaaatggcagatctgactaaggatattcccaggcagaatatcataagagctgatttcttttagctgcatataataaaatactagtagagaaaaataagctaaagaacaaactattcagttttttaacagaatatggagaaaatgtaaaggatccggaacttgctatattcaaaataaatatgtccgtcattcccagtctcttccagtgaatgattttgaaagaaagaaatggtttgggggcaaagatcaaattcagggagtggtttgtaagaccctttgttaaaaccttagaaaaacctttaacaaaaaagaactccatcctgcctgatcaacagaatactgtggaagtcacattgctccagtttcttggatcagaccttgagtgactggcagattccagaatactcaaacactcaccatggtatgtgtcatttttaaaaggaggggttgggagagtttgtgtgtaaattttctgttgatgatccccactaaagacttgctaggtcttctcaacagttcattactgtaatgaacaaccaagttatttgccttgagcctggtcaggagtctcctgaaatagcaaagttatgttaatgaaaacagtgaaatgataaagtcatcttaatgtagatggtaagttatatgggtttggtagtttgggtccctagagttttcattctatatgaattgatattgaaagagctgtcaaaataaaagttgcactgggcaaagttgaacaggaagagatactttattcaagactattgcaacaagggacagagattaaactcaactcagctgaaacaaaagcctggcgagagtttaacagctggagtagagggaatcataagacagtggtgttcactaattggctgaacccaaagcaaactttctctgcttataacaggaggtacttgtataacttggagcaaaatgtctactgaagttaggctcctaccctcccatggagactggaagataaggagctatttcttttgatgtttacatttaaaactagtaagaggcttctaagcagatttacatacatttcaaaggaggcagagaaaaaatttgcaattacaagttttctccagtgatttaagaaaagggaggtcagggacctagagtcaggaaaaaaaaaaaaaaaaacacctgtcttaattttacttaagctgaggggaatgttgaaggccatctcaatcaaagcattcctgttatttaaattgaaggaatttctctatttctgcactgtattatttgggctacattgtgctgttgtccttattgcacaagcttttggtgagttagtttgaataatgtgtctatatgtaatttgagttgggaaataggtggaaacagcccagtgaagaaatgtcaagtaatgccttcacttaattaattctgacctctttcagatgccccttttcccaagaagatataaaagtatagtaataggcattagggctgggcatggtggctcatacctataatactagcactttaggaagccaaggtgggaggactgcttgagcccaggagttcaagaccaacttgggcaacatagagagactctgtctctacaaaaaattaaaaaatcaactgggtgtggtgatgcatgcctgtagttccagctatgcaggaggaggattgcttgagcctgggaggtcaaggctgcagtgagctgggatggtgccactgcactccagcctgggcaacagggtcagactctgtctcaaaaaaaaaagaaaaagaaaatagatactgggagcatggccagttgtaactatgcaagggaaaggacacgcctgttagctgttagcagtgagcaaatcaagggacttcagaaacccaaaaggctccttatgtgaagaagttggctgcagaatttaaccccagccttcacatgtcacaggctaaattagtttgctatggctgtcatagcaaaatatcacagactggtggcttaaacagaaatttatttctcatagttctggatgctagaagcccaagattaaagtatcaatagattttgtttctcctgaggcctttttcattggctttgttgacctaaaggaagaaactgaggcaaagtaaatataagcagagagtttatttggggccaagtttgaggactgtaacccagaaaacacagattcaagttgccttgtatatgtgttctggctaacagcattcaaatgtggagttttttgttggtttgcttcttgtttgtttttgtggaaacgaggtctccctatgttacccagtctcatctcaaactcttggcctgaagggatcctcccactttggcctcccaaagtgctgggattacaggcatgagccaccatgcttgactatacatgggtttttaaaggaaagaagaaggggcagttcctaagttgtttactaaaaatttgtgttaaaatactataagctactaattgactatacattgttctttgcatcacaaattccagaaacatgaagataatgggtcggggtcacattgttcaacttgtggtggcattatcaatcactcctctggggttatttcattgatgagcatataaccctgccttaattttttttccctcaaggtagaatttattaataagttatggtacattcataaaatggaatactacaaagcaatgaaaattaaactacagctacctacatccatatggatgaatttcaaaaacaatgctaaactaaaaaacaagccaaggaagagcatatgcagaataaatgcctttatataaagattaaaaacaggcaaaactaagcactctattatttagggacatgttactaggtggtaaaaacaataaagaaaactaagggagttattaacataagttctggatagtaatttcttctggaaatgaatgattggcatgcaatccagcaagaatatatccagagattctggggtatgtaaagttcaaacacttggtccattagtaggtacatgaatattaattattgctccttaagttatacatacatgttttcatatacttttttgtatgtatgctatattttcaaaataaaaataaagacgtgacctacagagtgtaatcgtaggcacagggaagggtggggggctttgatagagatgttaggtcagtggcaatgaaaatcacaccaatgtataatctatggtcaagttattaatccacaaagtatggatttaattagttaaactcccaaatgacagtctttcccttcttaacaagttcttgggagccaccttgttaatcctccattctggttacatttcattaggataagcatttgagacatctttgctggctttttaccacatgagacattcaaacaaagtataggttttttattatattctttggaaataattatgacagacaataagtttcacataccattaataaattatgtggtcctgggccaggtgtggtggctcacgcctgtaatcccagcactttgggaggccgaggcaggtggatcatgaggtcaggagatcgagaccatcctggctaacacggtgaaaccctgtctctactgaaaatacaaaaaaattagctgggcatggtggtgggcacctgtagtcccaggtactggggaggctgaggcaggagaatggcatgaacccaggaggcagagcttgcagtgagccaagattgcaccactgcactccagcctgggcaacagagcgagactccatctcaaaaaaaaaaaaaaaaaaaaaaatgtggccctgaagaatttacttgagtgaccccatttcctcatctgcaattaatagcagtgtggcaaagacatttattgctattgatgataaccttgcctttaaatgattaattcctgacatgggtgtgaggggcatgactgaagactcactcatgtctgtctgggcctgataaactttgcatacatcccattcttcaaactgctatgagctacttttctcggctagcagatggccatcttctcactgtgtccttacgtggccgtccttcagtctgtgtaatgtctgcattctaatctcctcttcttatgaggataccagattttttggattaaggccagccctagtgaccttattttatcttaattaccactttaaaggtgctagctctaaatatagtcacattctgaaagtcaggacttcaacatatgaatgtcaggggacacagttcagcccataatgcagaacatgactaaaagtgagacttgactgtcactcatgtttgaaatgcttgttccctggtgccacaaagaaatagcacttgaacatacatttaattttctcagcaaggccatttttattctctacagaaagggtacattcaccagcagttttgccacaagagtacaccgaacaaaggagacagggttatttataacctgacgcatccaccctactgctgtgtctggtttccattggctggaatgggacctcactgtaacccacatggacctagggggactgaacaaagggggcaaatgtgggaataaaacacaagagatgaaagagtatatttggaagaaggggtcagagggcaccttgcctctagtggacaagggccctgagctttacacagccctccgtatttattaggcaatagagatagcaagaaggaggggagtggttgttggctggcattttattcacagcaggctggcaagactgcattcttagaacaataggagctagatctctcaatagataacttcaaggagcctggcaccatggagtgaggccctcagcaaacgttttggtagcagggcagtgtgagtttggccacatcctgcattcatgataaacagtttgccgtttgatcatatagcctccagcagaatactaagttggtcatgtcccacaggctttcggctccctgcatatcccactttttgtttatgtattaattgaaagaatgtaaggccagactgggtagctctcattctctgattggtggtccatccaattttacagaaaacatagcattagaacagtgttgtgactctggccggcattctgtctgtctttacactcaggctcagctgtctcatggttcgtaccagaaggaccgggctcatggttggccaccctgggttcctccagtctcccattccatggtcacacatgtcttgagggcacccacagggtttgtccatctgtaaaaacacaagtatatcctcttccccacgtcagtaaatccaccgaacctttacattgtccttcttccggggatttccataacacttttggataaactttcctcttttcctttaacatttgccaatgtctttctactggagtcttaccatccatactaggagtcaaaaaatttaaagtagaggccgggcgcggtggctcacgcctgtaatcccagcactttgggaggccaaggcgggcagatcacaaggtcaggagatcaagaccatcctggcaaacacggtgaaaccccatctctactaaaaatacaaaaatattagtcaggcgtggtggcgggcacctgtagtcccagctactcaggtggctgagacaggagaatggcatggacccagggggcagagcttgcagtgagcagagatcgtgccactgcactccagcctggatgacagagcaagaccccatctaaaaaaaaaaaaaaacttaaagtaactaaggctaaaggtagtttcgattgaggtggtagttggcctcctataccccctttttgttttttcaacatgcattgtaatgtttgatgggcccattctataatgacttgtcctctagcatcataaggaattcctgttttatgggttatagcccaaagctgtaagaaattttgaaaagcatgactagtataagcggttccattatcagtttttaattgtttaagtatccccatatgagcaaatgatgacaatgtcgccatacatgaccagctgtctcacctgcttggcatgtagcatgcagcatctatagtcacatgaacatagctaagcttaccaaaggtaactattgtgtaacatccatttgccaaacttcatttggagccaaacctcatgagttacagccttctacaggtgtggctccagggacatgctgacaagtaggacaggcttgtattatagccctagcttggctgcaagataaatggaacacgcaagtaagggtggaagtattttgatgcagaagcgcatgagatgcttgagcttgctgaaacacagaacaaatcaatttatatctactttatcattccctagggataatggtcctggaagttgtgtatgagaacaaatatcagaaatatgaaaaggatctgcatgagaacgagtaactcgctgaagtctttttttgttttgttttgttttgtttttcacattagatgttggtagaaatttttatttttttaacttttaggttcggtgaacatatgtaggtttgttatataaataaattgcatgtcacagaagtttggtgtacagattattttgccacccacataataagcatagaaactgataggtaatttttggatcctcatcctcttccctccctctatcctcaagcacgccccagtgtctgctgttcctttgtgtccatgtgtactcaatgtttggctcccacttatatgtgtgaacatgatgtcttaaaaataaattaaacagttctgggtctagtgtacttttaattgtagcagtttctatgtgactggttacatttacaacataagctgaatcacagacaatgttgataggatctgaagctgcgagctgtaaaacctgaatgactgcaattagctctgagccttgagctgaagccccagatgtcattattatttgagtatgtttacgtccatagatagcagcatgacctctggaagagccatcagtaaagtaagtctgtccacctgcaataggcttgtgatgagtaatcacagaaagaatgaaagaatggattttataaaactgtaaaattttgtctgaggggtagtgattatctatagcacccatgaaatctgcaaaagcaatttgccaggcagttgacatttcccaagctgtggcttgttgctgggagtctaaaggaacaataattttgtcagggtcatatcccataagcatttttgacctatgcctgcccatagtcacaatttgtgtaattaaagaaagataaacttgcaaggttttgactgtttgattaggtagaaagagccattctattactgttgcagacttgtctatgaactggcccaatagtcctgttggagagtggggggtaggaggaataaacaaaagcaaaggtttttgcagttgtagctgtgaggcatgtctctgctgtaacattttctctacaagccgtaattcggcttctgcctctttagttagttgccatggggaatttaaagtagaatctccttgcagggtttggtaaagatgtgtaagttgataggtagcaatacctaacattggctgtagccaattaatatctcctaataattgtagaaaatcatttaaagtctgtaacctgtctttacagagaactactttctgaggccgtacacttctctccataacaataattcctaagtattggtatggggaagttgtttgtacctttttcagagctattttgagattccatttagtcaaagcttgcttcgtttctctgaataactgctgtaggatttgatctataggaggggccaaaagaatatcatccataaaatgaatgatgtaagcagtaggaaacatattccgagactcctttaatgcctgtcctacaaaatgttgacatagcatgacttgggggtaaaactctccattgataacaagaaacaggttctctttggttaatagaaggcacagagaaggcgaatcaaggcttatccttctcatgtaagaatatagtaaagaaacaatccttaagatctattaatacaagaggccagactcttggaatagccactgaagatggtatacctttttgtaaggcatccatccattttatatgtgtattaatagctcttaaatcttgtagcagtcaccatcttctggacttttttagaataacaaacactggagaattccaggagctaactgactcctctatgtgtccagcatcccactgatcttttactggctgttgaagttgtgtcggcttctcctgagataggggccattgatccacccacatgggtttgtcactgagccattctaatggtaaggcagtgggcagaggagaaatatcaatgacctccatcagaaatcctgacgtcctagcccttagctatctgtttttccagttactgctattgggttaggatttccctgaagaaattttcctaaaggttttccctgctgatatcccatgttctttaacattttaagttctgggttatcaaaagtttcatttgtaagtctcatatcccatgctgtaagtctcaaccccataatttgatggctatacttgcaacatgaggctgaaaagtacatgactgtccatccacaccaagacaagataaaatttcagcatactgttgaacactttgagctgttcctactcccattagggacatagaagttaattgcaagggccaggatggggggccaattgtctttacatattactgaaacatcagctcccatatccataagcccataaaatgtctgtcctttaatttgtactacacaggtggctctattagaggctatgggttgggatagatagatttcccaagtagttgtgctcccaaaccctttatttcctcatttctcctttcatggagaagggtgtaatttgcagggaataagcaataattgagcaatatattctcctggttcaaaaacccaaagatcttgtgacattaaaactacttgaatttctccttcataatcagagccagtcactacagtaatgccttgcaagttaaggcagcttttggctaaaattagtctcatatatcctgctggtaaaggtccccaaatgccagtgggaactttcataggtttgtctccaccaactaaagtgattctttctctggcgggtagatctaatcctgcacttcctggtgttcctggggtgaggggatcaatgtgcctctgggaactgacctctgaaatggggttgaggtctggactgggaatgcccttattgtttgtggggcctgggtccaggcccccatctcgtttcccagcaggggggtgccattctgatgaaattttgagtggcactgattagcccagtgatttcctttcatacagtgaggacagaatcctggtgtttattctgctgggtggggcactgcattgtaaggtcctttctgtcctgagatctggcagcattcctttttaaaatgtccagtttttccacatttataatattttcccgttttggggtttgacccttggctccttttagatttgtcaactgataaattagctattgcttgtgctaacattgcagagtgatgaagctcagttcctacatcttgacaagctctgagaaaatttcccaagttttttgtacacctcaccagtgccagtgcacatttacaatccgtgtttgcatcctcaaaagctagtgttaaggttagcatttctgcagccgcagtatgagaaatctgacacttcactgcctcttgtaatcatgcaagaaattgcacatagggttcctgcaacccttgtatgatacataaaaaggattgtactgggactccttcaggaatagtggcccaggtgcatttagtggcctgtgcacactgctgataagcaacatctgggagtcccatttgaggttccaggtctgaataagggccattacctaatagcatatcctctgtaatgtctccatttccagcagcacagttctgtctagcctggtctgcacacatttcttgccaatttaaattccatgtcagatatgcagtagccgacaagcaaattcacgccaagtgtttcacatcaaatggtaaaagacgcatagcaccaaacacagattctagcaatcctaaggtgaatgggttctgtacgccattgtttaccacactcgcttttaattcctttaacaagttaaaatctagtggagtgtgttcatgaataacctgctgtgcattgttaggattaggccttatggaaataggaaaagcgtgaggtcctaagggctctccagctattgcagcagagcataaaattctttgtattggagtctctatttctgccaccaaaggaggcggtacaaatgtttctgcaactggaggaggcagtataggccaacttttatcctccctctcctgttttttattttcagttggagctgtgggtgggacaacagattcttttagatttttagattcagcctgctgtcccgcagaataatgagataatagcagaagtacagtacaaactaaactccaagtggagaaaacagaagaatcaacttcaagacctttttgatgagcctgttttaatccttctcctgctctatcccagttttccacatcaagagtgcctgcctgtggaaaccatgagttatgcataataactttgtgtggcttctgcaggaggttagtgtctgagaattaacctgagctccagactgtctcaacagaactttaagcaactgcacataatgtttttcttcaacagacaagttattccccctgctaccctgattcagaaagcttcccattcccagcacttctataaagcactgctcccagtacctctttagagcactgaccttatatatgctgccggcagactcatcctggggtccccgtttgccttgtcaatttcagcttctctgctccagcagatcttttttgttcacatcgtcgaagtcccgtgttcagacgccacttgttggcatccttggcgtccctgttctgagtcaccacttgttgagaacccaattgtgtcactgtttggggcaccactatgtaacctgcatggacctagggggactgaacaaagggggcaaacacgggaataaaagacaagaggcaaaagagtatatttggaagaaggggtcggagggcaccttgtctctagtggacaagggccctgagctttacactgccctccatatttattaggcaatagagatagtgagaaggtggggagtggttgttggccagcagcttgattcgcagcaggcttgcaagactgcattcttaggtgctagacttctcaatagataacttcaaggagcccagcgccagggagtgaggccctcaacaaaccttttggtggcagggcagtgtgagtttgcccacatcctgcattcatgataaacagtttgctgtttgatcctatagcctccagcgaaatgctgagttggtcacttcccaggggccttcagctccctgcacctcacattctgtatttgtcctgattagccagcaacttagaactttttaaaagaggcaaaggcagaggagaacaaaggaggaagtaacttgtggaatgctgagaaaggtaaaaacacctccaaataaggaagaggaacagactatgacttaatacttgcttggaccagtgtaagcatgccagggcaaatatttaggctaaattgtgggagctaagaacacaaagtacattgatttctttattatagctagcagatatctaagaatgttagcacaggtctttgaataaattttgtttctgagagaagttactatttattcctaattagacggggaggaaagtctctttgaagaggaacctctattttatttttacactcagaagcccgggcagctctgccgggagtgcagggaggcagctctcctgggggtgcaggtaggcagctctgctgggggtgcggggaggcagccaggcttttgttgcacttccatctactggcagcacacacagaaaggaaatactcccagtggctagattccacccatcatatcattggactgagtgaaaactttcagaactctaatttaaaaaatgaatgcattcatgaatattactaacctaacatccagctgaataataattaaatacatggggctagcctgacagagggtggaaatgctttctttaacttttctctttgaaacattgctgattattttatgttttgttttccagagtcaagaaaatgtctctttttagctaattatagcttacagcaactgggtaaccttttgtgagcaaaattaaaacatctgcatttctccctacctgatttctctaaaatttggaaactattcatgagtatttgtattttgtggcaatatagttatttgcataagatcaataagaatctgttttcttttgtaacagaacacattggatacaccggttattttaccaaggctttggctggaatgttacatttttgaatgtgaccaaactgctttgaggaattgaggctgactttataaagccaatagacatgggaaagactggcctcatgccttgcccacacggttctcttacaaggttcctcagcttgcggtaagtaaagactgtcattttctgatgcacccaggaaccacaagatattttgggtcattgagaagataggaattcactcaatttttacatatgttacaagcagtcccacagtgaatccctggcttggcttactagtctttagaggttttaaaagtgtaatctgagatttcttattaaaaattctgcaaagtcaatggaaaagagcctatatggccaatcattcttcttgttgcacattttgcaaataatcaggccaagtataatactaaaacttatttagccaataaatttgtcctactaacatttatatttggtaggaatggggaactggggagagaaaaaaattgttttagaaggaaactataccatccttcttataagattctagccctgaccattgttttttagttgttttttagtttttactatttgtctacaatttggactgaattctgaataatgtcccagctctaacaatcctccaaagaagaaattggatttaatttccttcatgatatttttagttgactccccagtagaataggttttgttgttgttgttctgatatacaaattctttttttgattataattcctatatgcattacatatatctcttgttttacttcttccacaaagactaaactcatgatattctgaagactaacaatgattcaacaagcaacagcaactacatacttgactgaggtgccatttttgccacctgtgatgccatctcaatttggcttttgacagtcttaaaattcctcattgtaacatttcctcacctctccttcccatgtgagacagcaccatcatgagccttctcaaactgaaggaggaaggatattgatcactctaacctaagcagaaattgatcattaatgtttccatggaaagatttttgatcaacaggtgggaaatgagaaaaaaaattgctcagagccatctaagttatgtgaagcatacaaaatttgtcaggcccagagagacatgagtatggttatgggacctcaatcacacctctcacacccatacccagggccaactgtttaaagacattttgttcctgactagctgctttgcccattatcttcatgttcctggagtttgtgatacaaagaacagtgtataaccaatcaatagcttatgttattttaatgtaaattcttggtaaacaacttgggaactgcctctttgtttcctttaaaacccacttgtaactgctgctcataggggtgtatattcaggttaacttgcatctacgctcttgcgttgcagtgttcaagcttagtccaaatgaactctctacttacattgtttgcctcgattttttttcttctttccgttgacatatcaatgcaagggaccggagcaaatattcctagactgaaacagattaaatgcaagaaagagaagaaaacttgaaaatatgcattatcattgtagagagactcaatgatttttaaaagagcatattctcaaaaaaaaagagatcaattttaaaacaatataggggaaatcttaaaatggttttaaaaataactctgtggagaaatggagtaacaaaatagataacactgaataccaaatgatgagttagaaattcacagaatgaatttgattgaaattcacgtaaaattaatgagaagtaaaaattatcatgaaaaagataggaaacatggagaattgatctgatagctccaatactcataggagtttagattaaaaagcagaagtggggtggaagctataccccaaaataaaaaagagcagaaataaaagcaaatctcatttttgctacactggaactagaaaacagtgaaataatgtttagagtttctttcttcttcttcttttttttttttgacaaagtctccctcttgtcccctaggctgtagtgcaatggtgcgatctcagctcactgcaacctctgtgtcctgggttcaagtgattctcctgccttggccccctgagtagctgggattacaggtgcctgccaccacacccagctaatttttttatttttagtagagacggtgtttcaccatgttggccaggctggtctagaactcctgaactcgggtgatccacccacctcggcctcccaaagtgctgggattacaggagtgagccaccgatcccagcctgtttagagtttcttaaagcataactattgaaacccaggaattgtatagccaaccaaacctgtggcatatagaaaaattattttaaaataaaagctttaggcaaaataaatttaatagaatttattttagcaaagaacaattcatgaatcaagtattgggggtcaggaagtgttgccccaaagactggcactttgatatgctgagtggcctagaagctgcctcagaatcaaggtccctccaaccttgtcttacccccagacacacacctgcattgcaggaaggggctgtctctgggattttcttatctgtcccggaaagcttctttccaaaaacaatgcaattgcctttcttctccttcctgaaatctcattacagatcacaaaaaaaggagacaggaatgcaacctcacctggaaggactttttcataagaaaataacaatctctcaggttcattcaaattccaaaaagaatcatttacaagttaagttctgtccatttgcttcccctaataatcatttgctacccctcaaaagaattgtctacattccccatctccctcccctcctatgaaaagggtatataagtttctgtgtcccattgggttattgggtaatcattctcctgcagttcccccaggctatacacgttaaaataacttttgcatgccttttctcctattgatctgccttgtgagttgattttcagcaaaccttcagagagggctactggttgcccatttttatggttatttcttgattatatgctaagcaagggatggattattcatgagttttctgggaaaggagtggacaattcctggaactacgggttcatcccctttttagaccaaatagtgtaatttcctgacattgccatgacgtttgtaaactttcatggcactagtgggagtgtctttcagcatgctaatgaattataattagcatataatgagctgtgaggatgcccagaagtcacactccttgccatcttggttttggtgagttttgaccagcttctttactgtaacctattttatctgccaggtctttatgacctgtatctcctgccaacctcttatctcatgctgtgactaagaatgccttaacctcctgggaatgcagctcagtaagttccatccttattttacccaacctctatacaagatggagtcactctggtttaaatgcctctgacaactccattttggtttgatctattagggcacaatgcaggagctcagtctaaatcaatagcctcctgtaaattttatttaacaaaggcaaatggaaaactgttttagacatgcaaggatgcagaatgtataacaattatacaacatttgaaaaaaataactgttggagaaactgaaaccaaataaaagttcttctgaaaaaaacagctgaagaaaagggaacatgtaggatacaaaagtgataagccatttttaaatcagaaaatcttatagttcaattttaaaataatttgtcatgtataacaacatataatgtaataataaatgaaaggctatgaaaagaggtataatagaaaaaataacaacagtattatactaaaatatctgattattttcacaaacctgggaatgatagctggggaaaacaagaaaatgcttgcttaaagccttaccaattaaaggaattacataaaggttctgctctccaacccagacaaaccacaaaatagcaaatgttgaaactcaacatctgttaagtgattatcatatgccaggcatagctctaagtactttacatttattattaaataactcctttaataagtctcaaatatttaaactatcctgtaggacagggctactgcaagtgtaattctggatcagcaaggactaagagcttgttagaaatgcaagtttttgggccccaccccagaccaactgaatccaaatctctggggaggtgtccatgaatctgttttaatcagctctccaggtgatgcttttgcaccctaaaatttgagaagcacacatctcctcagttaacgtgctaggatgaactggtatatttcaaatgcattaaaagtttaccaggaaataatgatcttcttagacttctgagagcccaggcaacacctgaagcaaccagagtcccagaacattgtcactgtcctctctgtgggcttctcagaaactggctgaaacagacgtgtgtctgatgggaccctctgttccccacagacagtgagcactgtaagtgatgtctggcatcaccactctgccggaagccactgagtgaaggctaggagatgctttaaacaatgtgctgctgccttggtggctaagaggttccaggtgcccagaggagtgcagcatacacgcaataatgtagctcattcagagaatcagagtgggcagttatcagttaggggcctcttgtgggcacagctctagaaggtggccccaaatctctgcctttacatagtcttatgctcatttccgtcttaactacctggtagcaactgttcttgctttgcatgtgcgtgctgcagaatagcacttccttatgatgaaagaaaaacttaagtacatttcaattttagagagtttatcggagcattcagagattcaagaattggggcagcaccagaccacaaggggctatcactccatcaagaaaggcaagaggggaaactttcatgcgcgtccgtgtgaagagaccaccaaacagggtttgtgtgagcaacatggctgtttatttcacctgggtgcaggcgggctgagtccgaaaagagagtcaacaaagggagataagggtggggccgttttataggatttgggtaggtaaaggaaaattacagtcaaagggggtttgttctctggcgggcaggagtgggggtcgaaaggtgctcagtgggggtgctttttgagccaggatgagccaggaaaaggactttcacaaagtaatgtcatcacttaaggcaaggactggccatttacccttcttttgtggtgggatgtcatcagttaaggtggggcagggcatattcacttcttttgtgattcttcagttacttcaggccatctgggcatatacgtgcaagtcacaggggatgcgatggcttggcttgggctcagaggcttgacattcctgccttcttatattaataagaaaaataaaatagtgttgaagtgctggggcggtgaaaattttttggggggtggtatggagagagagtgggcgatgtttctcagggctgcttcaagcgggattggggcggcgtgggaacctagagtgggagagattaagctgaagggaggtcttgtggtaaggggtgatattgcggggatgttagaagaaacatttgtcgtatagaatgattggtgatggcctggatacagttttgtatgaattgaaaaactaaatggaataacagaaggagaaaaacaggtataaaaggtctaagaattgggacgactcaggatagctgactagagagtgcctaaggagattcagcatagtcctgccagcaaagattatttatttacttcaagagttaagagtggcagtttggggatagcaccaggagatatcagctgtgatggcttggaaaaacagtgtaaaccggcagtgtaaacaagagcaggacatgtatgagtagttgagaatggtgaataggagtatgactagacagaagatagtagggatgacaagtttttttgggggcacagtctaagttggtctggtgtctggaatgagactggggcctaacaaaaaggagagtctatacaggagcttaaatgggctgtaccctgtagcattccgaggacaggcctgaattctgagaaggaaaagtggtaaaagtattgttcagtcctttttaagttggtggctgagcttggtgaggtgtgtttttaaaagacctttagtccattctacttttcttgaagatggaggactgtaagggatataaaggtttcactgaatactaagagcctgaaaaactgcttggctgatttgactaataaaggctcatctgttatcagactgtattgaggtgggaaggctaaactgaggaattatgtctgacagaagggaagaaatgactgcggtggccttctcagaccctgtaggaaaggcctttacttattcagtgaaagtgtctatttagactaagaggtattttagtttccagactcgggcatgttgagtaaagctaatttgccagtcctgggtgggggcaaatccttgaacttgatgtgtagggaagggagggggcctgaataatccctgaggagtagcagaatagcagatggaacactgagaagttatttccttgaggatagatttccatgatggaaaggaaatgagaggttctaagcggcaggctagtggcttgtactatagcataacctgcctttgctggtgtgcagcgattaggctcggtggaaccatcatcaataaatcaagcgtgatcagggtgaggaacaggaaagaaggaaatctggggaaatggggtgaatgtcaggtggatcagagagatacagtcatgggggtcaggtgtggtatcaggaataatgtgggaggctggattgaagtctgggccaggaacaacggtaattgtgggagactcaacaaagagtgagtacagctgaaggagccgggaagcagaaagtatatgcatcaggtatgaggaagaaaatagatttttgaagttatgagaactgtagagagtgagttgagcatagtttgtgattttgagggcctctaaaagtattaaagcagcggcagccgctgcacgcagacatgagggctaggctaaaacagtaaggtcaagttggacagaaaggctacagggtatggtcctggctcttgtgtaagaattctgaccgcactaaccatgcctacgaaggaaagaagttgttgttttgtagaaggagcttggatttgagagatcagtcggacacgattggcagggacagcacgtgtgtttttatgagaattatgccgagataggtaacagatgaggaagaaatttgggcttgattgaagcaatgggggctgtctgtgaagctttgctgcagtacagcctaggtaatttgctgagcttgatgagtgtcggggtcagtccaagtgaaagcgaagagaggctgggatgaagggtgaaaaggaatagtaaagaaagcatgtttgagatccagaacagaataatgggttgtagaggcaggtattgaggataggagagtatatgggtttggcaccacagggtggataggcaaaacaatttggttgataaggcgcagatcctgaactaacttctaaggcgtgtctggttttaggacaggtaaaatgggggaattgtaaggagagtttataggctttaaaaggccatgctgtagcaggcgagtgataacaggcttcaatctttttaaagcatgctgtgggatgggatattggtgttgagtggggtaagggtgattaggtttcaatgagatggtaaggggtgcatgatcggtcaccaaggagggagtagaggtatcttatacttgtgggttaaggtagggggatacaagaggaggacgcaaagaggctttggattgggaagaagggtggcaatgagatatagctgtagtccaggaatagtcagggaagcagataatttagttaaagtgtctcagcctaataagggaactgggcaggtggggataactaaaaaggagtgcttaaaagagtattgtctaagctggcaccagagttggggagttttaagaggtttagaagcctggccgtcaacactcacaacagttatggaggcaagggaaacaggcccttgaaaagaaggtaatgtggagtgggtagcctccgtactgattaagaaggggatgggcttatcttccactgtgagagttacctgaagctcagcgtccgtgatggtctgggggcttctgaggtgatcaggcagtgtcagtcttcagccgctaagccgagaagatctgggaaggagtcagtcagagagccttgggcgagagttccagggctctgggagtggctgccaggtgagttgaacagtccattttcagtggggtcccacacagatgggacgcagcttaggaggaatctcaggctgcgggcattccctggcccagtggccagatttctggcacgtgtagcaagctcctgtgggaggaggttctggaggaatgcctggccactgcggttcaggtgtttggaagttcttgtgtgctggagatgtggctggggtttgtctcacagtggaggcaaggagttgcaacttttttctgttattgtacaccttgaaggtgaggttaattaaatcctgttgtggggtttgagggccggaatttaatttttggagttttatttaatgtcgggagcagattgggtaataaaatgtgttttgagaataagacggccttttgaccttttagggtctagggctgtaaagtgtctcagggttgctgccaaacaagtcatgaactgggctggatttttatatttgatgaaaaagagcctaaacgctatctggtttgggataaagaaaaaggagcattaaccttgactgtgcctttagctctagccacctttttaagagtaaattgctgggcaggagggggagggctagtcatggaacgaaactgtaagccggaccaggtgtgagaaggggcaatgataaaaagattctagggtggaggagcagaggctgaggaagaatagggacctagctcggcctggcgaggagcagcctggggaggaagggagaggtcagatgggtctgtagaaaaggaagattagaaagactcagagacacttggggttggtactgaggggacaggcaggagggaaagaaggaagatttgggatgagttgcactgggcacagagactaggaaggccctgttgtgtaaaagaatgcctggatgtcaggcacctcagaccgtttgcctattttatgacaagaattatttagatcttgtaggatggaaaaattcaaagtgccattttctggctatttggaactactgtcgagtttgtattggggtcaggcggcattgcagaagaaaataaggcatttaggttttaggtcaggtgtgagttgaagaggttataagtttttgagaacacaggccaagggagtagaaggaggaatggagggtggaaggttgcccatagtgaaggaagcaagcctagagaaaagagagagtagagaaacggagggaaggggtttgggggttcttaccttccaaaaaagtgggaaaaggggttggggcacagagataagaggtcggagcatggaaataagggattggggtgcagaaatgagggattggggcacagagatatgaggttggggcacggaaataagggattggggcacagagatatgaggttggggtgtggaaataagggattggggcacagagataagaggttggggtgtggaaataagggattgagggttcttgccccatagaaaagtgggacttgccactaagggtgaaggagaaggggttgaggggtacttgcccctgccccagaaaagcgggacttgccgctaagggtgaaggaccaaggcaggcatccctgcgtggtctgacacccttgaaacgtgagtgtataatcagagaggcatccctgcaatcattaaacaccaagggaaggctgccttcccagtccgtgactggccccggagttttgggtccccggataaaatgtgtctcctttgtctctcccagaaaatgaaaggaattgaaattaagagaagggagagattgaagagtggaaaggagaaagtggttgagggacagtgagagaggttggagaagagagtaagaagaggccgcttacctgatttgaaattggtgagatgtttcttgggctggtcggtctgaggacctgaggtcctaggtggatctttctcatggagcaaagaacaggaggactggggattgatctcccaagggaggtcccccgatccgagtcacggcaccaaatttcatgtgcgtctgtgtgaagagaccaccaaacagggtttgtgtgagcaacatggctgtttatttcacctgggtgcaggcggctgagtccgaaaagagagtcaacaaagggagataagggtggggctgttttataggatttgggtaggtaaaggaaaattacagtcaaagggggtttgttctctggtgggcaggagtgggggtcgaaagttgctcagtgggggtgctttttgagccaggaaaaggactttcacaaggtaatgtcatcacttaaggcaaggaccggccatttacccttcttttgtggtggaatgtcatcagttaaggtggggcagggcatattcacttcttttgtgattcttcagttacttcaggccatctgtgcatatacgtgcaagtcacaggggatgcgatggcttggcttgggctcagaggcctgacagaaactttataaagtttttgcagaagcaagacaaagaaaataattttgatgggttagaaattagttggtggtttctgattggtgctgtttctagtttcgatttactgattacactggactctggttggttcacataggaatttagagtgccaaagccaccttggtctaatggcctcccaattagattcttttaacaattatcattttgaaatattcaacatgaaaaacattgaaatagttatgaaatccatgctcattatcacaataaattgtaacattacacttgtcaatgaaaaaaaaagaaactgttagatttttaagtttcataaaccaaaaataaaattctaaggcccccaacctactgatggactcccctctcggccactggcattccaaagtaaacctgaaaaactagttcagaccatgaccggaagaggtaggttagacatgtgtcattataacttcctccctttggaattcagatgcaattgaccagcactaccattaaaacagagatcttaacacagaaacagaccctttgtaacagtaagataccaaattcaaacctgattctagtatggtgattcatgacagatagtaggtcctgaaagaaattgaaattattttccccaaaatatatttctttgacatgttcttaaatggcatggccctgcaaagctgtctcttgtgtggaaaatccacattctgtagagaatcgtcttccctttccatgtcttttccctgatccaggagagaattaattaaaagtatggaacctttttaggtctgataagagctttgaagcctggtacctggggtctccatctgcataataaaaatcttggtgtccacaacttcttatcttaacccaaacactcctttctattgattccaggctttagataataactcttccaatcaattgctaatcagaaaatctttgaatctacctgtgacctgaaagctcccacttcaagttatcccatgtttctgcagagaaacactgtacacctccttatacatattgattgatgtttgcctgtaactttaatgtataaaatcaagccataaaccaactaccttgggcacatgttctcaggaccttctggggctgtgttataggtcatggtcatcacatttggctcacaataaatctctgcaaatattttacagtttgactcttttcgtcaacaatttttatcaactaccttgtcagaatggtttgttttgttttgtttcagagacagggtctctctcactctgtcacccaagctggagtacaggggcatgatcacagctcacccactaccttggcctcccaggctcaagtgatcctcctgcctcagcctcacaagtagctgggaccacaggcacatgccaccatgcctggctagttttttatttttatttttgtagaaacggggtctccctatgttgcccaggctggtctcatactccttggcttaagtgacccttccagcccagcctcccaaagtgctgggattacaggcatgagccaccatgcctggccatttttatattcatgacaactatcaaaactgtaaaggaaacatccctaagatgtcttgatcagaaattgcatgttgcagtttcaagcatagaaactgatattagaaaactttacttgcggaaacaacctcaaattccttctcctaatttctgaaaacactttattagaagtatacaaatttaatatttaatgtcttatctaatactttgttaatcttataattatggcatataaaataaaatacttttttcatcataaagatgtccccaaatgtcttcttgttttcttatctctgtgtgccataaattgaacagttttgaatattgtttatccttttgattgcactgaagtctggtgtttggaaaaatagttcttttacttacttctgtatttatgtaaaattttaaaataagcatgtattacttttgtgattaaaacttatcataaatatttaaagtaaattaaaataaatagtaaagtaatatagcataatataattagcaatattttctttaaaaataaataatatttctagctttcttttgattagtgaaaaatgaaaaaatgcaaatttaaaaaaagaaaaagtaaataatactagatcacaggtcacaaaacagacactctggaatgctatagtatagtaggtcaaacaatacaaccttccttattggcaatttgacaatatgcatcaaacatctaaacaatgttcaaaaccttcaacccaacaatcctttttccaaaatctagtctaaaggaattaattttaaacagttaaataatttcactggagaaaaaatttttttttaagattcttttttttttcttttttttctttattatactttaagttttagggtacatgtgcacattgtgcaggttagttacatatgtatatatgtgccatgttggtgcactgcacccactaactcgtcatctagcattatgtatatctcccaatgctatccttcccccctccccccaccccacaacagtccccagagtgtgatgttccccttcctgtgtccatgtgatctcattgttcaattcccacctatgagtgagaatatgcagtgtttggttttttgttcttgcgatagtttactgagagtgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcctttcggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttccatttctctgatggccagtgatgatgagcattttttcatgtgctttttggctgcataaatgtcttcttttgagaagtgtctgttcatgtccttcacccactttttgatggggttgtttgtttttttcttgtaaatttgtttgagttcattgtagattctggatattagctctttgtcagatgagtaggttgcaaaaattttctcccgttttgtaggttgcctattcactctgatggtagtttcttttgctgtgcagaagctctttagtttaattagaccccatttgtcaattttgtcttttgttgccattgcttttggtgttttagacatgaagtccttgcccatgcctatgtcctgaatggtattgcctaggttttcttctagggtttttatggttttaggcctaacatttaagtctttaatccatcttgaattgatttttgtataaggtgtaaggaagggatccagtttcagctttttacatatggctagccagttttcccagcaccatttattaaatagggaatcctttccccattgcttgtttttctcaggtttgtcaaagatcagatagttgtagatatgcggtgttatttccgagggctctgttctgatctatatctctgttttggtaccagtaccatgctgttttggttactgtagccttgtagtatagtttgaagtcaggtagcgtgatgcctccagctttgttcttttggcttaggattgacttggcaaagtgggctcttttttggttccatatgaactttaaggtagttttttccaattctgtgaagaaagtcattggtagcttgatggggatggcattgaatctataaattaccttgggcagtaaggccattttcacgatattgattcttcctacccatgagcatggaatgttcttccatttgtttgtatcctcttttatttccttgagcagtggtttgtagttctcattgaagaggtccttcacatcccttgtaagttggattcctaggtattttattctctttgaagcaattgtgaatgggagttcactcatgatttgcttctctgtttgtctgttgttggtgtataagaatgcttgtgatttttgtacattgatttttgtatcctgaaactttgctgaagttgcttatcagcttaaggagattttgggctgagacaatggggtttttcagatatacaatcatgtcgtctgcaaagagggacagtttgacttcctcctttcctaattgaataccctttatttccttctcctgcctaattgccctggctagaacttccaacactatgttgaataggaatggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggtggttgaattttgtcaaaggccttttctgcatctattgagataattatgtggtttttgtctttgggtctgtttatatgctggattacatttattgatttgtgtatattgaaccagccttgcatcccagggatgaagcccacttgatcatggtggataagctttttgatgtgctgctggattcattttgccagtattttattgaggatttttgcatcaatgttcatcaaggatattggtctaaaattctcttttttggttgtatctctgcctggctttggtatcagaatgatgctggcctcataaaatgagttagggagaattccccctttttctattgattggaatagttccagaaggaatggtaccagttcctccttgtacctctgggagaatttggctgtgaatccatctggtcctggactctttttgattggtaagctattgattattgccacaatttcagctcctgttattggtctattcagagattcaacttcttcctggtttagtcttgggagaatgtatgtgttgaggaatttatccatttcttctagattttctagtttttttgcatagaggtgtttgtagtattctctgatggtagtttgtatttctgtgggatcagtggtcatatcccctttatcattttttattgtgtctatttgattcttctctctttttttctttattagtcttgctagcggtctatcaattttgttgatcctttcaaaaaaccagctcttggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagatcctggtatgttgtgtctttgttctcgttggtttcaaagaacatctttatttctgccttcatttcgttatgtaccaactagtcattcaggagcaggttgttcagtttccatgtagttgagcggttttgagtgagattcttaattctgagttctagtttgattgcactgtggtctgagagatattttgttataatttctgttcttttacatttgctgaggagagttttacttccatgtatgtggtcaattttggaataggtgtggtgtggtgctgaaaaaaatgtatattctgttgatttggggtggagagttctgcagacatctattaggtccgcttggtgcagagctgagttcaattcctgtgtatccttgttgactttctgtctcgttgatctagaaaaattttttaaaattttttttgcagggaaaatgctgtgcatataattagcagtgctttttatgacttgataaaattcaaaacaccttaaacatccaaaaatagggaatgagcaaataaataattttccatgttctgatgaaaaactatgtttatgaaaattttgtggtaacataaacaatgtgtaagtcactaacttaaataaaatacacacttgaataatcttatgatccaagttatataaaaagcaagatttatcttcaagaaaaaaaaacacttggaactcaaattatgtgcagcttttcatggtagaaatttttttttctgcttattttctttgagaagcatgtattggaaaaaagtattaacttttatatttgaaacaagcttgcgtgatttgctttctgtttcaagtttacttggaacatcagccacctctaagcatctttggtgaagggggttataaaacctttaaatctgtccatattatgggttgctatttgcctggattttctggaagaaaactgtaactctatttcacttctaggatattatttttcttgtcaaactttattcatgactaccagtattacagctccataatttctttttcagatctaaacagaaaaaaatataatttaaaattttctaaccttaagcttaaatatattgtggagaaagatgccaaattatccactacatgtaagttttcttaaatttatttttttttttttttgtaacaataacagtctggattgggttatgctgtaacagaaaacctagcaaatactggattaaacaaagacaaggtttatttctctgaagtaacagtcagtaaacaaataggcaggagaggaatgataaggtcactacgcaatgccgtcacagacccaggggccctctagctttccacttggcctctgtagggcctggcttttctagtcatgctttaactctcattgcaagatagctgcactatctctagcctcatggcttgtttcaggtagaaggaaggaggaggttgaagagcaaaaagtccttattaactaagtcacatttttaaagagttttcatagacaccctactcaaggatgtccacctatatatcactagtcagaactgtgtcacaaaccacccttgttcaaaagagaaactgggaaattggttattaactggatacattactgcccttaagaaacttgttttttttttctacttaaagaacaaaaatggggttttctctattaaagaaaaaggagaatgggcataaactagaaaactagcagcagtagcagccacggtgactataactaaaaatcaccatgaagaatagtatgcagaaatgatatgattaggctattatgtgtgaagcatactaacaatttctattcatcagaataacataaaaattttaaactatgactaaatttactagcgattatttctatctcctcacataacatcacaaatgtataaattcccagcacatacttggattcacacacgcatatacacacacacatacaaatttagaattagagtgacctaatttcttattgtaatttcatgaacatcttgccaatccaggctttatttatcacaaaggcaatgaaagaggaaagcgtcaaatatagtaaccttccagcatctaatgaccagtacactgtaaatccttcaagagcagagactatttcattagatttagctctcttaagacatttttataaagaattttttttaagaaaaaaattggtttacagaatcaatgaacaaaatgaactaaagaatggctaaaaagactttctgtatttagcttcctttgtttgtttctttgctgatttgttcgttttacataagtcttacttaattggttcttttaaaagctatcagaaggaaatttcaggatatcaagagatgggatccaatcaaaggcttttgctgagggctgtttggtgcccaaatgaaaacagtattatacaacattcagatatcactgatagcgacaggaggcagccaaatgcctaggcagatggggtgggttcctggtgaaaccccacctctaaacaaaagacagtttaaagcctgaaagccaaactgcaagttaaactctgggaccggattgagaacttatcttcccatttcacatactttcctctgattgttccccgctcttcacctattttacatatacctaccctttcctaattggtttttctacactgtcatgcccacctttgagtggtgtcttcactttaacctttttgcatacctcacaaaccagcatgtacttcccattttgagtccctaaaaggtcctggacccagccaccatggtggggctttcctgccttccagtaggggaaccaccccccatatcccctctctgctgacagttgttctgtccttcagtaaaattcttctccaccatccttacccttcaatgcccagcatatcctcattcttcttgggtgtggtacaaaagcttgggaactgctgaatgcaggtacaagctataacagaggtgagctggggcatgccaggtgggctgttgccggtcaggggtccccagcttccaaagtgactgagaagaaaagtcctgcatcattacccacaaggttccagccttcttctcatgaaatttctctctttttttgaaattcaaatagatttgcaacttcacctttatttttggcagaaggagtagtgaagaaaagaagggttttccatccaatgaatgattgttttgtagaagtgttctaaccgctttattaccccacctccacccccagagcagaaatgaagggtgttgtcaactcctttgatatagatttaatgagaagaaccctttctatttattatagcaatattaaaataggaagcaagaatgaaatgttatatttcaatgttgcaatgtgtctaattattcatctttatatataactagaaagactattatgtgattattttatgttggaaagatgcacataaatattgatatgacccaaggataatagaaaataggcacaatgaggtaatcatatttatgtcccacaacaaaaaaacacaatcatacattgtttggcctgtatgaggtgcatttttgccttatgaaagaaatttgaccaagtttcaaaaaatatagtttataagtggaaaggacagccgtactttaaatgaccttcaaaaatgatcacatgatgttctctactcaaaacactggaggaatatatattctaaaataaccagaagatatctagttttgaattatagactctctgggtccctgagtagagacattgtgttcctctcaataaataactgttctttcctacttatgtatggaacagattttcactacagaagcagaaaatctcatctcgttattgtaggcttcttggcatacaacatagtagagggataggatgggtgctcaggtcagtctgaagttgttaaaatcatttaaaaaagtaactcagtaatatctatgaaaacttgcaaactcacatttgttttgacccttcaaacctactttgtgaaagctattctgtaaaaattaaagcaccagaatttatgaatatataaaaactggttgttttagtattatctattgtgacaaaaaaataaccatcagtagggctactactaaacaaattgttgaaattgtgttatattcaatattaaggaatattatgcactggtgaaaaaactaaaaacattaacatataaagatgctcctgatatacaatcaaacttggagaacacaataaattagtcatactcatgccaaaaaatgcaaacttaatgaatctaaatttattaaatttagattgaatacagtcatgcagtgactaaatcttacatggcttctcaacacagtcagattgtgtgtaaaaccactcgccttcgccataatttcatcaaagccctcttcatctcactatttcgcaaactgtagataagcagattcagcagtggtgtcagaagtgagtaagacaatgacatcactttcttggtttccggtgagtagccagatttgggttgtaaataagtcatactggctgtgccatagaatagggtcacagatgtgaggtgagcggcacaggtggaaaaggccttttgtctcccagtggttgatggcatcttcaggatggcaaacagaactcgaatgtaagacaagagtatcaacaagaaaggaaccaaaataatcaaaaaggtgcctgtgaatgcatagatttcaaacaaaaacgtgtctgcacatgcaagttctaacactgctggggtttcacaagatatatggttaatttcattaaggccacaaaagggaaaactagatacccatgatgtttgaacagtacctaacataaaacctaaggcccatgaaaatataattaatttcataaaaactcctttattcataatcatttggtagttgagaggatggcaaattgcagcaaatcggtcataagccattgctcccagaagaaaacattcagccccaccaaaaagaaggatgaaatacatctgtgcaaaacagcccccaaaagaaattgtagttttttcagtagagaggaccaccagcatttcaggcataataactgcactgaaactcaggtccaccacagataagttcaggagaaacaggtacatgggaacgtggaggctctggtctagggagacgatgactataataatggcatttcctatcagggtcaccagataaataaccaggaaagccacaaagagctgcccctggagctcaggatagttagaaaagcccaagaggatgaattcaaccacacagctttgattttgtctttccattttcagtaatgaagtcgtgcattgattttatggacatagtatatacagaataaagccacagtccattagctaagagttccagtctgcattcaccccagaaattctggcagaagatgaggagcctatcctgacagaaattttctttggcaattttagacaatgaccaaatacttggattatattccaaatataaaaaatagaaatgaagaattctggctcagagatcttgtcaaataatatcaaaatttatttgatattatttgaaaattaaacatagccttaatggaaatataaatactttataccttaggttccaatcccataacattggtgcaagtgttctttatttaactgaattttacataaatgcaaaacttaagactacaaaaaataaaatataaaaaagcagatagattgaaaaagatatctcaacaaatgtgataatagcctaataatccaatgttacagcatatttgatataaacttatttaaaatattaattagattcaaagtacctatatatgacttggagaaagaaaacaacattctgtagaaacatagaggggatttgaattttcaacacaaccatattaggtgacctatagactatgtgaattggcttcaagcttgcagatttctgcccatcctggatctggccaattatattgggatttacctggatgtgaagtttttggggccagatctccaaggtctatccttctgaccatgatgacttaagaaaaaaaccatttgggggatcattgtgtaatttaaaagatttcactctctctctccttttctctcttctctcttcccactatactcgtcatcaaaaaattcatttaatcattaattattcaacaagcactgattaaccagctaccattttctaggctctgcacccttaggaatacacatgaatccagagctcaacagagagctaagcacactacataaaatagcttctaaccccttaaccagtatgctgcataaactagtacctccccgtaccgcataccccaggactttctctttctttctctctctctttctatgtgtacatatatatatatatatatatatatatatatatacacacacatgcacacatatatatacacaactgagtgattcagttcattgattttataacattatatggcatagaatataatatatcctctatcctttttttaagaaatatgtgtaaaatatattttaaatatttatataaatataaacagattaatattttatatatattatatatatataagctctagtaaggtatgtgtatgtgtatgtatatatatatatatatatatatatataaaatccctcactagagcttagctcccagagggcaaagattttgtttgcttctttgctctacacacactgcctacactacaaccctccctggctcataataggttttaaaccaacatttttgaataaatgaattttaaaataagaaaaacctagactctatttttaaggaatagagtgcctaagagaagtcagcacacaacacaattggaaattaataacacgtgctgtagaaatttaagtaagggaatgatgacatttgaagggggtggaggatgaacaaacacaatcacaggatgtcatgaatggaaggccattaggtcggaggaggatggcaggaggaggaaaactgacttgctcaagtcaggaggcacttggtgacaccataaaactagaatggaagcctactgccttttgtgtgatgttttgaaaaccaaaagaaattcactgtgagagatgaggaagccaggaagacagatggacacagcaagttgaaggcatacagtgctgtcttgagtgcagacctgtaggacattagcagacaggagaagacaagttactttatttctgaatttgtccatagtcatgtattaaaatcaaatgactgtatttaaccacaaaaattgtactgtattttggatgtcaaaaaacctcctacaattattaaaaccagactctgtgaggccaaatatttaaaatgcatttctaatggcaaaaaaaagaacaacatgtattcagttccaactatgtaaaagtagattggttttaaaaattagaatatttacagaatgttatacaaaatagaaaatctttataccttagaagatcttcatggtgtcttggatagatcactgacaagtaatacttacgcagatcacttcctccccaaggcttcagcctgccaatggaaagaggtaagtgttgaacttactaaccaagttctcttctagttgcaaactccagaatatgatgatttatgcatgcaaagcacttacacttctacttattgcccgaacctttctctgaaaagaaaaagaaattgactggcatcaaaccaaaaagtctactgactcaatgtttcagctgagcctagtgactcctgagcactgagccatcacttcaacaacatctccaactatcaaagaggacaactataaacagaagtcccaccaaaacgcacaggagcagaatatgcacttttttacctgttgactctgtctctttaattttcatactactttatcagaagattcacctgtagtcaaaagccacctattcacaaacacaactgactgattcagagcattgattccataatgttatatggcatagaattatatgccctggagaattcctccctgaagaacgtgaaatcacttcatagagaccttcctgtatttttgtgtgataactaacgaggcttaaacttggcccctcgggtgagaaagctcaagagcacaaacatggagcagcactccttcttatgtctatggggaatgagcacctcttcccacaagagactcaattccaccgtgacacctcccagtaggaggtgagagcagaggctgaatgaacattgtcaatagggaaagaagggaggggtggagtgaaggtgtgagcaaaggcaggtgacctagggctagaggattcacatggacacaatgcacagtttgtgcaatggagggagacatggcaggtagattaaaggtgctttgtagaaagcctggatgctccctctgactcaagaactttttaacatggagtcaaaatatcctgactggcttgtataactttgagcacatcactcaactttctggttctattactttctctgtaaaataaagataatgatattaatctcataggatgtatataggaatgaggactcagggtttagtttaaactggcttgagcaataaaggaagccataggctctgtcccaggagacagagatgaatgaatctgcaggcttggctttatccagaaggcagatgatgtgctcacgccgaggctccacttctcttcttctcatctatggttttgtggggtaggttctattctcaagaaagccctcttgtccttgcagcagtaaggctgccaacaacacatagggatattctccctaatccgtctccagtgggaaatgtcccagtgatgctgaggaaagggggttctgaaagaagcagtccagggacgcctcccatattagtccccatggtgggattacatgcccattcatgaactagtccggtgccccaaagatgggaaaagctgtctaataggtacttttcataattcctaccccatgacatcccatgcaggcttctgttgtactaatatgctctataacctgatgtcagtgactgtatcacaggtgatgtacaaattgtgagaagtcatcaagatgtagagtcatgaattgtacactttacatacattggatttcaacaaagtgtataaaaaacatttcaggcacatatttaaaagggtaagtggggaataatagtaatgttaatctccaatttaaagccaatatgtcatggatataacaataatcaaaatgtggagatttttaacacactttctcaaagtttgagagagcaaacagacaacaaaaaatacaaaatggaaagatttgaataataaaatgttgatttaacaggtggtaatgagaataaataagatatagaacactttcatctcattaactctatatttttatcccaaaatatctatataatatttacaaaaattgaatatgtgttttgtcaaaaagaaaatctcaataaattccaaaatcctggcaatcatatatatacagcattccgtgtaataaaactgcaaaaaaagcccaaaatagaaaagaaaaactagtcttagaaacaaactaacaacataccttaaaaaactagatgtaaaaactcttatgctcattttataaaaattatatttatttatataagtgttttatgtacataggaagaatcacaaaaaaatagacatgaaataatttacattggctacttttaggaatgatggaattgggggatgagaatagaggtatttttgagagacacttttgtatttttattttataaatctactgcttgaatttaaaagaaataattttgtaataaataaaagcaaggtttttaaaaatagaaagtgaagttcagccatgaggtctttgcccatgcctgtgtcttgaatggtattgactaggttttcttctagagtttttatggttttagatattacgtttaagtctttaatccatcttgagttaatttttgtataaggtgtaaggaaggggtccagtttcagttttctgcatatggctagccagttttcccaacaccatttattaaatagggaatcctttcctcattgcttgtttttgtcagatttgtcaaaggtcagatgattatagatgtgtagcattatttctgaggcctctgttctgttccattgatctatatatctgttttggtaccagtaccatgctgttttggttactgtaggcttagagtatagtttgaagtcaggtagcatgatgcttccagctttgatctttttgcttaggattgtcttggctatgcaagctcttttttggttccatgtgaaatttaaagtagttttttctaattctgtgaagaaagtcagtggtagcttgatggggatagcatggaatctataaattactttgggcagcatggccattttcatgatattgattcttcctatccatgagcatgtaaatgtttttccatttgtttgtgtcctctcttatttccttgagcagtggtttgtagttctccttgaagaggtccttcacatcccttgtaagttggattcctaggtattttattctctttgaagcaattgtgaatgggagttcactcatgatttggctctctgtttgactattattggtgtataggaatgcttgtaatttttgtgtattgattttgtatcctgagactttgctgaagttgcttatcagcttaaggaaatttggggctgagacgatggggttttctaaatatataatcatgtcatctgcagagacaatttgacttcctgtcttcctatttgaatatccttctcttgcttgatttccctggccagaacttccaatactatgttgaataggagtggtgagagagggcatccttgtcttctgccagttttcaaaggaaatgcttccagcttttgcccattcagtatgatattggctgtgggtttgtcataaatagctcttattatttttagatacattccattaatacctagtttattgagagtttttagcatgaagtggtgttgaattttattgaaggacttttctgcatctattgagataatcatgtggtttttgtcattggttctgtttatgtgatggattgcgcttattgatttgcatgtgataaaccaactttgcatcccagggatgaagctgacttgattgtgttggataagctttttgatgtgctgctggattcagtttgccagtattttattgaggatttttgcatcgatgttcatcagggatattggcctgaaattgtctttttttgttgtgtctctgccaggttttggtatcaggatgacaccaaaagcaatggcaacaaaagccaaaattgacaaatggaatctaattaaactaaagagcttctgcacagcaaaagaaactatcatcagagtgaacaggcaacctacagaatgggagaaaattcctgcaatctatccatctgacaacgggctaatatccagaatctacaaggaacttaaacaaatttacaagaaaaaagcaaacaaccccatcaaaaaataggtgaagaatatgaacagacacttctcaaaagaagacatacatgcagccaacaaacatatgaaaaaaagcttatcatcactggtcattagagaaatgcaaatcaaaaccacaatgagataccatctcatgccagttagaatgcagatcattaaaaagtcaggaaacaacaggtgctggagaaataggaacgcttttacactgttggtgggagtgtaaattagttctaccattgtggaagacagtgtggcgaggatctagaatcaaaaatgccttttgacccagcaatcccattactgtgtatatacccaaaggattataaattattctactataaagacatatgcacacatatgtttattgcagcactattcacaatagcaaagtcttgaaacccaaatgcccatcaatgatagactggattaagcaaatgtggcacatatacaccacggaatactatgcagccatggaaaaggatgagttcatgtcctttgtagggacatggatgaagctggaaaccatcattctcagcaaactatctcagggacaaaaatacaaacaccacatgttctcacttataggtgggaattgaacaatgagaacacttggacacaggaaggggaacatcacacactggggcctgttgaggggtggtaggtggggggagggatagcattaggagatatacctaatgtaaatgacgagttaatgggtgcagcacaccaacatggcacatgtatacatatgtaacaaacctgcacattgtgcacatgtaccctagaacttaaagtataataattaaaaaaaagaaatttgatccccaatgttgaaggtggggcctagtgggagatgtttgggtcatggtggtggatctcttattaatagactgatttcctggggtgatgaggggagtgagtgagttcttagtttgttagttctgctagagatggttgcaaaaaatagcttgacaccttccctctttctctttttttcacttcctctcccactgtgtgatctctatactctgcctctccttccccttcagccataagtggaagcagcttgaggtcctcatcagatgtagatgctggcaccatgcttcttgtacagactgaagagccatgaactaaataaatctcccttctttgtaaattacccagtctcgggtatttctttgcagcaatgctaacagactaaaacattactacaattgcattgatcttcagatagataacaaaagatgagtcaattgacaaaccattgaaaattaaatgtgagaaccagagtgtcagtcactcacaaagaggtcctcatctcttgcaacaagcaggcagaaaaaatggagatcattttcagggttcagtagtcacagtggctgaacttcaatgatacctgcatgcttaatcaaggtagctatgttaagccaaatctggagccagagttggaaaaaatctaaggctttgacacatgggataagaattctaggtggatgcctccaaagatctggacttcaaagatatcactaaactttctaacactgcagaagtgaccaacccctccctattcagggcaggaagactatcgaagaggcgcacgatcagaaactgccttcccctcttttcctcaacaccaggcctataaatatggttaagtcacagcacagctcagccagggaaataaggaaagaatggaacaataccacaaaagaactgcaagatctaacagaccttcaccaacaaggggagaaccatggtacttgtcctgagggtgctggaccaggaggctggtaggcaaggctggataagtgaaagtttattgacctgatctggaaagaaaagaaagggagtttggcagcagggaggtctagggtagaggcatattgataggcatatggagtgggcataaagtgtgaaggtctttgtatcttgtgttaacacctggtcagtaggtaaaatgactcacccagttgacaaattagcctacttcttctgtcagcaaccaccccagtgctggcatgatgcccacaagaacaaagtggcctggcagcagagataaaggctatgcaaaagcccaagcaacgtggaactcatttaccaagaccaaccagatttactagttataatgtgtaactcctcaaaaaaattacaaatcagtgcatagaccatatacaaatatacccatacacatttagaattaatgtgatatgatttcatattgtaattccttaaacacaaattcagtcaactctatatgaattgaaataataccagtaaacaattcagatatttatgtcaaatttcatatgtaatagagaccacgtaaacaatcagtagggatttgtttaacaattataaacctaaaaccagtttaaatagacacacagatatatatatgtattgcctattcccaaataatatacacaaattataatgacaccccttcatttagcagaatatgtatatctaatcttaacatcacagtatcagttttattccaattatttttaagaacaattgagggaggtaacctgggaagataggtgaccggatatcttgtagctatctatttaggaacaaaaggaaaggcaatttttttgcctgagccagtttccaagcttaacttttcttttggcatagtgagtttggggttccaagattttactttcctgtcacagactacaaaaggaaacttcataaaagtttctaaatcagtggtctgtaaatgaaaaagatactgatattatcaaatgagaatttgagaaacttcccatgtagctctctggtcaccaacattggataaatatttggaaagataccaagagaaatccagtttgggattataatttgtgtaaggtcatgaagtagaaccatttttggccccccaaaatagatgcactttttttttactcatccgtggaacaaattttcaatccaaaaatagaaacatcatcaccttatttgttggtctcttgaagctctaccctgttaccaaagcacagtgagccttcaggccagtctgaagaactataatcattttgaaaagtaattctgcaatagctaataaaatttgtaaacacagatactcctcatcctatcagccgcactgtagcaaatctatcacacaggtataatgacatcagtacatatgagcatatggaacaaggcatttattgaagcactgtcttaatgacagtaatccaggccaggcgtggtggctcacacctgtaatcacagcgctttgggaggccgaggtgggcggatcatctaaggttgggagtttgagaccagcctgaccagcatggtgaaaccccgtctctactaaaaatacaaaaattagctgggtgtggtggcgcatgcctgtaatcccaactactcgggaggctgaggcaggagaattgctagaacccaggaggtggaggttgcagtgagcccagatcgtgccattgcactccagcctgggctggagcgaaactccatctcaaaaaaaaaaaaaaaaaaaatgacagtaatccagtagctacttggatgttcataatagagaaatggatgaataaactgttgtgtcatgttatgagaacatatgtatctactaaaaacaagtgacagcagttctttattgagatacgttttccaataaaaaaactcaacaaacttacatagtcatacaaaaaatgcagtctgttttcaccctttattaaatttaaatagagttcactcaggcagtggccaaatcttactcagcttctcaacacaatcagaatgtgtgtaaaatcacttttcttcgccatagttttatcaaagtcctcttcatctcactgtttcgtaagctatagatgagcggattgagcagaggggtaagcaacgtgtaagccaatgagatcagtttcttggtttcgggtgagtagccagatttgggttgtaaataagtcatattggctgtgccatagaacagggtcacagatgtgaggtgagaggcacaggtggaaaaggccttttgtctcccagtagttgatggcatcttcaggatggcaaacagaactcgaatgtaagacaagaggatcaacaagaaaggaaccataacaatcaaaatggtgcctgtgaaggcatagatttcaaataagaaggtgtctgcacacacaagctctagtaccgggggagtctcacagaagagatgattaatttcattggggccacaaaatggaaaactaaatacccaagtggtctgcacagtagccaccatgatccctgagatccatgagaatattactaatttcataaaaacccctctgttcataatcactgggtagttcagaggatggcaaattgcagcaaatcggtcataagccatcgctcccaggagaaaacattcagtcccaccaaaaagaaggatgaaatacatctgtgcaaaacagcccacaaaagaaatcatagttttctcagtagagagcaccaccagcatttcaggcgtaatgactgcactgaaactcacctccaccacagataggttcaggaggaacaggtacatgggaacgtggaggctctggtttaaggagatgatgactgtaatgatggcatttcccatcagggtcaccacataaataactaggaaaaccccaaagagctgcacctggagctcaggaaagttagaaaagcccaggaggatgaattcaaccacacagctttgattttgtcttttcatttcagtagttgaaacttatattgtttttatggacctggtatatcgagtatgaagtcgtaatcccatagctgtgagttcaagtctggaattcttgacagcagatgtaatgacaagctcattttgacagaacttcaggttggcacttttgaagaatggccaatgacttgtaatagtgaatctttaaaatacaaataaagaagtgaagtattttggttcagaaatcttgtttttaaagtacaaaataacagtaaatgttatctggcaacatctttgttttgtaggttgctctctctctcctctcttaatgccaagttcccctttaaaagcctctgctttctttccaaaaagtgaagcagtgtccttaaaggcaggagcctatacctcttcccttagttggattcttcaagcaaagagcaactgaacctgagttttggttacgcctggattgcgagctagtctggaacttggctgcagtcctaactctgccactgtctccaagatgggtctctgcctctgctgcacttgggttccccatctgtatgggttagaagcagcagaatgatcccttctggctctgacataggtgtttctctaatttgttgatagaaaactgcaggctgcaaggcctcaactccaatcagatgggagctgggctgaagggaacatggagtagtggtgggtgggcacataggcagcacacatgctgcctgagtcactttgggcctgccagtcccatgcggagatgaccattttcttcccaatccaactgcccctccagagccactctcagggcaaagcgacttcattctctctgctctcaaccagagcaacaatccttgtctcccagtattcccttcactgtcagggcccacaagtctttaaaatctggagtcctcctggcctcacgagtccatccccgctgacacgctccacctcactgcctcttttcctctcccttcacctcctctacctttaaacggaaacctaactggctattccatgttttatacccgttcctccaatctgtacctcaaatttctgacaaaataatatcaccctccctccgagaaacttcagagtctccccttatcagtaaaatacaatgcccacttctcaggctggcatttaaggggaactagagtgataacaattgctttaggaatgtaaatgagggaaacattacttctgaatggacagtgagggtgggaaaccataatcacaagatgacaagggtggaaggtccattaagcagaggagaaaaagcataaggaggaaggctgccttgctcagatagaaggtattcaatgacaccttagtactagcatggacctccaaactggactttgtgtgatgcttcaaaaaccagcagaattttactgtgggacaagaggaagccaggaggagaggacacagcaagctgaagacatcttgatttcatatcattaggacattagcagagaggaaaaggcaattgatttattgagtctgaccatagtgatattaaaaaccaaatatatgttttaactataacaaaattttttggatgtaaaaaatctcctaaaatagacttggcaggaaaaaaaaatgcctaagtatcattttaatagacaaaactacattttcagctccaggcctataaaaccaaatacgtttgtaaaatgagaaaatttagagtatcctactaaaaatgggcaacttttaaggagctgataaagcaaagttacaaaacaaatctaaattactgccttcatgagtaatttttttaagctgaacttaaatgctccatcttttccctttaacataaaacaacataatgctgatttagctaattcactgatatgttctactggctctggcattaactttctgtataatcttgggcaaataactccctcatcagggtttcatctttctaaccaattggacttatttctgaccgctttcaccccgctccctcaactacatacctctaagaattgatggtttgtgcaagcaaaccgtctatagatctaattactgtcgaacttttatgtgaatatgaagggcacagcaattgactttcttacctgagcattgagttatcacttgataagtatctccaattatcagtgaggataactacagaaggcaaacccaccaacaagtaccaaagcagaatcttcagatccttatctattcactgtccctgattttcatcccatttatgttttacctcttcaattaaaaagcacttcctaaatacaacttagtgattcaatgcattgattttaaattatactgcattaaattttatgccctgagagaaatcttctctggagaactgacacacaatttatacagactttcctgtatgggggcaaggaatctccgctgcacaaacttggaatacgactcttccaggtttccatagggaattaacacctcttcacatgagagacccaattccaccaagacctttcccattaagaaatgaaagcagagactgaatgaatgttaataaataggcacaaatgcagaagggagaaaagaatgtgagcgtgagtaaaggcagagtgatttggacagaggatctgattggacaagatagacagtttgtgcaatggtaggaaatgtgttatggcaagtaaattgaagttactttgtggaaagcctggagataccaaaacttatattttctagtagtaatatggaaatactaaattttgggggaaagtcttttagataattttatagtcgaaactttttaacttgaagtcaaaacatctgaactaatatgactttgagcatcatgtctcttctctggctctattacttttttgataaaatcaagataatgttattaacttcacaaagtatatgtaacaatcagaggactcagagttaagttcacactgatttgagcaatcaataagactattagctcagttccagcaaagtatagggatgaataaatctgtaggcttggctttatccagaactcagataatgtttccaggacctggatttctttttttctctatttctcatctctgctttcctagagtaggttctattctcaatgaatattttccctttagtgtcaataaggctgctaacaacacttagggatagatcctctctgtatccagtgggcaatgtaccagttatcctgaggataaagggtttttatttgtaaaaactaatccaagaacccctcctgtatcatttactatggtgggattacatgactatccacctataaaccagacactgtgactgtgaatgagatgagaaatgctacctaatatgcaaatttcatggcattctatcctataaccaggtacagcatcaattctaactatgcatacctgaaaatgtttaattttttaaaaatccccaaggtactgtttataggagaaggaggtcaaagaatgatggtgattcaacacacaaatgctctatacataaagcatggtatcctttaaattattatatgaatacaaggaagtgagatgaaagctgagaaacaataatgttgcattatttatttttgcaagatggactggacagaagtagaactaggatgtaatgaatggagaaaaatcatgtatactgtagaggataaatagtaatatatagtcctggatatgaatgtgttacataaagaagacaggatttcaaatgtttgtggaagagaggatgaataaatagaaacatggacagggaagtccataaataaatcacttcaagggctttgcacacctttggaactggttcctgagtccaagagtgaggggaaaagggatatacttaccctcgtaaaataagtcaaggagcaaatagtcacacactctattaatgaagaagtcttctcagaattgacaatcccttcgttgaacaagctgaaaacctgactgtaaaggcattgttatgagcctatacagatgtcccagtcccctgagtcatgcaaaaaaaaagaaaaatccattgaaacccttgaagtgggaaatgggaagtgtgatatacagaaattatcttctttcctgtgagtctgttacctaagatgcaaagcaacagagtaagtgccatcagcaggcaatgggaacagcaacaatttttggggggtgggggagggtgttacgatggtggtattgttggacctatcattgtatgtagggctcccttgagaatttcttgaaaggtcagtctagtggtgatgaattccctcagtttttgcttgtcgggaaaaactttatttctccttccattctgaaggatagcttttcttggtatagtattcttggccaccaattattttctttcagcactttgaaaatatgactgtctctttgcttatagaatttctgcagagaaacctgctgtaagtctaaagaggactcccttatatgtgacttgatgcttttctcttgatgtttttagaattctctttttatctttgacttttaacagtttgactataatgtgcctcaggaaggatcttttggggttaaatatgtttggggactttgagcttactggatctgggtcttcatatctctcccaagactctgaaagtttttaactattattttgtttgataggttttctatgccttttcccatctcttccagaactctcatgatacaaatatctgtttgcttaatggtgtcccataagtcctataggcctttttcattctattttacttattttatttttattttcactcactggctaatttcaaacaactgatcttcaagttcagatattcattcttctgcttgatctggtctggctattgaagctctctgttgtattttttatttcattcattgaattcttcagctgcaggatttctgtttggtttctttttatgatatctgtcactgtgttaaatttctcattcatatcatgaattgttttcttgattttgttgaatcttctatacgtattctcttgtattttactgagtttccttaggatcgttattttgaattccttttctggcaactcatagatcttttttcctgtgagatctgttattaaagagttattgtgttcctttggtggtgtcgtatttctttatttttcatgtcttttgtgtctctgcatttatgtctctgcatctggtggaaaaattgcatcttccaaactttatagaggggctttcatagaaaaggaatttcacctgcagttgtgtctttgtgtggctattgagaaaggtgtagtgactctggttctgagtagatgtagtagtatagtctctgtgcaatttcttcaactgcaatcaacatcagcaataactgtgggtgcctcagtgttgtggcctgtagaagcttgtggcagtggcaatggtggcatgggttgttaaggtgctcagtaacaagggctttggaggtcctccttttctcatttttcccataatggggagaggtagctgaggtgtctcctcttggtgtcagatctgacatggcctacacgcagctgcagcagtgctaggttccaggtgcatgtgctcagagcatctgtggagctggagtactaagctcagggtctcaggaacctattgtgtgaccagcttgggtcttaatgtgcaggttcaccctctgtagtggggttggatatagactgccaacagtatctgtgactctgaggcatcccctagcagctgaggcctagaaagtcaggttgtatctatgactctgaccctggagattaggacataacactggcttagctctggggaagaaggggtgcttcagaggtttgggcccaggcagcatggtacagctgcaatttgggaaccagaaccaataaagttcagtggcaactcaggtcccaggggatgagaaatcatgctgtggtaactctagaccttgggaaggtgggagtatcccagactctgtgaggcaggtgtagtgacagtgcagactccagaatggtggatcacagctgttgtttgggccctgggggacagggagcagcacagtgatgactctacttcctgggaatgaggggtgtctcagcagctcatgccctagggggctagtccagctccaggagagtagggtacttgagttgtttggcctccagagcatggtgtctaagctcaggcactgctctgtttccctgggatgcagggtactaatatagctaagccttgatatgtacagctactcagcctaggcaccaattccccaggggcaatgtgtcacttcagctaaggactgggggcatgaccactctgggtggcccaggcaccatttccccaggatgcagggcatgcttctgcttaggctccagggaggcatgactgctctgagcagccaaggtactgtttttccaggaagcaggatactggttcagctcacacacagaggggcagaacacagcagcaactgggaagggtatatggaacgacttcaccaaagcactgtttccctgggaggtagtacatagcttcagctcaagtcctgtggagcagagcgtgacagcagctggagaggtttttggagcagctctgtagaggcaacatttcctcaggagtggatgagcagctttaactcaggctcctagggggaaggtgcagcaacaactggaaagggtagatgggcaggtctgccaaagcactgtttctgtgggagggagtatgcagcttcagctccagcctgaaggggtgaggtacagcagcaaatgggaagggtaggtacagctgctcactggttacagatgttgggccactgggtaggggtagtttggagcctcaggggtgaatgggtgctgtggtcactcacccccaaagcaaaacacactccagcagtattcccaggttcaagacagcattgtaatgcatagctgcatgggccacagtcaggggctgagacaggggctgggacacagggcacagtgtcaactccactggtgacagaggggagcacaggtatagctatggactccaggcagctctcttagctgggcttagtgcctgtgaggactacaagagtccataacactgaggactataggtgtccgaggtgttgatggggcctgctgaggtgaccttgcttgccttttccctgcaaggagaagtccttactggttccaagctgatcccagctggcaaatggggtgatggggcccaggtgcttccttccattctctgtgtggctgtcctgagtttctctgcccacccagggtttctgtggctcccttgataaactttggtgctctcctttagttatttttatcaaaatgtagtggtttatagtggtttatttgttgttttggctatctttgtgggggatgggtaggacgagcactatggacttttagagggctatcttgctgtcatcaaaatccaaatatatataatttttttaaaaatagcaattgatgaagaagcactctaccaggaagaggcatacccagtgctcttgcctctcaggattccctttggacactgtaatatgatgtatactttggagagcaggatggtaagggtcagacaggagtggtatgatacataaacagttaacattttagacatgaaagtctcaacagttatacatgtcctttaaatatttgctgtcccccagggtaaagaaagaagcttatactttacattctctgaaagaggacctcttttcttttgcatagaaatataaatatatctatcactgccaagaaaaatgtaaatttctgttataaaatcctccaggaacatcacaattgacagtctctaaggtagcatccctaaaaccatagggaccctaaggggcctctccccagagaaccaatccccagtaatctctaagtatcagcctggtcttgcaaaacttcatgcctagggcagagtttctttcattctttcctcagatttgcctttcaggaacttgactgtggaagcagcagggagaatggatttgaggaggctgctaaagttaaccaggtgaacagtgggtaagcttcggaaaaattaagtggtataggcaattggattggtgattgatggaaatctgggagatgagaacaaggcaagagtgacaactaagttttggcataagcaactgagcaaaacttaaaagacaaaatagaggattggatgatgagttcaatctgaaacacgtgagtttggggtcaaccaagtagaaaagtccagtaggcagcaggatatactactctcacaatttttattcatcaattataccacaataaagctggaagataacaaaaagaaaggaagggaatagattgagtaggtataaagggataagatctgggcttctgtcttaaacagaagtgcaaagatctcatctgtggtgacaggagagaaggcagagtaaaggggtacattttgatggttctaagcttggttcacctttgtattcagaccagtctgggaatcactgacagctgctagagctgataaattcagaaacaatttatttgaaggacagaggagactttgggggagaaagtagtcctgaaaaagaaaacagaaggctaaagctttgaaaattgagaatagtgaggaggcagaagatgtgggaagatgggaatagggccagggcagtaagactgagattctgagcacagtctgtgtcctcatcttaaggaggcttaatggcagagtcttaagagaggggactgccttcaaacagcaggaaaatcaatttgtaaaggagaggtcatctctctaacatccctggggacatagagtttctaagaaagcctcagtttggtgacctatgggataagctgtccagatctaccttcaagaatgaagaatcttcaggaatgaagattttgcgagtgccagaaaggcctgagctgtcagcccctaaaaggactgcttcacctggggcatctgtacctactaactgatcaatgtcagagaataagggcttggcccccactgtgacggtcaggacatctctgaagggtcatccccgccttcagtccattgaagccttcaggaagtctgcctcaaaactcaacttctttcttcgctaaatcctgcccttctttccttcccttccacagatgttgatcccattgcacactaatctctatcgcagcatttcctgcagaacctaatctactatttaaactatttaaacaatagtttaaaaatatgaatgtttggatcctgacaacaccagcaggcactgaagaccctgcatgggggttgtgggactctgcacctttgctttaaacataaccactgaaaccccagaagcacctctctcaccaaagatagtatcttgaagcacagctgaagttcctgtgcctcagttaccttgtctacaaaagcagaggaattacattaacactctttaggctcatacccacttctaggatgctattctatttcatttttctgttcattatggtaataacaaaagaaagagaacaagggagataaaataacatgaagaagaaagggcttaatgcattacaaaaaccaaagagcaaagagtgaaggagagagtggcagagatgattaggagaggtgtgcatgcaagcctggtaggttcattaggattttttccccaattataatgggtttttaaatattttccacagataaaactgtcagagttttgtttcaaaattactacttttttattgtgctaggtgttaaaatgaatagatttggaatgaaataaatgtctcataattatccctactcctatggaaatgataatgtcatcttcaaaatgagggaagattgacttcgagctgtttcaacaaaaagtgggtctaatgagcaaaggtgtgattagagccaatctggtcaagaacactatccacctgcccatgcaatctggcaaagtcataaattcattccattgggactggctaaaagactgaatggatcaatacacctgttaaatcattccatagtcaaacatatgttgacagctcaaacttatttttatcagcctggtcttagatacatgtaaaagtagatacatgtaaaagtttggattcagtggccatttagaccctgtgattacaacagactgtgagtccctcaagggcaggggtttttcagttttgaagctcctgtgactatcagtgttgctggaaggtaattagatagtagatttattaattgaacagagatataaatgaacaacgaaaagcataattaattgatttgaattaatttgagtctatgtgacttagcttcatgtgaaaacggatctccagtgagcatccagtgtatagacaacaaaaagatgtcccataaaattttttttaacatattctcaggttacacgaagcaaattgaattattcccttaaatggctaagtgtattcccatttggagtttagaatctgatggttcccagttggaccctcccaagtttgaaccaactttcccaagtcattcacagataagtttttagctacagaaatgaaaatcctgtctctatttagtggtatctgggtgctttcccaagatggtggcattgagtatatcttcaggcttatctaaagtagaaacttttcagaaagcaatgtagcaatactatatctgttaaaattaaaagtacatttactccttgatccagctctcccccttgggatatatatgcatacagctgtttattgcatcatagtttgttttggcaaaaaaattgaaactgatagccaacaaatactgtgttattgtataaatagtgcgatacccaatattatgcagtgacttaaaaggatgaattagaccaaatgaactaacctggagaaatatctttgatctatggtattgccaaaatacacagtccttctatctttacaaattcaaattgtgtgcaatggcctacaaccaaataacaccacagtgtgtgtaaaaccactttcttctccagtttcctaagtaccctttagatctcaagctgtagttcaacagattagcagagagatgagcagaaagcaggccagagatttaagtttcttatttcctaaggagcagccagatttcacttgtaataaatgatattggttgtacccataaaagacaaatatatgacaagaattttagcaagaaaaaaatcataagatttaggatgatgttcataaatgcagatttcatgtatataagctctagcattggtgagatttcacaatagggaccattaatttcattacagccacaatagcaaaaattaagtttgtatccccaaaatgcaacacagaaagacaaagaaattattagaaaaaaatgcaagacttaaaggctagaagactcaacaactacatgcaatttttaccaagaaattctaactcattggagcatgaggtgtttttgtttcttccaataactattaccaattagatcacgaaaaaaatcctttttccattgcatagcatttctcttgatgacattttgggcagacttatgtatgttttcagctagttagttgttaaactagtttcattctactattaagagtttaatctctttaaaaatccaaacttggctgggcgaggtggctcacacctgtaatcccagcactttgggaggtggaggcgggcggatcacgaggtcaggagatcaagaccatcctggctaacacggtgaaaccttgtctctactcaaaatagaaaaaaaattagctgggcatggtggtgggtgcctgtaatcccagctactcgggaggctgaggcaggagaatggtgtgaacctgggaggtggagcttgcagagagatgagattgcgccactgcactgcagcctgggtgacagtgcaagactccatctcaaatacaaaaaaaaaaaagaaaaaatacaaccttataacttattcaaattcttcttcttcccacctcaaatatatactagagtgatgcaaactggggtagtggaagcagagtgtgttccctagacacttatcttaccatcttttagcaaagatgtggaacaaatagaactctcatacatttcttttttcattttaatttttattgtagattcaagggaaatgcatgcaaatttgttataagagtatattgcgtgatgctgaagtttcagcttctattgattctgtcacccagatagtgagcatagtaccctacaggaagtttttcagccattgcccccatctctcctttcatctttttggagtcccagtgtgtgttattcccatctttgtgtccgtgtgcatccagggtttaactcccacttataagtgagaacatgcaatatttggttttctgtttctgcattaatttgcttaggataatggcctccagctgcattcattttgctgccaaagacatgattttattctttttatggctgtgtagtattccatggtgtatatgtaccacattttctttatcaatgcaccactgatgggtacctaggttgtttccaagtctttgctattggaatagtgctgcaataaacatatgagtgcaggtgtctttttggtagaacgatttattgtccttcgggtacatacccagaaatgagatttctgggtggaatggtagttcatttttatttctttgagaaatctataaactgctttccactggggctgaaccaatttacattctcaccaacagtatataagtgttccgttttcgctacagccttgccagcatctgttgtgttttaactctttagtaatagccattctggctggtatgaaatgatatctcattgtggttttgatttaccatttctctgatgattagtgatattgagcattttttcatgtttgttggccacttgtctcatacatttctgatggcagtgcaaattattacattcactttggatatctatttggcaacgtcatctaaagatgaaagtacacatggcctacgattcagcagtttcactcctgcatatatccaacagaaattcatacatatatttaccaacagacatgcacaagaaagttcagagcattatacttaatagccaaaaactggaaataattcaaatgttcatcaacagtaaatgggcaaattgtagtttagcaaaacgatagaatattatacaaagaaatattaatgaaccactgcaataataaaagtaaatctcaaaaacataatggagagtagagaaagctaactcgaaagaatacgtatcatatatttccacttatataagttttaaaaacagacaaaagtcatctatgagattagaatccagatagtggtgacctttggaatgagacaaggtagtgactggtagagggcatgaggagggttccagaattccagtgtgttctgtttcttgatctcagcgatggtgacaccagcaatacacactttgtgaaagtcatcgcactgctccctcatgatttctacactttcccaatgaatatcatacttgaaaaaagtttacatggggggaattccttaaaagaaagttataattaatttcttctaaatgtagaaggaatgaggaagataggaaagccaccattctagccaaataataatagctgtaatcaagacccacaaataggtgccaaaattcatgggagaaattttaaggaaaatcaggacatttacatagtctcaaagtgtctcccccaaaatatgtattacttacaaagggaaaatagtagcttcacagtggagaagcctggcagaccccactttaacaaagtgaccaaagttaacatttccaatgataacacatattaacatcgtgtacctcctaatatgatgcactaagaaggacacatcatctctgtagcatttttctcaaaaatgtgtaacttcaaaacatcagacaaatccaaattgaggagcattctgcagtttacctgaccagtacttttcaaaggagtgaaggtcatgtagggagaaaaggaaagataaaaggaatgtctgtcagagattggagactaagaagacatgacagctaaatgcaaagtgggatcctggattagattctagaacataaaaggaacattagtgtaaaaactggtgaaatccaaataatgtctgtagttaagctaatagcattaaaccagtgctaattgcttagttttaataactgtactatgtttatgtatgatgttaacataagtagaatctgggtgaagaatatacaggaacaggaacttctttatagctttttgtttttgttttttgttttttaaagatgggatctcactatgttgtccaggttggactcaaatacctgggctcaagacatactcccacttcagcctcctgggtaactgggactacaggcatgtgatattgtaccaggatctctctgtagtatttttgaaacttttctataattctacaataatttcaaattaaaaataattaaaatacaaatatacttaacactactgaactgtacacttaagtgattaagattgtaaattttgtgtttataccataatttaatttttttacattattaaaatatatgcactttattatatataataatatatatataacataatttatatgtattaatatatctaactgtcaccccagggcacaagtaaagatacattgcagtctgaggaagggtaaaagaaaaaatatcttctatcccttagaatggggcaggaaaaagttctgggcccaggatcacataccaatactattagatgtctcctattcttagggcagggtcaaggcaaccactactcctgagactcagggtcacagcacctgcctaagactaatatgcataagaacgaccaaaaaagctctttttcccacccccaatcagtctaagaaacaccaaataataagcaaaagaaatctgttgctaggagagaagtaaaatcactgaaaaggccttactcctgacactgaaagtcatagcactcacttaagattaagaattgttggctgggcgcggtggctcacgcctgtaatcccagcactttgggaggctgaggcaggcagatcatgaggtcgggagatcaagaccatcctggctaacacggtgaaaccccgtctctactaaaaatacaaaaaattagctgggcactgtggtgggcgcctgtagtcccagctactcgggaggctggggcaggagaatggcgtgaacccgggaggtggagcttgcagtgagccgagatcgcgccactgcactccagcctgggcaacagagcaagattccgtctcaaaaaaaaaaaaaaaaaaaaagaattgttaaggacaaaaaagaaagcccctctttcttctcacacttcaatgagcctatgaatcactagaggatcttttgaaaatgaagattcaaattcagtagatctggagtgggccttgagattctgcatttttagcaagcctccagatgatgccagtgtggctgggccacaaaccacatattgagtagcaaacgtctaaagaacttcagtgttaaccaagagaatccctgttggcttgaatgaccctagcccttcctccaaaaaaccttttcgcaaaaaaaggtacagaaagaacctaacttgttcaaatgtgagaaataatcaaaagagaaacagcatgatattgaagcagagactgtaagaaaaaaaagtttcagggaggaaatagcatattaagaacagtgactataaaaatgttactatgaagccagtaaaaattgtggccaaaaaagaaaagccaataattttaaatacctatgaagaaactgctcctctaaaacaagagtacaaagcacaaatataagcattaaggaaatatatagttaaaaaatgaaagttataaaatactagctaccagagttcataaaggatattgaataataaatgaaatttttactacaatggtgtccctatcagaaccattaaagaggagaacatacttctttttagaagtcattatgaagttattatttacacagttgttaaagtacacaaatacaggggcaatacaaacacacagctcagagactggtgaccaatgcacaggttgacacagatgtcctacctacgtttcctgcatactcctctttaatggttctaatagggacaccattttagtaatgactcctctttgccaaaacatagagacaaatagaaaatagaataaagaaaaataaaacagaaaataaaaggttaaatgaccacagaaaagttttagacttggaaagcaaaccaagaaaatccaatgtatataactgatctctttgaagaagaaatacaaaattatatatgtatatacacatttattttttaaagacaggctcttgctgtgctgcccaggctgtcctccaactcctaaactcaggtaatcctcccactttagcctccagagtgctgggattacaggtatgtgccaccacacccagcaaaattattttttaaaattcaagaaggccgggcgtggtggctcacacctgtaatcccaacactttgggaggccaaggctggtggatcacctgaattcaggagttcaagaccagcctgaccaacatggtgaaaccccgtctctcctaaaaaatacaaaaattagccaggcgtggtggcaggtgcctgtaatcccagctactcgggaggctgaggcaggagagttgtttaaacctgtgaggcagaggttgcagtgagccgagatcatgccactgcactccagcctgggtgacaagagtgaaactctgtctcaaaaaaaaatttttttcaagaaaagtctaatgaaataagacaagaatctacagataaacacaatttgcaccaaaaataagttaaaggtacagtgattagaaatgaagaaattaaactgtcattatttgcagacaacataatgtgtcaatataaggtccaaaaagtctgctcttaagctattaaaaaataagtaaatttggggaaatgacaatatagaagatcaatgtactaaaaaaatttgataaaaagctaattgtaaaaacaattagaaaataaaaatttaagtatcgcacttagaattgtattaaataccatcgaaagatatgaactacaaaatattgctgtgagacatcaaatgtatataaaaagtagagctatatacaaccaatgtacatggattagaaggatcaatattataaaattgtcagtcctcccaaatttgatctatagattgcatgcaatttcaatcaaaacccaaaaatcctaatgtttttcttataaattgacaaactgcttctaatatttaagtgtagatgcaaaggacataaaatagccacaaaaatccagaagaaaagttgttgttcttccactaccaggtggcaagacttattacaaagctaccataataaaaactgcatggtatttgccatgagaatctacaaatagatcaatggaaaagaatagagagatcagaagagacttatgtacacttgatttatgatgaaggtgatactgcagaattgtggagaaaggttgatctcttgaataaatagtattagaccacctgattatcactactgggaaaaaataaaactttatctatctcacatcatacatcaaaattaattcctagtggtttaccagactaaatatgttaagtaaagcaataaactttctggaagtttatataggagattattttatattctcaggatagaaaatgtcttaaacagaaaataaagttattaatcataaaagaaaaaatgagtaaattaagaactcatttatcaaaaggcatcaagagactgaaaaaacaagccaaaaaaataagaagagatatgtgtaacacatattaactgataaatgacctaaaacccagaatatttttaatatcctatatatcagtaaagttaaccatatttttattaactaaagtccatacttaattcagattttcttagtttttcaagagcaattttaggtttaaagaaaaattgagtggaaagtacagaattcccacatatagtcaacaatactgtattatgtgcttaaaaatttataagagggtaaattttgtgttgtgtttttaacacacacaaaaagataaaaggacacgggaacatttttggggggattgttatgtcttctaccttgattgtagtgatggtttcacagatgtatgtgtatgtacaaattcatcaaattttatatattaaatatgcacagtttattgtattaaactaattatacttcaataaaactttttttaaatacagaaagttcctatataccctctccaccaccaccaccccctcacaaagtttctcttattaacatcttgcattagtgtgacacatttgtgatcattgatgaaccaattttgatacactattattaactacaaggcacagtttacattaggattcactctttgtattgtacagctctatgcgttttgaaaaatttatgtcatgactccatcattataatatcacacagaatagttttactatcctaaagtgcctgtgcctccacctggttatctctccctgactctccttgaacccctgacaaccactgatttttaattgtctccatagtttttcatttttcataagagcatatatttggaattacacagtatgtagccttttcagactgacttctttcacttagtagttgcatttaaggcttctccatatcttttcatgtcttaattgctcatttatttttatcactgaatactattacattatgtggatgtatcacagtttgcttatccatcacctattgaaggacatcttggttgcttccaaatttgggcaattacgaataaagctgctataaatattcatgtgcaggtttttatgtggacataagtttccaactcacttgggttaatatctaggagcataattgctagatcttacatatagtaaaactatgtttagctttgtaagaaactgccaaactgtctttcaaagtggctgtaccattttgcattctgaccagcaatgaataaggctcccactactccacatcctaacaagcatttagtgttgccaggatttgggatgttagccattctaacaggggtgtcatggtatcttattgtggttttagtttgcaattccctaatgacatatgaagttgagcgtcttttcaaatatttatttgccatctgtgtatcttctttaataagctgtctgttccaatctttttactcacctttttttttttgaggcagagtctcactctgttgccaggctggagtgcagtggtgcgatctcagctcactgcaacctccgcctcccagattcaagcaattctcctgcctcagcctcctgagtagctgggactacaggtgtgcaccaccacgcccggctaactttcgtatttttagtaaagacggggtttcaccacattggccaggatggtctcggtctcttgacctcgtgatccaccagcctgggcctcctactcactttttaagtagactctttacttattattgagttttaagagctatttgtatttttttttacccaagtcttttatcagatatgtgtttgcaaatattttctcccagtctttggcttatcttttcattctcttaacagtgtctttcacagagcataagtttttaattttcatgaagccaactaattctttttttaatgattcatgcttttgctgttatatctaaaaagtcatcgccaaacccaaggtcacctagattttctcctatattatcttctagcagtttatattagtacttttgtattttacatctagattcatttttttacatgtggatgtccagttatttcagcaccatttgttgaaaagagtaaactttctccattaaattgcttttgctcctttgtctaagatcaattgaccatttttgtgtaggtttgtttctggttctctattctactccactgatttctctattattttaacaataccatactgtcttgattactgtagctttatagtaggaagaagttggatagcagcactcctccaactttgttcttcttcaatattttattggctattctgagtcttttgcctttgcacataaacattagaatcatcttatcaatgtccacaaagttatttgctgggatcttgattgggattgcattgaatctacagatcaaactggggaaaactaacatcttaacaatattgagtctttctattcatgaacatggaaaatcttcccattcatttacagcttctttgatttctttcctcagagtgttgtcattttcctcatagagatcttgtacatatttaattaggtttatatgtaagtattttttggtgtttcctctgtccctctgccttttccagtagaagcttccttttgtgttcctgctatattatctttgccctccttctgtccatggacagaaggacatttttgctcctccttaggtccatgactcaagctgcttttgacagaaaataaattctggctctgtgatttcttttcatttgaatgttttatcttgaatgatacattgttcatctgaataccttttaccagattctttattttagcttcatacagggagaattccaaatcccaggtcctgttgtgcttcatagattccatctgttctttaaaatgcttcagatcctgcgctaaacagggagaaattctgaagcagaacttgagctccaagttcgagaagctgtcttttttcgagatgtccagtaaaaactgcatagtgagggtcatctcatcattcccttcctgctcctttacctccagcagcctttgcacttctctgcgggactccttccccagccggctttggtcctctttcaccaggtaagacatggcatgaaaaaagtcctggaagctgatgtggcggaagctgtagaacttcttgatggcaagtcccaattggtagtcgttactactcaggaaagcggcaagcctggggccatctaaattatgtttcctgagctcagcttcttcaaataggaacctctggtgctgaatcccttcagctgctagggagcacagactcctcaggaccctgtgccgggaaagctcggagcagcccccatcatcatcgggcggcagaaaggtggagacgtaagccatgaagatgtcagtgctgtttctaggtgtctctaagacaactttgcctctctccatctgcccctgcagccaggagcagaccacccagcaaatgcctggaacctgacacgctttgtagagaatgtcatttttctgtacaatgtcgaaggcacggtcagcttgcttctcatccgtgaaataggagctgaagtacctcgccctctcctcctcagagaagcctaggatatggacatgacgtgcttgtttcagcaagggctccagattcctcaaagccaggggccgggtggtgatgagaagggagcacgtggggagtgtatgtctcctaattagaaggtgcagcaggctctccttgggactcaaacccctcttcttcaacttttcttcaaagggcctctgcagctcatcaaagccatccaggatgaacaggagccgctctggctgcctcagaatctctgtgacaggggcttgattgtccccgcagcaccagaaaaggagctgctccagtttgctctccagcagcaggaccacttctttgcagcttacataaaagacataatcaaaccggcctgggtacagagtaccggtggcccagtccaacaccatttttctggcgagagttgtctttccagtgccagccgacccctgtagcacaactaaggatggggccagtgagggcttttcccctgaatcaaatagagcctccaccgtgacagactccagctcctgctccgggaaggggcaggcaagtgattctgggctctctgagctgggcttggccaccaggagcacctggttgtatctgccattgactcctgcttcctgccattcctctaggcagcgcacatgctctcggtatacttctctgtaatctgagccaaacaaatgggatgttaggtagtgaaatgggaattttagaaggcaaaatggcccctccaaactgactctgctcattagtcttcttgtatgtctccaacttggatcttgctgagattatagttctggcttcatggggaggggccactgtatgtgtgcatgagtgtgtgtgtgcaggcgcagtatgcatatgcacatctgtatgagtgtgcaagggtgtgctctgtgtgtgtggatagttgtgcatgaatgctggtatccacatgtgctcgtggaccttcatgtactgttgtggagggaagtcatgtcagtgtgcatcagcaagtgtgtgtctgtaagaatacatgtaagtgcaaaatgcctgtgtgagaatgcatgaatgtctgagtgttcatgtgaaatgtctccatgtgaagaggtgaggacagagagaggggaaaggaaagggatgcctgaggatggtgaagtgataggagccttgatatagtttgggtgtttatcccctccaaatttcaggttgaaatgtgatccccaatgttggaggcagggcctagtgggagttgtttttgtcatgggggcaaatccctcatgaatgtcttggggccctccccacggtaatgaacgagttcttgctctattagctacacaagagctggttgtttaaagagcctggcacctcctcccctctctcttcctccctctcttgccatgtgacacaccagctctgaccttgccttcttccataactgaaagctgcctgaggcctcgccagaagtcaatgttgacaatatgcctcttgtaccacctgccaaaccatgagccaaataaacctcttttctttataaattacccagtctcaggtattgctttatagcaataccaaagggactaagataagcctgttcttttttttttttttttttttttgagatggagtttcgctctgtcgcccaggctggagtgcagtggcgcgatctcgactcactgcaagctccgcctcccgggttcacgccattctcctgcctcagcctcccgtgtagctgggaccacaggcgcacgccaccatgcccggctaatttttttgtatttttagtagagacggggtttcaccgtgttagccaggatggtctcgatctcctgacctcgtgatccgcctgtctcagcctcccaaagtgctgggattacaggcgtgagccactgcgcccagccgataagcctgttcttgggaaaggacaagccaaatgctaaagataaaacagcttctcagaaagagccatgactctgggtccatgaaaccctcccatttgtacgtagcagaggagctttcaagcatgaaaggagcctatgggagggagcaaaggcaccaaaagatccctccctccccccaggcacccacaggaagaaccagcaggccatgaggtcccacaccacccattctgtagtgtggttccttgagagatcagggccacagaagacttagaagcgcctgagcagcttgccaggaagcagctagggacaggtctgacccctacatcctgatgctatttcttctggttagtggaaatcccttcaccaacaccctcccagtctctaagaccctttcttcagactctccccttctctgccactgcagctggaggtaagatgtggggaagaaaggctagtcttttcttaaataaatcccagctttggctcagtccccctcctgacagttgttggaaccctcaggtggagaccaccaaggactctggggcaccagggactagaggacaaggtgacagaaggcataaggtacaggctacaggcagctctggaaatgccatggtgggaggggagtcccagtgccatcctgccctccccttcccccgctccacactcaccatgcagacaaatatggctgagctggtccacaagttccaacaggttcatgaccttcaagcccttgaggacaactttcacagcctccttttctccatactttgaaatcagtaattctgccaggtccaccggaatcaggccctccaactcccctctggccagtgggggctggccctcagacagggtcatatcccgtaagtagaactttaacttcttgaaatcgttctcctcaaggtcactcaaggcccagagcaatgcctcccggggctttctggccttggccatggccatggtgatctgggggaaggatcaagtccagaccagaagaccagtgacctggagaaagaggcaaaaggagaggtccactgctgagaggcccaccctgctttctgggggcttggccaagttatagagcggaggccagggagagacgagatacatgtgcaaagctccaagaaagacaagcagatgaaacgcaggggaattttcctagtcattcccctctgcctcttagtcaggtgacacgtgactgtgttggcaaatgggtaggaaggtatgtaggtgtgttaatctctcaatctctctctctctcccccaaactctatctctgtctctctctctccccccactcccttcctctttccctctcaacacgttctttattaggctctgtatgcctccttagacggatggattaagaaaaaaaagtctaagttttttattttattttttttggagacagagtctacctctgttgcccaggctggggagcagtggcatgatctcggctcacctcaacctccacatcccacgttcaagcaattctcctgcctcagcctcccaagtagctggaattgcaggtgcccaccaccatgcccagctcacttttgtatttttagtagagatggggtttcaccatacgggcccggctagactcgatctcctgacctcaggtgatctgcccgccttggcttcccaaagtgctgggattacaggcatgagctactgtgcccggccaagttttaagttttaaaagtgagactgtccctggctgtgtgaacctatagaaagctggagcacatttgctggaactgctgtggtatggcaagaaggtaaaaaaaatctacactcaacccattggcctcacatgtcagcctcctggcctcagtcacacagggattgcaaagctagaagtctcctaattcaaataaggaaacaaatccagataatgataggaagaggaaccgccacctgtgagtgctgactttgtgccaggtgatttacatatcctttttgatcatctcagaaatcgtctcaggaactgttccacatgagaaatttggcagtcagagaaaaatggtttttcagagttttccagagctaggccaccgggcaaagaggcaggatttaaactggtctatgccctgggtggaagagagagacagaaaaaactcaaaagataaagaaatagaagacagagtcaggaaccagaaagttaggctaaatgttgccagaagctggagacatgtataaatactaaagtaacgggaaaggagagcagagttttgaattgtgtttctaatgtagaaccaaaatgtaggccaggtggcagtctttggaaaagaaaagcaacaattaatagaaagccttcagaatccagaaatacacctgtgacctaaggcccatagggaacccatctcagtagtacaatgtcacattcatcattgagagtgttcaaaagagaatttgggaacacagagagttgttgccattcaaataccaacattttgactacatactgacagagaaagaaaatgtttggaacatgttaggatacaggggactttggttgtgagtcataggccagtttggaaaagcaggcctgtgaaagcaggatcaatttacaacaaagcttcaggctgcatgggaagactcagggcttccctgcaaatttctgatgttggcagagctatttaataattcaggaaagaaaagacaacactagaacctgccaagaagatgtccagtctaggctgcttaccacagttcagacttggggagctggaggtgaggcagcgagaactcagctccctgatccaggagcccagtaagcaaagcctggggactgagacgaaacagatcccctttcctggtccgacagctctacaggtccaagtttgggctctcttagcccatactcactagttcacttctgtttggtggtgctggtacctaccagctacagcttgatacctaacagttcctagtatataggcctggaacagaagggcccctccccatctgccccaagcctctgtgaagcagaaccacccactgaatgtcagtgggatgactgtcaatgggatgggcaattgctcaccagtgggaaacttgacctcattttttcaaatgttgaagttgagaaacaagggaggggtggaaggcatgaactattctgtcaccaagagaaaaagagcccaggagacttcccacatccctccctggaacccacactcctcctctaccacttaaccccagcctaggctggggcagtttgactagagagacgaaagaattgaagcactgccaccaccatatcctccgccagtgcaccatttctctaagttgttgaaatcactggagaatgaaaaaggaagaagataggagctccatgaagtaggaattcaaacaaggagaaaaacaggccaggcatggtggttcacgcctgtaatcccagcactttgggaggctgaggtgcgtggatcatttgatgtcaggagtttgagaccagcctgatcaacatggtgaaaccctgtctctactaaaaatacgcaaattagccgggaatcatggtgcatgcctgtaatctcagctactagggaggctgaggcaggaaaattgcttgaacccaggaggcggaggttgcagcgagctgagattgtgccactgcactccaacctgggcaacaaagtaagactttgtctcaaaaaaacaaaaaagaaaaaggagaaaaacaaattcccagaaggcagccagtcctctggcctagagagctgaggatccccaagagccctgacagaaagagaacaggtttctccaaaaagaatgtctccaagaaaaaagaaaaaagacttgctagactagctgatgctattggccttctaaaacagcctattgggaggctattagaaggtggaaaaagctagcagtaacttccaagaaaaccagataaatgaaagtaaaataaagaaattactagcaagaggagaaacaaaaaataaaattggaaatataatagtaaactaatatactcaagtgtgaataatgtttgcatagaaatcatagtgtaaccactgaacattgctctaaaatttaaaatataattacattgaaaggatggtggtggaatgtactagaagaggaagttgatagacaatgcctaaaatgttgaatcaaaagatagtgatatacagtacacatattacttcaaaatgcagagatgtaagaagaaatagttaaaatctaatgtattaatagttgttttagcgaaaagagactgggcatcaggagaggaaaggactactgttccagggcataagttttttaatgcctattgactttagaaatcataaccatgtattactttgaaaagataaaaattaacttagcaaagaaacagtaagaggtaaagaaatggagttaacatgtatagacaaatctctctggaagcttggtaacaaaagtgatgagaaaggtcctgaggtaatatgggagatgtgaagtccagagaaggttttgtttgctttaacatgggaaagggaggaatgtacctggatgctgatacaaagcctcccatagagaggtcaggttagaaatgcagaagagaaaggcaagcaccagaggggggaatggagaatggggattgggacaggattcgaagcaaaggcaaaagattggcctttgacaggaggctggaaggaacagcatccattcattcctgaggaaagtgacagaggttgtttggcagagaaagtcaggtgtgtgggttttgtggtcagaagataagcatggtcatgtctgagtctccatatgctctgtgaagtacatgtaagagtatctcccatgagtgagagggcaggggtggttgaggagaggagacaccttaaggaggccactgcaagccttccctcctgtgcacctctcctcctcctccaaggcctcttgtgcccactgctcagggagtaccccagagtccaggggaacaggcaggaatgggactggcctttcccagtgccttgaccaagatgaggctagcgacaaaaacaagactgccaagaaccaggacccagagaccaagatgggaagataaaagagtgagacacagttatgtagtgagggtgacagagagagcagaaaggccacctactgcaaaggcaccaggtctggagaccactgtgccagattcagaatcacacctgaagaaaggaggaatgagatgcatggaaccaactataattggagggtggaggcaagagatgaaatgagtcctccctgcctatccaccctggcctggctacaggcaacactgataattgcaactaagtcccaaaaagggcaggggtggagacaaaagaaagagaaaccaagcctgggaatagcaagagatcaaaagagtaaagagtcagagaagagatacagagagatatcagaaaaatgagcaaacaaaatagaaagtcagagagagatgaagccagctggtaggtatgagtctctcactttcccatacacacatacacacatacttacacactcactctatacacagtgttttttcacagcaaactgttagaaacaagggcaatgagaaaaacatgtgaagcaattggagtttctcaatcaagctgcagtgttcccacattcattatactctttccctacctatggaggcagatcccaaggcaaagttgaacacatgtcttcatcctcttgcttccaggccttctttttgacacaggcaggagctccaaccccagtctgtcccctcttatacaagggccctttgagacagtcccctcaggctccccaaaggtcaccatcttctcctttataccttggtcagttttgatggagttagcacatggatttggtaagcttaaaggtcttcttgagacaggagatcctgtggccattttggaggtatctgtctctgctgctagaagctgtcttttctcaagagtattgtcacaaggcttttgtaaaccaaaaagtatctgagacaggtctcaatcaatttagaaagtttattttgccaaggttaagatgtgcctatgacacagcctcaggaggtcctgaagtaatgtgcctaaggtggtcgggacacagcttggttttatacattttagggagacatgagacatcaatcaatatatgtaagacgtacattggttcagtccagaaaagtgggacaagtcaaagcagggagagggcttccaggtcataggtagataagacataaacagttgcattatttttagtttctgatcagcctttcactgaatacacaatttacaggaacagtcacttatgccttagtctagcttagtgaaataatggagcaaggaagcaatcagatatgcatttgtatcatgttaacagagggatgactttgagttctgctttttatccacaaggaattttcccgtgggcaaattgtgacggaggtatgtagcttttttttttttttttttaatctttgtagctatcttatttaggaatagagtgggaggcaagtatgcccacagtacccagtctgacttttccctttggcttagtgatttgggggaactgaggtttattttccttttgcatttccccacttttctttttaaaaagctttcaaagaaagcattttagaggaaaatgagtctttgggctgaggttttgtctgatctctcatggctaggatggtttattcctagacgggtaggtcccacattattaggaaagctcatttttagcagattgtaaagtcacacattctacaaagagaaaatagggggagggaagaagaaaaacaacaacaaacaaacaaacaatgaagaacaatcctggaaaattcatacaggtcatgttactctgaagtccatacatcagtaggcaggtatgaaagtggtttaggtacgtaaataggctgccattattttcttctaaagtttaagttgttcacaaagctttaagaaagcacggcttaatcttcagtgatttcaaatcaggaaaaatgggagaaaaggaaaaaaaagaagaagaaatattgaaaacattgttttggagacttgtagccaggaaaatttttagaattcagtctaaactgtagaaaggaataaaaactgaaaaacattaggcaagactagactctaacaagtgtactatagtttattttgaaacataatttttctctctccagtcctattttcactaaagacaagtcataagacaaattcatttgcaaaataagttttaatcttattatacttggctggggtattttcataaagtcagcaagaataactatttgtcatataggctcctcttttttttttaattggcattgctggaactttattccataaggaatctcagattcaactttaatgccttaagcctaacctctgcccacaaatatctgtattaattgggtgaattcctaaacttgaattcccaagaaaacttggggctcctgggactatcagaaagtgacattctttacttaccacagcataattgcctgaggggttcttcctgcccactgcataaagaaagaccacgacactgtagtagaaaaagagtttaacagacacaaggccagccacaccacatgggagatgaaatttctactcaaatcatctcattcaaagctggtaaggttagaggtttttcaaaggcagttttggggaaggggtgggggtggccaggtagcaggtacttgctgctgattggttggggtggagatgaaatcacaaggggttgaagctgtcctcctgcaggccaaatcgcttctgggtgcagccacaggagtggggttgttggtccaggtggagccatgggtatgagacatgcaaaaaagtctggaaacatatctcaaaaggccaatctacaataatggtgttatttgcagcagtaattggggaagtagcatatcttataacctccagaataatggctgacaattgtttatgtctacaccttagcaggatttagcctcctctccttctcccagcctgacggcatctcattagctttacaaaagcagttgagtttggggcaaggcctattatcatttaactatagcctaaatatcttccaaagatagcttggcccaatagcccaggaataattaagggaaaggcaaggtggggattgtgttagcttagcttactgttatacttttctcactgatataacttttgcaaaggcgtttcaacaggtaaggaacctgtacagggactgtgtagacaaggtatggggccatctttcccaaggggttttcattggctctataagtcaactttgaatccttaaaggcatctgtatctgaaagcatgccattccagtcaaaaccttggtaaaataacctgtgtctccaattgtgtcctgttacaaatgaaaacagattcttattgcacttgtgcaaatgactaatattgccataagttaaaaatattcacaagtagtttccaaatttttgagaaatcaggtagagagaaatatgttccaaattttgtttacgggagtttactcaattgttaaaagctgtaaaaatctcaaaagaaaagtttattggctctgaaaaacaaaggatcagcaatgttttaaacaaaatgtcataaaaggattatttcagtcttctattagttcaatccatggagttaactcctattctgtttgatattcatgaacatttcagctctccatgggagtcttggaagtttttcctctattctagtgtcacagtctccaaagttattagaaatatatttatataaatgtgttattagtatatgttcccgcattgtatgaaattcctgtgattctgatatgtcttagcatatgttaacagtagtaattatgataatgtaaaattgttgtatgccacaaaagcaaccaaatttccttgtcaattgtgtctttatgactgttctaagacttgtcatccacagttgtttcacttttatccttttcaaaagattttttttttttataatcagctataggactctgacaggtgtccttgaatgcagttttctaataactttattttcctttcacaccttcaaggagaaggaggccttcaaactcccccagtggcatagccagtgctagcaagatggcagtaaggagtacaggcaggctggcaaagcacatgataaaattacagtggtcatctggacaactctgatggctgctttctatagcatgttcctaagtctctagggtgaaagataaggcctaggccctcgaatacatctcggtgttcaggctggagggtggtgctgtggcctgctcgggactgcttttctggggcttgatcacaggactgagggaaatttgatgagggtgcagcctgcactgcaataaaagggcctatggtgagatgaaaccagggagggattacccaaagaagccaaataaaggaagaggagcatgaaatctggtcagagaagctggaagttagagcaagattctgacatgaaaggcaacatctataaatgagaaatggaattgaagttggaggaagtcagtttccccagggatagaaagcagagattaggaagtgctggccaggatccatcagagccacattgtgatgtaaggttgtaagtgaatggtttgttgcatccaagtgcacagtacacatgagcaagaagccccatggtaatcaaatcttggggtctggcccagcaggagagagagagaaaggaatactatacaacactgtgattccagacaccatatcatctctccagcccagcaatctccttgtgacaatcatggcaaaagccatcattctctaaactttttttaattttttaccttgtagggaaaggaaaacttctcctctaccctcttaggttcttaaactgagacctacagattaaattgacaaaaaaaaaattatgattaacgggagaaatcatacaaattttatttgatgtcaacaattttacatagcatcagggacctcacagacaagaagtgaaaaccccaaagaagcagttagacccaaaggcttgtataccattttaaccaagggctgtaaatttttggagaagtgacaaggcaaaggaaaaggatatggaattctaggggtagcaagttctgggaaagtaactagggggtatatggggaaaactaatgaaaaataagggttactttaggaagttttgcttggcaaacatatctcagcattgacctcccatctccagtgataagaatgttctctccttcctaggaaaacctttctcatgggaaatttatgccctgcttttaggtagaaatgggaagagcagacagccctttctgaatctgctgtttttcagttcccttcagatcaaaataatgaacatgcttaagtggcatattttggtgtggcgtgttcagatgcccatgcctttcaatctcaagaatgagttctgtacaaaactctcatgcacttttggtgagaatgtaaaatattacaaccagtttattattagtattattttagagacagagtcttgttctgttgccccggggtggagtgcagtggtgccatcatagctcactgcagcttccaactccagagctcaagccatattactgtttcagcttcccaagtagctgaaactacaggcacgcaccatcacactgaactcattgatctgacagtttcttgtaaagttaagcactccctgtcctatgacttagccattccatgcctaggtatttaccccagaagaaagaaaacatacgtcttcacaaagaattctacacaaacgttccaaagagcgttattcataacagttgaaaatctgaaacaaatcaagtattcatcaacaagtgagtggaaaaacaagttatagtacattcatacaataaaatattactcagcgatgaaccatttgatagacacaatgcattgataaattttacaattgtattgtgtgaaaggagcagacacaaagaattcaagttgtttcctagctgctggttgtaaaaaaaaaaaagaattcaaattttattattccatttatatgaaattctacaataggaaaactagtctgtcataatgcagagcagtggttgcccatggccaggtatgacatggggtactacaaaggagcccatggcacttttggagtgaggaaatgttccatgtcttgactgtggtggtggatacataggccaagactttctcgacactcactaaactctacacttttttttttttttgagacagagtctcactctgtcacccaagctggagtgcaatagcacgatctcagctcactgcaacctccgcctcccgggttcaagtgattctcctgcctcaatctcctaagtagctaggattataggcatgtgccaccacacctgagtaatttttgtatttttagtggagacggggtttcaccatgttggccaggctgatcttgaactcctgacctcaggtaatccgcctgtctcggcctcccaaattgctgggattacaggtgtaaaccaccacgcccagcctgaactatacactttaaatggaggcagtttgttgtattataaattatacctcagtatatatccaaaggattataaatcatgctgctataaagacacatgcacaagtatgtttattgcggcactattcacaatagcaaagacttggaactaacccaaatgtccaacaatgatagactggattaagaaaatgtggcacatataccccatggaatactatgcagccataaaaaatggtgagttcatgtcctttgtaaggacatggatgaagctggaaaccatgattctcagccaactatcgcaaggacaaaaaaaccaaacactgcatgttctcactcataagtgggaagtgaacaatgagaatacatggacacaggaaggggaacattacacactggggactgttgtggggtggggggaaggggagagggatagcattaggagatatacctaatgctaaatgacgagttaatgggtgcagcacaccaacatggcacatgtatacatatgtaacaaacctgcacgttgtgcacatgtaccctaaaacttaaagtataataataataaaatttaaaatatatatattagtcagtgattgagctagaactcaaacctaattctactctatactgcatattgtttcagtttacaataaaaatatttatgcttaaaaaaataaataaattatacctcagtaatgttgattaattaaaaaaagaatgagctctgataactaaactgttaatcttacaaacctaagagaagtctgcaaggaccacttactcccgcaaccaaacagataattgtgagctagtcctggaatgtgcaaggccagtagagaggagacacacctcttcatggataggaatcagggagggaccacacaggagcctgggaaggaatgtccttgccagggtgaggtggccaggagctgagcctgcagagagggggaacctgggggctgaaaacagggtagcaggcagccagctttgcagggagggaagaagggagaggagaggtgcccctgaggccagagttctctagcaacactgatgtgggtatcagaacttcagaactgcagagaagtcgtaaagctaagcatgaccaccctttcttagtcaaagtcttctaaaaagtctaaagtgactccatccaagagaagaaagagaagcaaactgtctctgggggaaagcctccccaatttaggcctcaacaactatcgctcaaaaaccaagaaatgaactcatagccttgaaagtctgaataagaataaataaaaacaagaaacatagattcaggccaggcaaggtggctcacgcctgtaatcccagcactttgggaggccaaggcaggtggatcacttaagctcaggagttcaagaccaacctgggcaacatggtgaaggctcatctctacaaaaattagccaggcgtgatgacacatgcctgtagtctcagctactcaggaggctgaggtgagatgatcacttgagcctgggaggtccaggctacagtgagccgagatcatgccactgcgctccagcctcggcaagagtgaaaccctgtctcaaaaaaaaaaaaaaaagaaaagaaaagaaagaaagaaagaagagacacagattcagaccactaagaattatagatgttacatttatcagcttcgtatgaaaatgtttttaaaatttaaggatgtaattacaaaaataagcttataagaaataagaaaaaatagatttgttttaaaaatccttttatatgaaaaagaaagaaaataaaatagaacttctacagatgaagaatataattattgaaatctaaaattcaatatacagaacagatagcagctgaagtcagaattagagagctgaagctatggccaaagaatttatccagacagcagcataaacggatagcagattgaaaatatgaaagcttaagagacatggagaataaggtcaggagaggcaatattaagagcaaatgggccgggcgcaatggctgatgcctgtaatcctagcactctgggaggtcaaggcaggtggatcactcgaggtcaggagttcgagagcagcttggccaacatggctaaaccctgtctctactaaaagtacaaaaattagccaggcatggtggtgcatgtctgtaatcccagctattcaggagactgaggtgggagacttgcttgaacccagggagcagaggttgcagtgagctgagatcacaccactgcactccagcctggcaacagaaactctgtctcaaaaaaaaaaaaaaaaaagcaaatggctgtaaatttcccgaaccaaaaaaaaaaaacaaaaccacgaatctatagatccaagaagaacaatttatcccaagcagaatacataaaaagaaagccaccttaaaatacatcacaatggaacagcagactctaaagacaaacagatcttgaagcatccagaaagaaaggaccacaaagaaacaacaaagcaaaaaagaagccagagatggcagaatgttttgaaagtactaagatattataactgctaatttagaattgtacatccaggaaaactgtttttcaaaaatgaaatcaagccaggcacagtggcatgtgcatgtaattccagctactcaggaggctggggcgggaggttcccttgagcccaggcaatacagcgaaaacttgtcccttaaaaaaaaaaaaaaaatgaatgaatgaatgaaagcaaaccactttcacagtttttaaaaatgtggactaccaagggaactgctctaaaaaaaaaagagagaaaaagctttacttcaagtaggtgaaaagatttcagaagaaagtcttagaacaggctgtgcatggtggctcacgcctgtaatcccagcactttgggaggctgaggtgggcggatcatgaggtcaggagatcaagaccatcctggtcaacatggtgaaaccctgtctctactaaaataaaaaataaaaaaaattagctgggcatggtgtgtacctgtagtcccagctactcaggaggctgaggcatgagaatggcttgaacccaggaggctgaggttgcagtgagccaagatcgccccactgcactccagcctagtgacagagtgagactccatctcaaaaaaaaaaaaaaaaaaaaggtcttagaataaagtcttgtcctagaaagacaagaagaaatagtgtacagagaaagtggtaaacaggtaagcaaattgaaacatactgggtgttagccttataaatataatactaatagtgtttacatcatgtggctagttcctccacccacgggaaataatgaacaacagtgtataaatcagaacgggaaataccaaagtgaaagcattttaaagtccttttaacatcatcggtgccgttctttaaacagagttaatgcattaaaaatgcataataacttctgcacctgcatgcagctggtgcaatagcaatgcctatttctctgtccatctggaaggaacttgcagaggatgatgcaataccatgactatcatagcttccagtgccttgatgaaacctcaaggtttttggccttttggccaagcatctgccatttcatactgttgcagcatttgttgtgtcctaggagttgcaactatctataagtttgttgtggctaaaccatgaaataaggcatatatagatttctgcagaaattataattctacaaatgattttgaagagatgaaaaaggttggtatcttttggaatgcaaagtgatattggaatgtaaagaatttctggggattgtgttccatggaagtttgtcactggcctacgttcctgaactgtgaaacatgaatatgtgggcaaaggaatagtttgttttgatagattaacaaatatgaaaaaaatgcatgataaaatcaagagctataattaaaacactaaaattggaatatgtgcttcctaagtagtagagaaacaggaaaaataagaacatgcaatcaatcaataaccccatttaaaggccaaatataaggaatggagacaacacaggggctgggcacagtggctcacatctgtaatcccagcattttgggaggccaagttgggtggatcacttgaggtcaggagtttgagaccagcctggacaacatggtgaaaccacatctccactaaaaatacaaaaattaaaaattaaaaagaacacagaaaagtgaaccaaataaaaatcaaaaattaaatgtaagaaattagtccaaatactcaacatagaaaatgctaatggactagacttgccaatgcaaagagagaaacagatcaaattgtttaaatatttagctatatgtgtttataagagttacacctcaagcataaagatatggaatggttgaaagtaaaaaaaaatatgaggaaaatatatgtgagaaaatgctaatcaagggaaatctagtgtagctatatatatttttatttatttacttttaaataaataaactatgaggtaggtactagaaggtcaaatatgaaaacaacgtgatccatgcctgaaaagatgtagagtttagtaaggataacaaacaaagaaatggatcatttattccactttagaaccagacaaaagaggaaattcacattttaggaagaatgtatagtcctgaaatataaccagtctatttttatttatttttcaagacagggtaaccctgttgcccaggctggagtgcagtggtgcaatcatagctcactgcagcctcaaacacctaggctcaagccctccttccacctcagcctgtgagtagctgggtctacaggtacacaccactacacgtgactatgatgtagctatactaatttcagcaaaatagattttaagacaaaagcatcggccgggcacaatggctcatgcctgtaatcccagcattttgggaggccaaggcgggcggatcacgaggtcaggagatcgagactatcctggctaacacggtgaaaccccatctctactaaaaatacaaaaaattagctgggcgtggtggcacgtgcccgtaatcctagctactcgggaggctgaggcaggagaattgcttgaacccgagaggcagacgttgcagtgagccgagatcgtaccgctgcactccagcctgggtgacggagtgagactccctcaaaaaaaaaaaagacaaaagcatcattagagttgaagacagtcaacacacaatggtaaaggtccaattcactagaaaattttaacagttctaagcatgtaataacctaattagattcaaaataactcagtatgtggtaaaacaaaaactgacaaagttacagagagaaactaacaactccatcattacattgagaagatactaaacttcctctctcaattgttgctaggtcaaacaaataaaaaaagatcaattatatataggttaaagatcagaattagcaagctttacataacagacttatagagttctgtgtcctaaatttaaatgataaacattcttctaaggtacacctggaccacttgataacatacttggctataaagtaagacaattaattttttaaaataggtattgtatagatatattctctggaaaaaaacaaaattaaattggaagttattaataaaaagataaagaaagatgaattatagcttttgtttatgaataggaaaactgaatatcacaaaaatatcagttcagctcagtacgtctttagaatcaatgcaacctaatccatcaggtttcacaaacttattctaaaatgtacaggaaagagcaaagggccaagaataaccaagactttttttttttttttttttttgagacggagtcttgctctgtcgcccagcctggagtgcagtggcgcgatctcggctcactgcaagctctgcctcccaggttcacgccattcccctgcctcagtctcccaagtagctgggactacaggcgcccgccaccacgcccggctaattttttgtatttttagtggagaccgggtttcaccgtgttagccaggatggtctgatttcctgacctcgtgatccaccctcctcagcctcccagagtgctgggattacaggcatgagccaccgcctggcctaaccaagacacttttgaagaaaaagatggtagacaagagggagaggctgccctggatatattctaaaactaaggtaattaagacaacataatattgcacctgctctaccacgtttcaaaactaattctaaaactagagatgtgggcggatcacgaggtcaggagatggagaccctcctggctaacacagtgaaaccccatctctactaaaaatacaaaaaaaaaaaaaaacttagccaggcgtggtggtgggcgcctgtagtcccaggtactcgggaggctgaggcaggagaatggcgcgaatctgagaggcggagcttgcagtgagctgagatcgagccactgcactccagcctgggtgacagagcaagactctgtctcaaaaaaaaaaaaaaaattaaaattaaactagagatgtagccattaatatggcacagcaatggttcagagtggacaaaatagaaacaagagccagaaacactaccagacactatgaaactgtgatacactgtcatgcattgcctaatgatggtgatacattctgagatattcattattaggtaattttgttgttgtgtgaacatcatagagtactttcgcagacctagatggtatagcctaccacacacctagactttatggcatagcctattgctcccacgctacaaacctgtacagcatgttacaggaaagagcaaagggccaagaataaccaagactttttttttttttgagacagagtcttgctctgtcgtccaggctggagtgcagtggctcgatctcggctcactgcaagctccgcctcctgggttcacgccattctcctgcctcggcctcccgagtagctgggactagaggtgcccaccaccacgcccggctaatttttttgtatttttagtagagacggggttttaccatgttagccaggatggcctcaatctcctggcctcatgatccgcccacctcggcctcccaaagtgctgggattacaggcatgagccaccacgcccagtccatcattgacctaaacatcactatgtggtgaacaattgtatttttcttttaatggcacggtagatgaatagggaaaggaaggacaattcaaaaaatagaatttaaaaatcccacatagattgaaggataaaaacaatactttaaaaaacatcaaaaatacgtagataaaatgcctgtctctggtattcatataggaagaatttcttaaacaagacccataaaagtcctagccataagataaaggattggtaaatttaactacattaaaattaagatctgttcttcaaaatacaccttaaggaaagtgaaaggaaaagctgaaaagttagagcatatatttgtaacatttatgactgataaaggattggtataaaaatatgtactgaagtctttaaaaaaaaaagtccctctcaaaaataaataataaatagaaaacaacctatagaacctagtagaaaacaacctaatagtaaagcatatggagagattttttttaacaggattcaaatacatatggccactaaacatatgaagtgatttcaacctcattagtaatcaggaaaatgcaaattaagcacacaaatagataccattaactatccatccattttttacagttgagggaaaaactaaaacatgacagagtttattcatcaatgggaacttttatatactgttagaaggcatgtaaattggaacagcctctttggaaaacaagtctgcattatcttgtaagtatgaatattcacatatcttacaacccagttgtcttagtctgttcagactgacacattgaaatgagacacaaaatatcactgactgggtgatttaaacaacagaagtttattttcccacagttctggaaggtggaagtctggcagcagttgacagcatggtcaggttcagtgagggctctgttcctgccttgcacatggccaccttctcatcgtgtcctcacatgagacacacagaaagactcttcttataaggccacaggcttattggattagggccccactcttaacaacctcatttaaccttaattacctcctaaagaccctatctcagatacagtcatattgggggttagaactcaacacagaattttgaggagacaaaattcagcccataccactaactcccaggtgcccaagaatacatatataaaaggatgtttaaagcaccaattttcataatatcaacaaatttaagcaagccacatgtccaccaacaataaaatggaaaataaattgtggtatatttatacaaaatactattatacatcagtgaaaatgaagaatgagctgcagttctatgcaacaacatgaatacacatcagtaaactaaggttgaaaagaaaaaagaaagttcaaaaaattactactttcagtatgatacactttttattgagctcaaaaactagcaaaattcaacaatgtattgtttagtcatgcatatatatttgaaataaaactatcatttttatgcaaatgatggatacaaaattcaggtgagtagttatttctaggggtggggcagtaaggcagtgaaatattgatggatataactcatagtgtctcaaaagccaattgttaaattttttaggactttcaagagccccttgtcaaaccactggtagcctgaaatcagccatggtgggagtatttacaccatggaaactggcaaatactgaaaccaagaggctggttgttaaacatttaccagtataccactgaatgtaagctgttgctagtgttccagttcttggtttgagtagtaagttctgttcattattttttaaatgaacaaggttcttagtttaggtagtaatgtctgctcattatattatttaaaaagaatgaatgaatgtaaacaaagaggttcatgactggacccaaaaagtcagcatatcacgaaccaaggtgtatgattgttacaactgtgtgcacctacagtaggaaaaaaacaaaaaaagcattaagttccctccatctgggcatatcaagtgtcaaaagaatctctactaataaatgaggtcaatatatacctggaaggtactatcccactctctgagagcaacacacaggcttccaggaatgagaggatgggcccatccagtcccatggaggtgagtctccctagttccctcaccaagcaagcctctcaatgatcaggctctaggccagaaaaactagatggtataacccatgcgacagtcacagaaggagctggggccacactatcagcacccacaatgtggtcatggttcttgagccaaactgggtccagcctctaaagtagctcaggcaagaggggaagctaacaccagtaactcacgttgttttccaccccaccttgccataacgtcaaggaggctggccaggccctctgctgttagaatcgaaggaacctgaaggggaaacagttagggatagactaaagttagcaagccagagaaagaagcagcagtgactagcaaaacaaggggaagggaggaaaggctagaagtgggtgtagaaacgaacatatggaggtcagaaatcagagagctgagagaagggaatctcatgccaagtcagccagaatgagagtggtctcggggaccctggctcttggcagccctggagacggacagatgctacatgtgacaggtagcctggtcaggttggctccctcaaaaggggcatcggacagggtggccaactagttggtggggccaggttcccttgataacatataccacgcagaaagcaggtctgaagcttgaggtctgtgacactgttgctttcaagttgtgtggcagccgttccttaccaccctggtctgaaagagcctccaggcagaggggccttaattgtgctaaattccacgtagaaaaggagtgagactcataaagcctaagtaaggtgctcggcttcctgaaaacagctgacattgccagagaaaaactgtgggaggcagcccacaagcctgcccatgccaggccatctgcagaaggatggggcggcagcatcagagggtgggcggcagcatcacagtgcatgcggcagctctgccccatgagggaagccttagtaagttccaagtcacacttgctgcagagttatggtagtgtgggctccccttggtggtccccccacagtttaagctgtagctgagctaccctcatgccagctgatcaccgaggaggtgggatggatacatcaaactgcaggtctcaactttaatatgaccctggcatatgtggccctggtcttttcaggcaggactgtcaagcatgttgccaggacagccaggaacccacatgtgaaggttaatcctatgggtcaacttgactgggccacagggtgcccagacatttggtcaaacattattctgggattgtgagggtatttggagatgagattaacatttgaatgagtaaactgggtaaagtgattgccttccctaagagtggcctcatccaatcagttgagaacctgaatagaacaaaaaggctgaccctcctgtgaataacagggacctcttcttgcctaactgcttcgaactgggacataggccttttccagccttttgacttgaatggaaacatcagctcttcttggggtctcaagcctgtcagctttcagtctggaacttacaccactggctctcctgggtctccagattgttcactgcagatcttgagacttcttccataattacaaaagccaattccttataataaatctctttctatatatatcctgttggttctgtttttctgtagaaccctaatacactcgtacaatacattgcccatctacatgggtacagtctattttctctcttcccatacctctgccctttccctgatgaacccaggccccagatatctctcagacagccactgaaaagccagcatttgggatatacacactctcatcctggccagtcagcctcccagaaagaccacaccaaccatctgtactctcctgctcctgggctatgttgctagagaaaaaccacaagagttggccagattctcgagctctccaggctcagggggtgctcccataattgatcaatgccttcaatagctcactctcagaccctcctccaaacactgtccattcccccgaggcttatccctgcccttgcattgccattcacagcagatcaccttgcctcaacttacctgagaaaaatgtcatttgcaggaggtcctgcaacttccctctctccccaattcatctctgcttcttcatccatccccttctcttttctcccagagagaaatgtctttaagacatcaatataaaggcaaagttattgaaggcaaagtgtccacaccaacccagattaacacatagataggaggtctcaaaggtgtgcatggtcagttgggggcagcaacacttcttcaactgggttctgtcctctggcctttttcccatgagatgatctcaatggactgaccttgactcaggcagacccctactaagcacccaaaagggaggccagggccctgggcagtctctccagcatgcctctcagcctgtgcaagaccatctaggcttctcagtgtgggtccaccttttgcccgtttcattagatattttttcacacttgtatatttaatatttctctctcgtctatattcttatcctcagtttaaaatatacttgaaacactgccatcctaaattggctgcctctcaatcctgctgtttccctggctatttccttaaatgtctcctttccttcccagaaaacttcctgaaagaaaagctggcacttgctgctttcagttcagactggccattctctcacaccagatttctagtttctgtgcccaccccaccctcagtcccactgacgttgctctactagggttgctaaagactccaggtcatcaaatccaagagttacttttcaatcttcttctgtttggctgttcacctttgttttggtgaaagaaagaatgcatgtctacacagagcatttacaggggagcagcgtcatgtgaattctaataatggaagatttctccaaggagaaatcaactcttgggcacagaatcagggataagaagttcaacctcacctatccacttgccagctggacactaggacttgacctaattaagggagttgacagtttttttggtgttttgttttgtctttacaagcagatgttatcaccccattataccaagaaggaaattgaggctcagaaaaaacttgtagattgccccaagttacacagtgggttatggtcagagctccctccatcacatagtgataatagctatgacttaataactactgtatatcaggcatgtgctaagagctttacaaggcaatacctcatataatcctctcctaaagtacagactagtttatacaccttattacaactccacttgaatgtgtaatggacatctcaaaggtgacacattcagaaatgaaatcaggatcttttccccaaaacctgctctacctacagcttttgctatctcaattgatggtgacttcatcctactaatcgctcagtacaaaaaaaaaaaaaaaaaattgcagtcctccttgactcctctctttcacacctcatatacaatttctcaggaaaccctattgaaactaccttcaaaatatatccataatcttcccacttctcagaacttctactgctaccagcctggtcccagccaccatcatctctcacttagattacctagtggcctcccagcaggtctccctgcttttccctctctcgcctccctctcctcacctcccctcaccctccagtctcttctcaaagcagcaggagaaatccagctaagttctccttctcgcccattgcagcctcgagcttctgggctcaaacgatccttccgcctcggtctcccgaagtgctgagattacaggcgtgagccaccgcgcctggccttaaaatcctttttaaaggcactttgacatccattatctcatttaagtctaaaacacgaatttcgacctccgcgctgctttctggttccacctggcggcagctgcacaaagtgtttctcttcgaacgccgtcccaagttttacccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggtgagtggtcagagaaagttaacattcttttcttcctcccacttctcatttatctcactcccctaactcattaattctttaattcctggtgtcctaccgtcctttcctcccatccccaatgacctcttaatctatatctgcatcctaccttttgctgtgacttatcttctcaagcacttgcatctctcctctctctcctgccggattgctgtcactttaagcgacataaaatacacaaggagtagttgtgtcatttactgaatattttatgccagtggtttacatttatgccagtggtttacattttacataaacagcagtttatggcaagtatgatgggctgcatctaccaaaaatgagttcacacgccgagtgggaagtcaggaacccttgactccctataccagtgaccacatatttctcccttatccactgactaaatgtcatcgttttccaggtattgacaaagttttctaaccagttgtcaaaggagtggggacgtttgtaaaaaaacattcctcccaacaagtaaaccggtttggttggaacccgcttgggattttatagtgttctgctgtcctaaacgtctgagcctgatctgtgtccctcagtgtcccctaatattagtacctaatgtgagaaaccctgttcccccattttgcatttggacgcaaacagttgtattatctgtttatatttctgcccttaaccttcaggtcgaaaaatgacccattctctgcctgtgttccaaatttggggaatagatattttatgttaaagtagtttgtaaaatggaaaagcactaaagagggattgttgataataaattcctttctggagactatgctggtcccatgaaattcgtttccattccatcttagtgccagattttaaatagctttgtgaatccactttatttacaagcattctttctctttcatactcttgaacatctactagttcttacaccatagaagacagttggtatattgcaaagcagacaagatttgtaagcagacctcacaaaacatttgccatgtgacttggggcagattacctaaaatctgttctgtcaggagctactttagacttagtctttgtgagagctaaattaaaaacttctgactatgctggcacacattaggtacagctgttagttgccattcacatcaggcctggaccaccccaatgcatacagacacacattttctctcctttatctatctttgacggtatagcattttacagaaacttaaattcatatcttctgaacattgcttgtcttttctcagaccaagcttttgcgttctctttgccacaagtgcttttcctgctgtccttcatttgtttaagctctacctaccttccacgttcccagcaacagcattaagtgccggtcctccatcccatacccggaccctcactccattcttaaccttccacagcatgatggtgttctgtaactgtgccctgctctgagcttctgtaataaattatttttgcatcactgacttgacactcagcaaatacttactcttttggctgcactttctaattttccaagctcgctaaagctatttaaagaaactaattcattacccatgatttatgctttagcgccccaaatattccagtgatccagtcagaccaggtataatctaatctacatcctcagatcctcttccagactggaatcatggtacagtgctataggtgttatagaggcaatacttacagaagaataaagaatagattctgcttgctatgaacttatttccttagatatacacaaaacatttcatttgtctaaatgaagtcattggtgctttttttgtaccataaaactgttaaggtatttagaattcaaagtgtaataaagtgagctctcctgtaaccttaaactcaagatagaagtgtactcttaaatgcaaataattagaatgtaatatgataaatgttccaatagaagggtgtcatggtggcatggaaatgcagaagacttaactatttcagaaggttggggaaaagttcacaaaaaagatgacgtttgagctgggcattaaagcaactacaagaagtataaaaaagcctggtaaatccactgtctgaaacattcagtattacaggaatgtaggtgacaggaggtagagcaggaaatgaagctagcagagggcagagccctaagaagtattaaataattacaaatgtaaagtgctgtgaagggaattacctggatccctgagaagacaaaatgaaagtctaacctcatttgaagctctttggggaagctcctgagcatttcagctaacactgaataggaattaaaaatcactctggaatgagtgagttgagagataggaaataaagttgacaggacatggtgtgatcagaagtgagggattagaagaaaatatcagggatgacttctacatctttggttaagtgtgaaagaagaaagggaaggtaggggttgactaaaggtctggagtgcaaaagagatgtgggcaagtatgtcaggttaggaattatgtcattggaatatagaaggtaattgaacccataaaattggatgagatcacctaaagcaggggttggcaaactttctataaaggtccagacggtaaatattttaggctttgtgtgcagtctctatcacaactacttaattctgcctttgtagcaagaaagcagccataaaaaaattggcgtgtaaactttattcacaaaaaacatttctagatcagggcctggcctagaaaaggaacattgaataaaaagacaagagaacagagacaaaaccctaaaaacctaaaaagtcaggaagaagtagccaacaagattagaaaggtaggaagaaaactagaaggaaagttttaagatgggaagtaagtggtcaagtctgttcaacgctgatgagaggtcaaataagataaaggatatatgtgcatttggtttagggacatagtttcagtgaagggagcagaaaccatagtgagttggaattagataaacactggtagatatagacaacactgtggtttctggtggagagggaaacttttaaatcctggggtaggaggttccaatagattagaagagaatggaaaactcaacgtagtggtcttaggtcaagaaacaaatgtagtgggaataaataaataaataaataaataaataaataaataaaagaaatacagcctgggcaccatggctcacacttgtaatcccagcactttgggaggctgaggcaggcagatcacttgaggtcagtagttcaagaccagcctggccaacatggtgaaaccccgtctctagtaaaaatacaaaaattagctgggcgtggtgatgcgcacctgtagtctcagctactcgggaagctgaggcaggagaatcacttgaaccctggaggcagaggttgcagtgagccgagattgcaccactgcactctagcctgggcgacagcaagatttcgtctcagaaaaaaaaaaaagaaaaaaagaaatatggaagtaaaggtatcagaactagaacaaaagtttgtggtaaaagactgacttctaaggttcgcagatagatttctggatgatgataaggttaagactgaccatgggaccagatggctaaagggaggtacagatgaagctcctgacgtctcagtgtctgaaacttggccactatattagcagtctatgtaaccattaaaatattccaggtagctctgcagattaaattacagggagaaagtgtagaggctgaaaaaaaaggccgtagagtgaaggtctggaataggctagtagtggagagtaacaggcaaaaggagaccttgtaaaggaagaataaaccctatttggtgatgattagagggagaagttggcgatcacaccacagtttcagttccctggagaattctggtcccatcgatgcaccggactaaacttggagctaatgagttcagttaggtgttcattgacattgaagagatcatcaaaagcatttcaaaagtagtcagaggttgttgggagccctaggattatataacacatggacgattctctctttcacaggaactgtcgacaaacactcagtggaggtcaccaattgcttttcagtgccgcacaatgagtcagaagatgaagtgagtgggaatccaagctgtccctctgcagtttttagctgttcatttgctcggctcccctcacggtccctcccacactcataactagagctcctgtagccaaggagcttcttcccatttgtacgtacttcctgggcctcttctgtttattgggggtggcctcttgtcctttttaaccaatttttctttggacttctggcttcttagcttgctttcctgccttccctcttaggtggctgttgacatggaatttgctaagaatatgtatgaactgcataaaaaagtttctccaaatgagctcatcctgggctggtaagttggggaggtgggggctggggttaatggaaggtctcttcgtgattgccggtgtcttttgctactggactggatcttatactcttccttttggaggcaagagtattgcaagtgtattactgactgtgagcagtggctcaatgcctgtaatcccagctgggaggctgaggcaggaggatcacttgagcccagtagttcaagatcagcctgaacaaaatagtgagaccctgtctctacaaaaacattttttaaaaacttagccaggcatgatgacacacacctatagtcctagctattcaggaggctgaggctagaggatcacttgaggccaggaatttgaagttgcagtgagctatgatcatgccttgccactgcattccagcctgagtgacagagtgcgaccctgtctctaaaaaacaaaaggaaagtgtgttacctgtaggaactgtgaattcagtgggttttgctggtggttctgatcctgtggggccaggatatttcgaattaccttgtaagtgacttggaatttttcatcagcactaagtcagcctttgattttatttgacatagttttcggtgtgtgtattgctcttggcagttggtgtcactaggtgtcctaccgtagaagtgtccggtaccctgaagacacccatgccactgttgtgtttgatattgacgccacatatagacaggagtccaccactgtgttccatttcacaggtacgctacgggccatgacatcacagagcactctgtgctgatccacgagtactacagccgagaggcccccaaccccatccacctcactgtggacacaagtctccagaacggccgcatgagcatcaaagcctacgtcaggtgaccacagtcttgggctacaagggcataaaaccatgcccagatgccatccctcccccaccccaagcaaggttaattccttccatgtgtaacttgctgtgtccttaggaagcctgttcctctctctcaacagttattctaaaggtttcactctgaaacaaaatctgttcctgtaatttctaccgctgatcctagttgtactccagtttctactcattgcccttttaagtatttgagcaagctgtcaagtcatcttttgtaggacctaactattccatagttcctacagccaatcatcacatggtattcttgtcatgatccttcaccacattcattacttttctgaattacccattagtttgtcattatctctagaactcagcacagcgctcagggtaatacagattataaggatgactgtccttattttgaacacatttattaacccaggattgagtgcagttttaatgacaatgacattacagtgaacacgttgagcttgcaggtggttaaaatgccagttatgggggatgttgggaaaggccctggtggcatgctgaggaagcagctgtggtagttggaaagaccatggtcaaagggaaggcagctgttagtgcatctgtcaggctgttgattttgtgctggttctgtgtctgacactgacatagccagttaactcttacacagtacacagtaagacaaagatggtggatgccaagtctttatgagccagttggcataccactaagcactagccattgcctgacttcttaaccttcccaggtatttcagactcctcaagatccagtatatatatatatatggatccagtatatacaatatatatataagatccaactatatatatgtatatatatgtagatagagaaagatatatatagttgacatagtaaagtatagatccaggtatataattgacatagtaaaaagaatacctttagtgagatgacttatagcacccaatgtaatttggtgggcaggagttggtttcctttttcaatgctgatgaagggcgtagtccccgaaaagatttgtctctgtctcctttccatggtaggtagctgtctagacagccagctctacggggtaattgagtcctgtcctctcgtcactgacactgcaccgtgtgtgaagtaatcctctaaagggaccaggccaaatgcaaaggccccccttacagatcaagggtttggtatgtgggaaaagctaaggggagaaagtaacttttgctcccatgagacctctggggttcatttggtcccaccctttctatcagaaccttgagagccatattcctgctgtatctgctttctcagcccagaatagacatggaaaccctctcccaaggccatctgtttactttggcttctccttccgcagcactttaatgggagtccctgggaggaccatgggagtgatgttcacgcctctgacagtgaaatacgcgtactacgacactgaacgcatcggaggtgagtaacctttccatacactcgcgagaggccataggcattttcagggaagggggctgctagtctgcaacatggacggaggccttgggtggtttgaaaagggactattgatctaaggtttgtgaagactagaagtcacagtcatctcttgtataaatgggatttaaggagttatttgagaaactgttaaaggtgggaaatgatcagcaccagaggccacataccattcacatgagatcaaaaccggtgatgagcataccaggtaaaaggagttgagctctattaggaggaagaaaagctgataagggcacagcaggaagtgtgactgagcagactgagtctaaggggagttgggaaacagagttagtaggacgttaagaccatctctttcctggtgggatgactgaattctctctcttactgcccaccactgccgctgccaccctgccaaccaacttccatagttgacctgatcatgaagacctgctttagccccaacagagtgattggactctcaagtgacttgcagcaagtaggaggggcatcagctcgcatccaggatgccctgagtacagtgttgcaatatgcagaggatgtactggtgagaggggaaagaaaaaacaaagggggaggacatagttctctatcctgggatcactgaggcatgtgctgatgaaatggtagggctcagtggttataattaactgcctcatcgagtctttgttttggtactcagtctggaaaggtgtcagctgacaatactgtgggccgcttcctgatgagcctggttaaccaagtaccgaaaatagttcccgatgactttgagaccatgctcaacagcaacatcaatgtgagtgcccttcctgagccccttcttgcctggtttcttcccccacctcagcacatacactcaaatgtgaaaagagttgggtgaggtgacctggagtaggatagagacagggcttcacctatagccccactgaagtccaggttgggaggaaggaagaggtgtgttatgcgtggttggagacttccttccttctcccatgattccattgtctcatttactgctgatactactgtgacttactgtctaaattcgtgatggaaagaaacactaaaattcagaggttaatgaaaatgcaattacttatttcccccatctgagttcacagaccccctatattccatccatgggtttcagctaaggcacccctagtctataagtgtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaaagaggtttccccaaaacttcagaaaattcttaggtgctatctgtaactcgaggatagagccttgagttatactgaggtctgccagtggctcaatttaagcaaagactagatggcatttcccagaggccttgtaggctagagtacttgcctgtgtaacttcagacatccatttcctctggtatcctggagttccgcctcgccactgtgtgtcttagaaataagtcattattcaagaactcaggaaattatacgttggagtgaaaaggtgagtgaaggcaatggggaatcaaaaaggcctggatcctagttctgaggtatgtgtagccttaggaaagataaattataagagtcataagatatggatcataaacatacatagtccattagggtattatgaggattccatgaattaataaatgtcaggttaatcaacacttgtggagaatatcacctggtatgtagtaagcacagataagtggtagatactatgatgcctaaaggtgaatagtttgaaagtaataagcaacatgaaccccagcctggaactcagttctgagatatgtacctcaggaaatataagttatgggagtcataaagtgtggatagtaatgatagataatttcttacaggtagggaaatgtaaacagatcttatcggcaaaatgataatgacaggccaaattgttaaaggtaggttaaaagtagacagcatggtgggaaggttaatcagagtcaaaatgtttcagtgttcttacatttttgggagtagccagttaatatcaacttagtctttttaagtatgcatgataaaattccgaggttaattgctagaagtatatataatctctcaatgaatagtgatgagagatggtgggataatagggaagaaacaaaattttaaatttgagaaataagcatagaaaaggtggataaaacaaaagatggcaaaacaagtccaaatagatcagtaattacaataaatgtataagtattaaactagcccaaggaaaaattgaatattaaaacaaaccccaatcatatgctgtttacaggagacacatctaaaacaaggacataaagttgtcctgcagctgtgagtaacaatataggtgaatgttaataataatgttgaatgaaaaaagctggtgtcagaagacatgtacattatgatactccagaagttcaaaaacaagtgaaacttgtttagacatgcggttggctgtctgtatatgtgggttccacatctatggactcaaccaactacaggttgaaaatattgagggggaaaattgtgtctggactaaacctgtacagacatttttccttgtcatttttccctaaacaatacaaagtattagatggtgtttatactgtattcggtattataagtaatctagagatgacttaaaagtatatgagaaggtatgcacaggttatatccaaatacttcatattagggacttgagcatcagaggatttttatatccaaggaaggttctggaaccaatcctccacggatactaaacggtgactgtgtgtgtatatatatatgtatagtctgttctcattatctatagtagttatgttttataaagtcaccatgaacactgaattagagagtactgaaccattattcccaagggaaatacagggttgggttcctatgaacctctgggcacagtttcatcaacccatcagtacataaacttgttacatgtgtttctgtttgaagacaccttagtatatatggttgacccattaacactgaacttagcccacgacacttattcctgaatgaagcttacctcagtttctccaggcggcacatcacagtcttcttgcacttaggaacacttggcactgtgcgtgggggtcactttaagcagcaaaatccacaaaaatgcaaaagacatggcactaaatagactgaaaaggatacttgtttataagaactgaaacaagaaggccttgttccacctcagctgggaacatggagagcaggcaattcaaattttttcacatgctgcatgtccgcaaatggctgcaaaagcccagcaagtactgatactggagttagaaataaattttagcaagaggtaaattcacacatacggagtctgcaaaaaatgagaattgactattatgtgtgtgtatattatatatatgataaaaaacaaaagaatgataaaaattcccaataatgtttactttggtggtgagaagaggatggcaagtaaaataagtctgtattgttatcagcaattatctagtttgaggttggacagtggtttcatcataggtattgattatattataaatagcccaacctgaactcatgaccatagtgtggtgttattacttagcgttattctagacttattagccattgtatttaaacaagaggaaatagagacattgaagataaagtggagccaggcacagtggctcatgcctgtaatcccagcactttggcaggctgagatgggttaatcaagaccagaagttcaagaccagcgtggccaacatggcaaaaccccgtctctactaaaaaaaaacaaaaaatacaaaaattagccaggcgtggtggcacgcacctgtagtcccagctacttgggaagctgaggcaggagaatctcgaacccaggaggtaggggttgcagtgagctgagatcgcaccactgcaccccagcctgggtgacagcaagatcctttctcaagaaaaaaagtgaaaaggaggagggtttttaaaaaattagtactacccagttgatacggtggaagaaaacttgaaaatgctaatgagaaacatgagatgtaatcacttgaaggcatatcatgttcttgaataagaagactcaacattattttaacaggtgttaattttccctgttaaactacatatttgtcataattacaataaaatacaaagagctattttggaactgggcaagctgtttctaaatgtatatggaaaaataaaaatgtctccaaaaaatccctgcagagggaaactagcccttccagatataaaatatattatagaactgtgtaattaaagcaatatggtactggtccataaaagaacataaaaccaaatagttcagtagactcaaaatgcaagcgttggtgagggtatggagaaaagggaacccttttacacttggtgtgaatgtaaattagtacagacattgtggaaaacagtttgtagagcttcctcaataaaaacacatatgatccagcaatcccactactgggtatatatccaaaggaaatgaaatcagtatgttgaagagatacttccacgttcactgaagcattgttcacaatcgccaagacatcaacctaagtgtccatcaacagaagatagatagggctgagcgcggtggcccacgcctgtaatcccagcactttgggaggccaaggcaggtggatcatttgaggtcagaagttcttgaccagcctggccaacatgatgaaaccccgtctctacaaaagatacaaaaattagccaggcatcttggagggcgcctgtaatcccacctactcgggctgaagtgagaatggcttgaacccaggaagtggagatttcagtgagctgagattccgccactgcagtccagcctgagcgacaagagtgagaagagtgagacttcatctcaaaaaaaaaaaaggtacatctacacaatggaatattattaaccttaaaagaaggaaataactgatttacaacaacatggatggacctggaggacactatgctagtgaaataagccatgatctcacttggatatggaatcacaaaattgaactcacaagcagagtgtagaaaggtggtttcatggactggagggaggggataaatggggagatgttggtcaagggtacaaagtttcagttaaacaggagtagtacgttccggagacctgttgtgcagcagggtgactagttaatgtatacttgaaaattgctaggagtagatctcaccaggagaaatgaatatgtgaggtgatggatgtaactagcttgattgtggtaatcaatttcgcaatgtgtacatatatcaaaacatcacattgtacaaaatacatacagtttttgtcaatttaaagatatcagaattctagaatatgataaagttgtgttttcaagcaagtaaagatagattacttaagagcgaatgagtggtaatttggaaacaatgttggattcctacttcgttacctgcaccaaaataagttgctcatggaataaaaacttgtctgaaaaaaaaaccataaatatgagggaaaaaacacagcaatgtgtttttaatgatttatgagtgaggaagaactttctaagaactgagaatccaggagttattttaaaagactgacaaatttagcaacatttttaaaatctgagtgtcaaattacacacatacacaaatagtcaatacaaatataaaactgggaaaatatttgcagttcatatcaaaaaaagggctaatattcttgtcccagaattcctacagttttttaaggccagtaatttgatacattagtgtgtaaaggatatgaccagacagctcacacacagacacacaaatgtgaaaagatgcttgatctcactgataaagcataaattaaaacgatgtcatttttaaaaatcagattcgcaaattttaaaagttgctaacactggaatggccagagtaagaggaaacgtgacacaggcacagattgctggtagacatataagttggtacagccctctctatgtaattttgtgtttgtcaaaattacaaatatgcatgcccttaacccaggaattccactcctcattatatatcctacaaataaactggtctcgttatgacacaatgtaatgaatacatagataagtactgaaatacttggttatcatagcgtaaagatggtaatcaacccaaatgactattaccagaatagaaattaaacaaagtatgatatatccataaaacacaatactatgcagctgttaagcagaatgagacagtcctctatatatcaatatggataaagagtaagtgaaaaaagccaggagagaatgttgtctataatatgctgttgttgtgtacgggaaaataaataatataaatacctagaatatttgtgaaggtacagccaagaaactactatcactgattgtcttaaggtactagatggggcacaggacaggacgaaagatttacttcttattgtttcttctgtataacttttgaattttatgctgttaatgtaatttttcaaaaaaatatataaaaatataaaaacatgaaaaacatgaaacaataccttatatttttacatatactataaaaagtaggaaatattgggaggccgaggtgggcagatcacctgaggtcaggagtttgagaccagcctgaccaacatggagaaaccccatctctactaaaaatacaaaaattagccaggtgtggtggcgcatgcctgtactctcagctacttgggaggctgaggcaggagaatcgtttgaacccaggaggtggaggttgcggtgagccaagatcacgccactgcactccagcctgggcaacaagggcaaaactccgtctcaaaaaaaaagtaggaaacatgcgaaaaatgataaaatcaaatttaagatactacttctggagagtaaaagaggaagagagggaacagtattggcaagggatgcagacgtggtttcaattatatctgtaatggctttcctttaaaaaataagatatggccaggagcagtggtgcacacctgtagtcccagagactggggaggctgaggacggaggatcctttgagcccaggagttcaaggctgtggtgcacaatgtttacgcctgtgaatagccactgcactccaacctaggccacttagcaagaccctgtctataaaaaataagatatgaagtaaatatgacgtaatattaagtacataagtacttgttattatttataattttctgtaagcatatataatatttcattaaaaattagagggtagacctttatcttgggaagatgtacatactaatttaccatgtgcccagaaaattaggcctccacatgggttttcatttgtatatgaaatggctcagaaatgaacaagaactaggagtcacccaatttatctgcttccagagtgccccatgctccatcatggggctgctcccaggcctcaacccctccacttcacagctctttaccctgcctcctccactccctgttcaacctcctgagtaacacttcagggccccagtgcaaaatccaaccctgccttctttccttagaggctgctcagagcctggaggctttgaccctcttctgagaagtgaaggacagaagaactgagaccctgaccacctctcaggaagcttaacttgttcaagtcaaagccaaaagcaggacgtcttttctggaactgagattgtaaactgctataagagcctagagaaggcatttcactgaggaaatggaaccagagccctggaatagagcttacaggatgcccaagaggtatacctggaagtgagactaggctgaacaaggcagaggtaagctgtggcccagacacaatgaagagaccaagagaatggtctgtgaagacatgttggtaccaagatagctgaaggagcatccagaagcttcagaagagagggcaggggtgcctttcagggtgatcacaccactggcagtctgaaagatggattggagtcgtccaaatgagcagtaaaggtgtcctagggcgggatgaggcccaggaaatggagaggcagaaacacacaagagaaactggcccagtgctcctgagacaggctgtcccaccacctgcccgacctggagtacaggctgagcaggaagtgaagtggaagcagtgaccattgacagcgcttaggaagttacggctgagatggaatttccacagtatatggaaaattagaacaagcccacaacacctataactaaggtatcgtttcaaagttccccgcccccagctgcctgcccaccctaccacagtaatttccctttttgaggctgtcgacaattttacccaaatctctttctacccagcccttcaaacagcttcccaagaactccctagccgatcattttcctgactagaaccctcaaattactaatccattttattcctaaaattatatcacatcattctactgaccagagccacctaaattaactgatcctttcaaccagtcccacataccatgccaaccaccctgccctactaagccatgggcccaccaccccaccatttctcacttactctctattcccctgagaatctgttcagcaccagttacccagtggtagtgaacttggttttgatggttgctttgacagagaacattagcttcataggcataaattgtatgttcctgtaccttctcagatgggcttcaatttacactgagatcatgagcatttttaccttaggggaatctttatccagtggacaacctgacaccaaacccatggatgcactgatcctatggaaccccaacctcaagggcaccttgatcacttgactcagaagggaacatggcaaccccgagggaacacatcatccccaggaacactgactctctgtgcatactggctgtgtaagaactctgtctctgtgggccccctgacccagcaagcagattaatctcaggtggcaatgagtccctaaagcatctcactggcccgctgaccccaggtacactaacagcatttgctccataggcatcattcattcatttagcattcactgggcttctattatttgccaaatattatgttagcattgaatgaagaaatatacactttatgataactggggggtagaggagaaggggaaacaggcagttttggaggctgtgtctatctccagctggtgggcggagggagggattgaggcccctttcctcttagcggcagctcaggagggatcccaggatctgtgcttccatctggatcaggtgaagcacacacagtgagactgtctttttgctctctgcaggggtgggcacaggatccctctgttcctgttgctaaattggtctgctggaggactgcactatattctgaccacctctgtaagggacaagggatatgtatgaccttacaatgactttggtgtgctctctattagggccagacagggagggcaaaccagctcacaaaaatctcagtctccttttttgaacaatgatatttttattgttatgagtaacatttatctttaaggattggaaaatatagaaaaaagagaaagaaaaaaatagaaataattcaaatttgccctcaacgatcattattgttaacatgttgtgccaatcccttttctctacaaacaactttttttaaaacagtgttttgaattttctattttggctttttttaaactaaacattttagaatgattattatccaggtcattaaatcttcaaaaaccttattttaaatagttttataggttcctgttatacgggtaaactatgatttacttaagtgattttttagtgttgggcatatgggttctttctgattttgtgctaatagatatcttccatggtcgacaactgtgtgcagacataaatgtctgagtttctgcttctttaggtcaatctctcttccctgctgtgtgtcatactttgtgtcctgggaagcccatgtcgtgctgctcaacttctgggtttgaaggagaccatcaggaaaatgcacctgtggctctgcatgccccctttccacaggattcagacactacggacggagggcatgggaaactgagaagggaccagagacaatattattccactttttgccctccaaggcccataccataaacctccccaactcctccattgcccaagccagagccctcatgaaaatgaactcaatcaaattaacttttgaagagtaaacgagattctagggacgtgggaacctgatcgcacttcctttttcccacccacaatctatggccactcctgagcctgtgggctgcttgaaggcaagtgaggccttgacctctgctggaatcctaagagagagaattatttagagtctcatgggtcaggagagtcctgggaggccagtacagagggtttctagcaaggaccagaaagctataaagctgggaagaatgtggcccacagagatctttggacccatgaagggaagcaagtgtgggggtcttgctggattcttgctctggcaagaaggattgaacaggtaaactgagtcttccctgccctgacacaggacagtgtaatgagacaagggcttcagcagggcactggtgtcttacctggttctgccccatccatcccagatagactatttcccctcccagcacccacagagctgccaacaacagccagactcaaccccaacaagcttcactccactctccttagaacatcgaggaatcagttcttactgaaagtttacttggtgcagcctataactgtgacttcaggttctgagcatatctgatgaagaaattagcattttccccacatactagatatagtcagcatttccaggagtgttcaaagagaacccaggttgtttaagatagaaatctaattgccagcactgacttgcttctcgttgcagagtctaggaatccatgcatgctcagtaatgcaagtacttgcaagctgacaaaattccatttgtttgtcccccttattccccttatcaccagcgaagtctcccagaaggcaagcagttgcctatggcgatgatctaagctgtgaattagatgtttgtcccacaatagtttgtctgatccatcttgtctgtcagtcctgtgaaggtattttctgtctcattagggtcttccagtactttgcttaagttttgtcccatgatgatggtcatcaattttataatggtctctgtcccacaatgttggtcccaactataacaggccaccagtctcaggagcattgctctatgccagaggctttctgagtcatggccactagaggacacccttacaccacttaaaggccaaaggttgccagtggcattcccttagttcctgagctgttttctgagggcctgcccagagaaagcaccttctgctttggagaggtcaggatggtgccaaaaaagtgaccaaagcttttggagctgcttcccttggccacctttgagccacagagtgatgaaaccaaaccatcttcctctatccccacccccaaaatcactccaaataaacacatagtatttctaaacttggtttgataacacagtttcaagtaaatctatggcccactccccttccaatcagattataatctgcaaacccctctatacagaaattctggagctgctgttgcccaggagaaaccctagctcaggacctgacaaccaaaatgaggttcctggagctttccttccagggaaagggtgatgcttataagagaacctggactttccacatggtactagagttctggacaggaaagtgagggactcttgccaaattctggaggttagagaagtgagaggtacaagataggatcctgtccaatggtcccagtaaaattgctttgttgattggaagtgcaagggatagacagaggtaatggttagctgacaatgggagccccagatttagatataaaaattcagctggagggaggacatagtttgggtccccttgcaacagaacatgtggcaaagacttggggaaaaatagtttacgtgtgaggtgatctgcatttgattcctatggttaccataataagtacaacagttcacccttatccatgcgggatacattccaagacccccagtggatacctgaagccatggatggtatcgaactctatatatactgtgttttttcataaacatacatacctatgataaagtttaatttataaattaggcacagtaagacattaacaacaataactaatataaaacagaacaattataacaatatactgtaataaaagttatgtggatgtagtgtctctctttctcccccccccccagcctctcaaaataactgtactgtactgcatgtaactgaaactgcagaaagcaaaaccatggataaaaccatgaataagagggggctgttgtatcataaatttggtggcttaagacaacagaaatctattttttcagtcttggaggctagaagtctgagatcaaggaacggtctttgatactgcccccaaagcctttatttttttttattttatctatttatttttttgagatggagtttcactcttgttgcccaggctggagtgcaatggcacaatctcagctcaccacaacctctgcctcctgggttcaagcgattctcctggctcagcctcctgagtagctgggattacaggcatgtgtcaccatgcctggctaatttcttgtgtttttagtagggatggggtttctccatgttggtcaggctggtctcaaactcccaacctcaggtgatccgcccgcctcagcctcccaaagtgctgggattataggcatgagccaccgcgcccagccaggacttcaacatatcttttaagggggacaaaactaacccataatatgatcttagaagtaaaagcaaatggagactaggatgggaagaacttaatgcaactgaaggtatcaagctggttatttctgcagcaacagggactcagtcccactgaggaacctccaaggagccatgtgacatacccctcagaattctcccactgagggactggaaggctggggaatttagcctgttaccccactggctgaagaattctcctgggaggctggctaacttcctcatatttagaggctacaactacagtagggctgcatccttccctagctaattaagagagattgaggtgcgatgtgagccctgcgtgtggggctgtccaccgccacagtgctgaaatcaaggaggcacccccagtgttagagagggtaccccccttacactgctcagatctgctcctcccccacagcaagtccacactatcactgactcttttagagtgtggactctttacgagtatgcaagctcttaaaaaaagaaaagggactttcaggagtagaattagtggaataaactatagtcgcctgtggcagctggtcctcagccacaattaatattcatcatctccccgctccccctccaacccaccaattccagatttctttcatgcctggtcaacactaaagttggtctgggctgctcttcctgagggcctgggcccttgactgtcttgccactaccctactttgttggctgtggttggctatgcaccattatccctcagcatgaaggcaccaaaagacactccagcgaccaagtttcagatgaatcctccctgcctcattatgcaacagccactttagcttctcagaatgggggttgattgccagctccaatatggtaacttttcttatctgatggtccactcgcaggaggagcccaaagtgacccagcaatagagtcaatggaaaacttctcatgttaaccagtggaagatttcttcctgagaatcaggacctctgttgcaatgaagcctgctgcagaaatgggaagcacagtttctgcaaggagctggctggggtgatgatgaaaggggccagtactatttctacctgttggttactctggccctgtgtgttccaacacagcactgtatatcatctgatagtttagtgcatatactacaacttggaggacagtgacccaacccacagggtgtcatcccaaagctggctccttccctgggctttaataagccactcccactttctaccccttgtttacaaataatccaatatattagaagactcattttttttttacaagaccattttcatgatcctttatcataaaatagacacttgagctgagacttcattatgcaggatcccatgccgataaattagatactctatagccgggcgcagtggctcacgcctgtaatcccagcactttgggaggccgaggcgggtgaatcacgaggtcggaagatcgagaccatcctggctaacacggtgaaaccccgtctttactaaaaatacaaaaaattagccgggcgtggtggcgggcgcctgtagtcccagctactcaggaggctgaggcaggagaatggcatgaacccgggaggcggagcttgcagtgagccgagacggtgccactgcacttcagcctgggcgacagagtgagactccgtctcaaaaaaaaaaaaaaaaaaaattagacactctataaaccactagtgaagcacaacaagaaaggaagataaatcagaaaaggtgtccatcttttctttgtcaataaggacaaactgtgccccctcagggtggaaggaatctgatgtcattaacttatcaccaagtgctggggcagtcccatcaaggaatgacaccataaccaggatccagtctctctgctgcattcagcagcaatggcaggtaaataagccttggtaagagggagtccctgtggctgggcctgtacagagctttcatctctgccttgttcccgctgcgttcatgggcccaagctcttagttggttgagaattgaaactgactgataatcaccagacaaatccttcttcctacctgctcattgagtgccccctgcacagccgatgctctctgatgggcattgacaggaggcataaagctctgcacagtcttgtcccactcccattagtccatccacttgcatctcccctatacctccttctccaatattccagtcttgcttcgtacaggcctgtgacctcccaagtgagttgttctccagtgcctagaagtccatgtgtactattgcctcaggccatgcctccctacatacaaagtggatggccaagtgtactgcccaagtctcttcccccaggaggatgtccctctccactcagcttaagaacctctcctgagtgggtgtgtggtacagctggaattcatttttgtttcacactaccgtatccagccaacccctccatacatcaggctcagagtttttcctcctacagcagtggtggtatgggacactcccacaggaaggaggttggagcaacagggatagatgacagagtttgaatcgtgtcttcatatagtttacttgtgccttcggcacctgtctggatccaacaccaaatcattgtcatcatacaatcatacaatgaattgctagtttctgactggtgaactggtaaacataaaacacccagttcatgcctgggtgaatttatgactggtgtcccagattactatgtgcagatctagtcacatagtgtcttgatgtcccacatcaggtattcaagctctattagggcccaggagcacactagaagctctctctttgcaaatatgagtagttctctgctgcagaaggcagggtccagctccaaacctaaaagctccacatgaccttccagagactcagcacagggctgttatctaacacagatacgtctggcactattggacttgcaggtcatcaagcccaagagtcagagcagccggcacctcagcttcaatccattgaaggtgcctttcttgccttagtccacttagaaatcaaataaatagtggatcatctggcctcatataataaatatatttcaacctacgtctctgagcctcctgactctcaaaaaactgccaaggtagtttctttcttaggttgggtttgcagaagtagacactgaaacaaacattcatattcaagtgatttattaaggaagtgctcagtggtgtgatagtaaatgagtaacaactggctttatggaaagaaaataaataagcttgataaataaatcaagcattcaacaatttccacaaatactctatagtgagtacttccaccatgaccagtttaaagctaccaacaggatatctctgaatatggagttgggaagagttgctaacaatcagcttttggaactagccagtgtcagcacatcactgaatgctgctagggagaccagtaaaagagtgggtgtaggaggacaagaaaaaaaaaggaagtcaagcaagagagtgatttcaggcaaagtctcatagaggtcagagttaacactatcctacagggaaaccctggaatacaagctacacctcaacgttgtctacacacaaggcaaggttgcttcgctctttcactcctgcacctgtcaggcttaggcaagggccatcccagcatggaggcagatcctaggtacctatggctctttttaaaggtgagcaaagtggttccagctgtgtgaaggcagtccttggagaagaggtgcaggtgcttgagttttgggggcccttggaatattctgactgatgaatgtttttgtatccctggggccttgggagaggctatatcagtttgacccaataagtttatcctaataaaatgacttaagatgaactcttagtttggctctgggggtgggggagagggagttattggggcagcgaggccagttacacaggctttgtatgtctccatgactgactcctcattaagagctttggacaacaaggcttgggtgagcttttccaattggcaacaccaccatgggttgtcacacactgttgctgggagaatgaagtgagtcctcatgcaactccaccgggagggttcacttggaagcctgtggtttctcctggctttgctccaaagcctttcttctttgctgactttactctgtatcctttcactgtaataagagataatggtgagtataacagccgcttctgagacctatgagttattctagtgaatcatggagcctgagctggatcttggagacactgacacagaatcctttcaccataataaatcacagtcatgaatacaattctgtgctgagccctgcgagtcctcctagtgaatcatcaaatctagggatggtttgggggacccctgacacttcatttcctaaactcctgataaagagggatttctgtgtcatcctgctacctagagaaaggaaagtatctgatccctgatcatcttctccataagaactaccttgtctcacctggtcctcgttggcatgccatatacctctactcatgtttgccatcccggcatcatctctctactcacctggctcatgtgctttgcatcttcctcacccaaacattgaagcccatttgggtccatctgtcctcttagccctttaatcggcctcaaggggagcccagaactttctatggcattttctgacaccaagctaaggaaatgaaacactgtgaggaccctgccttcaggaccattagcattggttgactggcccacttctggctccaagcagggatgcccactgacttccctcgggcttctattatcccagctcttcctatttgctgccttttattatttacatcattataaatatttgtggcttcagaaagaatgtgatgttctttctaaagttacctgggtaactctctcttaatacttacttgaattaactgcccatctattttcagatttaactgtttgaaaattcttaataatacattaaattaaaaactcacaattatacagactgcagcatacagtcatgcaactataaatagatatggtagaatttcaacttgcaaagcacaaaaggcattttttttcctccaaattctacctaaaatatgcttgcttggcctggcatggtggctcacgcctgtaatcccagcactttgggaggccaaggcaggcggatcacctgaggtcaggagttcaagaccagcctgaccaacatggagaaatcccatctctactgaaaatacaaaattagccaggggtggtggtgcatgcctgtaattccacctactcgggaggctgaggcaggagaatcgcttgaacccgggaggcagaggttgtggtgagcagagattgcgccattgcactccagcctgggcaacaagagcaaaactccatctcaaaaaaaaaaaaaaaaaaaaaggttgcctatatttgagagcaaatattcaaatattaataataaatttaaataacatacctaattcatgctgtggcagttgtacacaggttagagatgatagtaactcacatgatcatatgatcattggtcattcacaagttcagggatgccagaaatggcatttagtgacctgaactgaaaccaaattatagtttatagtttctgtctcttctgtctacagtaggaaaaaaaaaaaaacacagaacaacaacaacaaaaagcatataagtaaatctttttccaaattttttaaacgccagaaccttaactcctgatactcaataaaccttttcactgcataaacagtcccactcttgcgattgtccttaaaatctatggctttcaaaaatggttgattctaccatgaattttaagagcttcccccaccccaccccatcttaggaacaaatggctgaacattcacactgatgactatctttgcccacgcagcttccagctccccccgccccttgctcagacttccaaatagcccacagcaggcatctccaccattcactgagagctggagctatcgagtgtggtgctacatacctatctacgatatatgaaggcctgctccttcctctggcagcagagtgagggatgttaagaaaagttacctgtcacttctcagaacttctcagatccctatctgtactcctttcttcacttgcagaaagacttgaggactcatagaagggctgagagggtgctctatgtgaagaatctcctgccactgtgtgtttggcaggcagagataggagtgggggttgtcttagtctagttaggctgctataacaaaaataccataaactggttggcttaaaaacaacagaaacggctgtaatcccagcactttgggaggccaaggcaggtggatcacctgagctcaggagttcgagaccagcctggccaacatggtgaaaccttgtctctactaataatacaaaaattagctgggcgtggtggcgggcatctgtaatcccagctacttgggaggctgaggcaggagaattgcttgaacccaggaggtggaggttgcagtgaactgagatcgcgccattgcactccagcctgggtgacaagggcgaaactctgtctcaacaacaacaaaaaactcaaaaaaccagaaattgacttctcacagtgtagaggctgggaagtccaagatcaaggtgccagcaccattcagtgtctggtgaaggcctgcttcctggttcatagatgttgatcttctcactgtatcctcacttggtggaaggggattctcaggcctcttttataaaggggactaatcccatttccaccctcatgacctaatcacctcccacaggccccacctcctaataccatcgctttgggatttaggtttcaacatgtcactccggaggagacacaaacattcagtccatagcaggagtgatttgattgcaatgtggttattcagctgggcttctgaagatgaagccacgctctgtgagtgtgagagtagggacggaccattggttggtgaggttattcaaggtgctagtcatctggacgtgaagcctgtctctcagaacagaaatgagcttcttcacctcttgactttggggattgtcaggatgtctaggaaagaaatccggtagcaagtccaccttttggaatcagagtatagatatctgcagatggccagtggaatggtgcagggtcccgggccctgcatttatacattgcatgtgataactctttattttcctgaatctttcctctaaaattaatgaagctagtccttcctagctgcagtagaggatcacagggattgtgctaatgggaatgttaaacacagaatgttaaagggaaaccattgctgcttggggtaaaatgtggtggcagtgggaatggaaactaaagggaaagggtgggtcttaggagcacattggttctagctagcagaattttttttccagagttttactctggagataatggaccatgttttagcctgggaagtggtttctctttataactctccatctctgctgcaacaagggatctttccttccaggttttattctctgaggacatacattcccaggtccctgttccccgttttgccatggtaagcccttggtcctaggtcctggttttgggtttcttcattgcttgcttgcttactgcagagtagccagacccctagttccaggaccactggccacacatcttcacagtctgaagcttccagccttctaaggttacaatttcctttaaaatccagatagactatctctagtctgtcacctttcatctggggaagtctagtatgctcactgacatgcccagggattcttgggaaggggcatgccctcctggtctcctctgcatgtgcattcctgctcctaacttctcagtctccaacaagctgccagggttgccgtcctcccactacactttatcccacaaagtgtcccactgtggacagtgccccaccttctgcattccctaagcatcattcataggaggtggtggtatatacataccagactttttctgaaagtttcgaggtaatagagcagcaccaaggagcaggaaccaacttaaaatagaacattagacatctccattcctcgagttccttggccatccgtcagaatttctcaccagttactttccttcttagagtccagctttctaccatttcaccttctttttactcaagcttttctcctgtatcctctcttctcccagttccaatcttacccctacaactcatcatttagctacaagaagacaactcctgaattcctatcgctcctctgtgcagagcagctcatctctgcagatgaactgggacccttcctgccataaccaaagggccatgaatcagctttcaaggaaaaagaaccagttcctcggagatgaattctgcctgcctggttatctacggtgtaaaacaacaaccgtttcacagtgttcacagattctctgggtcaggtcagggcggagcaaggatgacttgtctctcctttgtgatgtatagggctcagctggaaggctcaagcagttggggatgacttaaagggctaggggctgtaatcatctgaaggcttcttcagtcctatgtctggtgcctggctgtggggacttgaaggctgggctcagctgggactgtcaattgaagcacccacatatgacctttccttgtagcttgggctttctcacagcatggcagcatcacagtagtcagacttctaacatgtcagcccaggggtccagtgaacaggggatgttgaagggcctttcattacttaacctcagaagttacatagcatccagattaaaggggaggtaacatagaacttgtttctcaacgagaggaatggaaagattttgtggccatgctttcatattgccaaacgtcctcctcctacagattgctgacgcaccgctcctggcattgataaggctcaaaaggtcctacctctacagcttcgttgggcttctccatctgcttagcccagagttctcctaaggatgtctggggtgtagcttctctacagctttcagccttggttcaggacacctggccttgggcttcttgtttgtacttctagagggtatcaggattcggaagcgggggctataagagccaatagcaggtttactggcttttgtagctacagtggcctcaccaaggcaggctgcagggggctggcagccagtgcctaaatgtcagcctcaggaggcctctgtgactgctggttctgagccagcatggattgggatggggtagccagtcctttggagaagggacatccttaggacttgtcttatgacatatggatcaggagcagtagcctctggtcctgcagtttctgtgggggaccccacaaactcccacacattctccagagggggaagctcacctctgacccctacccctaaacaatgaaataactgtgttcaaacagttgcaacaagttgattctggagttccaatccactactgctgaggtcatgggtatgccaagagcctcactatcaagatgtggttcaggaatactggctttttgggggagtcagtccttgcacaccagtctgtaaactccacgagagacagtaacagtgtctacctggtacataaagcattttgctcagtacctggcccttggtaaatattggttaatgatgcgtttgggtagctctatgagcaagttgggtacttcagtggttatagagatggctgtattgcacagaaatggtaaacttaaaagctataaggaccaagcaagtcatgtaagagaaaagctggccagctagggccagaggcttatagaacaacatattccctgctcccggtgcagaggacagccactactgcgctctatgcctgccatgctgaagacaggcccagcactggcagacattcttagttttcaagagaggataaaaagctagatctattaaatctcccaatttttaagtgttgtccatttattcagtgaaaagcattttttccctgtgattgtgggctggatgcaacaggtgcactgccagttgcaacctctgtaacccatagggttagctctagttcacaggagttgtcaggatccttggattagcgtagcgcaaaccctacctccccctcctcgcgctccagcctcctggcacctccaccccaccctgaccctggcgtgaagttagccagccaccccacagcaactgcccgaaaggtccttcttaggctcttgtgacctctgcaagaagattatacctgtaaatccctaaagccatcagcctaagatgggggatgggaagggactgggggcccggggcagacaagaaggcgcgagctggctctccctgccccacccctccccaccccgccccacccaggcgggctttctcgccatagccttccctgggtcactgtcagacaagctcttccctggctgagccaagacacttggactttttccaaaggatttttagtagtaatgaagagaaagcacaagggacataaacagaacaaggtggcctagaaatgggagtgtttacagagcttggtcttcggaacccaagagggccgtaatagaccagatagcagggccgagggaatccacccgggagagagggagggagtagtggatttccattctcagtaaggagggaggcagttggaagagaggaggggacggtggtttcaagacttccaccctggggaagaagggacggggagacggcgggaatctaggaaattgggggatggctatttccattcctgagaaggggggaacttgattgtgggaggttggctgaagactcccacgccggaaaggagggcgcctctgcggaagggccccgagtggcgacagcggatccgggactcccaagcaagcaggagccggagcagcctcttagcaacccctgtcccgggaaggtttgaaagcagcggtgccctagtgacgccggaaaagatggagcggttgtcatggcgacgcggagcacacctcggaaataaataaataagcgcccaggctgccgcagccgcgcccccgcgggacccgagcgagggggagggggcctcacgggcccgggtccccgcagtcgcgcgtccccgccattggcagagccggagggggtcaccccccggggggcgaatggtacagtcctccgcccgcgcctcggccgggcccgcagcctgcgagccagccccaagcccagcgccgccgccgcccgcggagccccgagcggagccggaggcggcgatggagggagtcagcagccaccggaccctgtcttacagccgctggagctatgacaggtagggcgcccgaagggtggccctgcgtgagcgcctgctgaccctcgatctcctgcgggagaagcgggcctccgggggctaggactggcgcgagcgcccgacccccagggtgggcttgggcacccggaccctcgggcatccgggacccagagcctcgggtacggcgcagcggagctccagcgagggtagtgtccccacacccacggggcagagctgtcggaggagggcacgcggccactgggactagcgagctggcacctctgcccccaccccagctgccccgccagggtcgctccgccgggggaccccgagaaagggcgcggagggggcgccgggaggggcggggcaggggccggggtgggcccctggcgggcggggcgaggagggggcgccttcggctctgggatgcgcccgccggcgtctgcgccccgccggccctccgcagggaccgaggctggccccgggcggagtgtcccgctggctgccggggacccgcgagtcgctgcctgttccgcggggcgagatggcagcctgggccggctgtctgggcgcaggagcggcgctctcgagttgccaggctccgcgcccgccccgcggggatggcgagcggctgccggcgtgggcggtttggagctgcgctccccacgcactcgtcctggaggaaggagtcatcctcccaggcgaaatgaaaaaaataagaacggagtgagttggtcataaagccgagtacatttattcctaggttatgcctgttctaccttttgttggtgtgttaaatgccacccttgtatttaaaatgaaaccatgatgatagtagatagtagtttgtttgtttgttgtttttaagtttcgtaaccccaagtccatctgcagaattctggagttaaatttcctgacccatgaccctagatggtgagggctggaagacaaacttcatttactgggctgctctcatctccgtgaagtcctgcttcctgtgctctccttcccttaactctgccaaaaacctccctgcatcttcgacagcccttgtttgcctagattcagaggaacaggtgtccctcctgcctaaggctagtttgcctaggacccctcctcaccttccctgagtctcgccccgtattaatcccatctgtctcctccatctgcaccttcgcctctttactagtgatctctcttcagcctgtaaacttattcacctgtgtcttgtttacctcctcgagatgggcgcaactgatccacgtctgtttttttcctttcattgccttctttggggaaatatatcgtctgaattggttaattctgtttcttcatcagcccttccttgcacagccccagcaaatctcctgtccacctcatgattccagtgcacctgcctttttgaaaagtggtgctctccacggagaagaactctattattggagtattaaacttaaaataacaaaacctacaaactttggttcagatcccaaattcacacattcattcatttattcaacaaacatgtattgagtgcgaactatatcctgggccctggaaataaggcgataaaaagatagaatttcctccgggagatgagctcacagtctagattatattagaaataagcagtgacatattctgggagaaaaacttaaagttgagctaattccatatagtaaataatttttccctgcaaaagcaaacctataaaagcagaaagactttggaattagataacctgcattcaaatcctgactccacctagctaactttggacaaattacttctccctgggccacagtttcttggggaagtgttgtgagtattaaatgaggtaataggcctggcgcagtggctcacacctgtaatcccagtactttgggaagctgaggtgggcagatcacttgagatcagtttgagaccagcctggccaacatggtgaaaccccgtctgtactacaaatacaaaaaacaaaaaccattagctgggcatggaggtgcacgcctgtaatcccagctacttgggaggctgaggctggaggattgcttgagccggggaggcggagcttgcagtgagccgagattgtgtcactgcactccagcctggacgacagagctagactctgtctcaaaaaataaaaataaataaatgaggtaataaatataaagggcctatcatattgcctgggacttagtaatcatgcaacaagtggtataaattgctgttttattaatgcatattgtaaacgtttctggaactctagtcttccacagaagcttggtttgaaaatcttggccaggcgtggtggctcacgcctgtaatcccaacactttgggaggctgaggcaagcagatcacgaggtcaggagatcgagatcctcctggctaacacggtgaaaccccgtctctaataaaaatacaaaaaaattagctgggcgtggtgtcgggcgcctgtagtcccagctactcaggaggctgaggcaggagaatggcgtgaacccggcaggtggagcttgcagtgagccgagatcacgccactggactctagcctgggcaacagagcgagactccagctcaaaaaaaaaaaaaaaaagaaaattatttttctgctttcagacccctacataaagacatttactgggtttctgtcttcagaactcttttcttctcaccctgacaatctcagtacctggggagctatgtgaagaaaacaactcacctggcccttgaccaaactaactgaatcagaatatccaggggtaggacctgggctcaatgtttgtttaaaacttcgcagttgattgtgctgcagctggtttgtctactctccaaaagcactagtccacaccacctcctctatgttctcatcagtacttgttttttaagacataaatattgaattattcaaaaattacacaatactcaatcaagctgttaaaaccattacacaagcaacacatacattgggtacatagcattaaaagtgaaaatctgtgttctgctgacctcatccccatcctaactctataaggaaccattgttaatagttaactttcactttccagcactgttctctggttgctgcccccatcacatctttgaacctggcaaacacctttccttcaagtcctcacccaagttgacctctcctccgtgtgtttatgtaagctgttgtccgccttgcttctgggccatgtgcatgtcagttatctattgccatgttaacaagtgactcctaaatttagtgacttaaaataacaactgttttggccaggcgcggtggctcaggcctgtaatcccagcactttatgaggccaaggcgggcggattacctgaagtcaggagttcaaaaccagcctggccaacatggtgaaaccctgtctctactaaaaatacaaaaattagccaggtgtggtggcacatacctgtaatcctagctactcgggaggctgaggcaggagaattgcttgaacccgggagacggaggttgcagtcagtgcagtggagatcgtgccactgcactccagcctggccgacagagcaagactgtgtctcaaaaacaaaacaaaacaaaacaaaaaacacacaaacaaaaacaaaacaacaacaacaaaacaactgtttgagttagcacaagattctgtggatcagcaatttgggctgggcttagctgggcagttttgtggtctgggccaggctcagcttttctgggttgggcttgctcacatatctggtgctccggctgggaaggctagagcagctgggccttctctccacgtgccttctcatcttgcagcagtctcactcaggttggcacacatggtggtggaagggattccagtgagacagcagaagctgcagggtctcttgaggcctaggtttagaacttgcacatcactctgctgccttgtattagtcaaagtcagtcaaaatgccagcccacatttcaggggtggggaaacaggccttacctcttggaggcaggagctgaaaatctatggccatttttccaacctaccaaaatatgatgcctacatttttacaatttctggctcctcttaggtccccactgtccacatctgagcacatgccaaagtgctcctcttttccagttcactctattccattctattctcaggctacaccctggtctcagttatcaacgcaatgcttctaacacagaaatctatatcttcaactccagcctttttgccaagacttagtcccacatctctaaatgcctgtagacgtctccatctagacattcagccaacagctttaacgcaataggtttaaaatcagacctttcactgataactgtattctctagtcagcatccacaagccaaacggactcctcaaaacttggacattgaccttgacctctccaaatctccttatctataccactgattgtgatgaagataaaaggaaaagatctatgtaaaatgactggcacaaagtgggtatcatgaagtccatttttttccacagcttggcaccccattaaccattttgtctccactcaagcttcagtcgttatcctcaaaggcttcagtgcccatatcagtgaccaaactagcactcttcactcccaatttctggaccttcccattctagacccttctcttcagttattcacaggataaattcctagatgatgacagctggaattgcttcacttctaatctcatacacatgaattgccagctctctgacctcaggcatgttccttatacattactcctgccataacacgaaggtgtctgccttcatggcctaccagccttttcccggcctctcttctcttcccagcttgtattacatggtagattatttcagtcactcactccagcactttttattccctcacgtatgctcagcacgactctagcccggcgtggatcaatgttaaaatctctatcccctttcttcttataacactagaatcctacaacaaaaatgacttgcctgtgcaggatgtcaccactttcatggtcttcatcttcggccgggccaccaatgccatctctcagtctttctgcttctccctgatgaacttcactcccattgcccacaacagcccttccaaaccttccgcactctcaagacccctctctgcttgacccttatctgcaccccgtgtgttatgtaaatggccctgcctcctgctccttggagaaaaattgatcacatcaggcatcatcttctgtcacgtcctgactccacttcatttccactctacttcaatcactcccttgtggggactttgttgttcttcccagttctttgctattataaataattttgtgttgaacatcttgtatatatgacattctcccctcatgtttgattattcaattaaaacaaacttctgaagaaggattgttagtttccaatgttggctactgtcagattgtcctccaggaggggtgaattgatttctttttccacaggcagtcactgactgcattgttttgcaattatgtttgtgtgtgtgagtgtgacctctcagactctgagacaaagtagcatcactgcgcagaacttggattttggggtcaaagtgacctggctttgcagcccaggtccttaaattattgcttatatggctttagacaagtgacttaacctccatcagcaaatagacaataataatggtagctacgtcttaaggtgggtccattcactcaatatgcatttactgaacaccttctaaatgccaggcaacattttaggcagtggagacagaatgaaacaaagtctgtggtctcgtagttcttaccatctagttgggggagatatggacaaatatatttaatgtatcagtgctaagaggcttatataatatgataaagtgcaaagcagaaaaagcagagtctggaggagagagtctgacagcatgggcatgctgggggtggtgtgtgtgctgtgtcatatagtgtggtcagggaaactctgaggagggggtatttcatccaagagctgaaagaggcgagggaatgagtcatgtggttaatgggaagaatgttccatggaaaggagcagcaagtgacaacgtcctgaggtaggagtgtgcctagtgtgtttgggaacagcatggaaacctgtgtgtcctctgcctctttgtaaaacttccttattgctcttctcccaactccccgcacccactccacccatcctcagggaaccactgatctgattcgtttcctagagttttgtataaatggaataatcagtatgaaccttttattgtttggccgttttcagacagtgtaattattgtgatattcttcaatactgttgcataaattagtagagcatttccttttattgctgagtagtattcatggatatatcacagtttgtttatcccatcacctgttgatgttcccactttttggctattacaaataaagcttttgtgaatattcatgtacaggtctttgtatggacgtatacttttgtttctcttaggcaaatacctagcaaagcagtggaatggctgaatcatataataggtctacatttaatcttttaagaaactgcccaacttttccaaagaggttggaccattttatattctcatgagcattgtatgagagttccaattcctctgcgtttttgtgacagttggcacagccagtctttttcatttaagcattctaacagttatgcagtggtatgccattgtggtttcattttgcattgccttgatgactaatgatgtcgagcatcttttcatgtgcttatttgctatccatatctcttctttggagaagtttctgttaaaatatttccccatctttaagttggattgttttctttttgagttttgagagttctttgtatgctgtggatgcatctcctttatcagatatatgacttgcaatattttctccaagtctgtggctttcttttcattttcttatgtattttcaagagaagtttttgcttttgatgaaatccagtttatcagtttttttatagattgttcttctgatgttgtatctaagaaatcattgcctactttgcggtgacaaaggtttttctaggaattttctaattttacattttaaatttagatctttgctacattttgagttaactttttgcatatggtatgagattcattaaaaaaaaaaatgggtatctaattgttccagcagcattcattgaaaaaaacctttcttttttctgctaaattgcctttgtacctttatggaaaatcagttgattattgtttgtaagtttatactctctactctgttatcttgatctatgtgtctttattgatgccaataacaaaaaatacttataagtattgaaatctggcagttcaggactttcagccttgtctttcttttacaaagttgttttgactattctagggccttttcaatttcacattaatttaacaatcagtttttcaagttctaacccccatccccccaaaaaacctgctggaattttgattgggattttgttgactttatagatcaatttggggagagttacatcttagtaacatcgggccttccaattcatgaacatggtatctatatatttatatctgttgaggggatagatcatcttaatttctctcagtcatatttgtagctttcagtgtataggtctttaacctcttttgtaagatgtatccctaaattctgcatatttttcaatgatattataaaagggtttataaaattcagtttctgatttttcattcctagtgtatagcctgtattgggattcttaattgtggtaaaatgtgtatgacataaaatgagctatttcaatgatttctgagtatacaagtccgtggcatcagttacattcacagtattgtgcaaccatcaccactatctattttcagagcctttttattatcctaaactgaaactctctacccattaagaaataatttctaattcatcaccatcctggcccctggtaacctctaatctactttctgtctctataaattgcctattttagatatttcgtataacgaaatcatacagtatttttccttttgtgtctggcttattttgcttagcataatgttttcaagattcattcatgttgtagcatatattttttggctgaataattccattgtttgcataaaccacattttgtttatttttaaaattttttaaatttaaattttattgatttatttatttttgagatggagtcttgctctgtctcccaggctggagggcagtggcgcgacctcagctcactgcaacctctgcctctcgggttcaagcaattctcctgcctcagcctccccagtagctgggattacaggtacccaccacaacgcctggctattttttgtatttttagtagagacggggtttctccatgttggccaggctggtcttgaactcctgacctcaagtgatccgcccatctcagcctccccaggtgctgggattacaggcgtgagccactgtgcacagccagcattttgtttatacattcatctgttgatggacacttggattgtttctaccttttggctattgtgaaaatgctccagtgaacattggtgcgcgcatatctatttgagtccgtcttagattcttttgggtagtataaacctaggagtagaattgctgtttggtaatgataattctatctttagctttttgagaaaccgtgaaactgttttctacaaagactgcaccattttacatttccaccagcaatgtacaagggttcccatttcttcaccttctcaccaataacctgttaatttctgggttgttattataattattattatagccatcctagtatagtctaggaagtggtatcttatcatggttttgatttgcatttcctcagtgacaaatgattagtattatttcttgtgcttatctgaccatttatgtcttagagaaatgtctaagttcttatcatttttaattaggttgtttgtctttttgttgttgagttataggagttctttacatattttcaatattaaattcttctcagatgtatgatttgcaaatgtttttccccattgttgtcttctcactttcttgataaggtcctttgaagcacaagctttaattttgatgaagtccaatttgtcttttttctgttggttatgcttatagtgtcatatctaagaatccattgccaaatccaggaccatgaagatttacctgttttcttcagtgttttgtagttttagagcttgtatctatgtcagtgatccattttgagttaatttctgtatatagtatgagttgtggtccaatttcattcttttgcatgaaagaaaatccagttgtctcagcactatttgtttctactttttctctcactgaatggacttggcaccctggtcaaaaatcaactggtgagtcgggcacagtggctcatgcctgtaatcccagcattttgggaggctcgggtaggaggattgcttggagtctaggagtttgagaccagcctggacaacgtagtgagaccctgtctccataaaatttattttttaattagctgggcgttgtggcacatgcctatagtaccagctgcttgggaggctgaggtgagaagatcacctgagcctggaaggttgaggttgcagtgaaccgtgatcacaccactgcatgccagcctgggcaacagaccaagacctgtctcaagaaacaaaaacaaaacaaaacaaaaaacaaaccccaaaattagccataaatgtatgggtttatttctggactcttgactcttgttttacactatatctgtgaccaaaggtggattctggcccacactggtctcttctgcaacatatcttcttgtggcttttttctggccccgggttcccaaacaaagcatgcagttgctggtgatattctctgcacagttaggtttttgttgagttgaagaagtagccaaattcttattgtaaaagtagcctttcgtactaagctgactttacctttcgaggagaacttaacaaaatatgtgcttcttccacttttaaagtttgggccctcaggttcttttctttttctttctttcttttttttttttttttttgagacagagtctcgctctttctcccaggctggagtgcagtggtgcgacctcggctcactgcaacctctgcctctcaggttcaggtaattctcctgcctcagcctcctgagtagctgggatgacaggtgcccaccacaatgcctggctaatctttgtatttttggtattgacgagttttcaccaatttggtcaggctggtctcaaactcctgacctcaggtgatctgcccgcctcagcctcccaaagtgctgggattacaggtatgagccaccacacccagcctgtctgagcactctctagttctgacattctgtgagtatatgacctatggcctcggtgtgtgttctgtgataggaaaggccagggtggagggatgagaacaggacagctgggattggaggtcctggccgtggcagtgccagcttaggggttgctggccagaggagtcgggtggctaccagaggcagggggctggaggctctgctttgttttagaactttttgagtgcagctacttctcttttgatggatttatagcagtacagtaccaagacagctggactggatggggcaaatgagggcagtgtacagagggtcgatgaggaatggcgttagagggcagtgagtggggggtggtctgtttcccatccagctggtgtaactggggctcagggtgatttatggtggagaggggagtcgggtatggaggtggggcatggacttttcagatcccttgggacttgcccgcgctgaagtttgacatcatcaggcactgtggttttccagatagggtcactggatgcagtccaacaaatgcaaaaagaccttgggcagggacattgtatctgtgaccaaaagtggaaggaagctccagctatgcctacagtctggagaacagttgccaagtaggggctcatgggtatctgttgatacttactgccttcactctggaaaatcctgagcctgagtctcagctgggagattctggcccagcatgtgcttgggggagattcacacctttgctgtctatcctaagccatgtagtttgtcctgaaggtgcagcagttagatctctgggctcaggtgtgtgttcctctgcagccttgggcaggtgtcctggtcttctgatctgaatatgaacaaagacaaccctagatatgtatgtgtgttggggagtggggttcagaagtcagcaggccttagggaacagcctgtccatgcttttgtcctggggagaggcagatttctgcaggtgaacaatgctagagaactgtgccagcagatgggaccctagtgtcagaatgaggagcacagagctgaggtccgggggaagcggtccctggatctggggaggctttggagtcagggagggctggcaccaggataacagcagcctaggattatctctttgcaaggtcacgttcctctacaaagattcaatcccagcctggctctgcctccatgcccccttagacactgcagaccaactaaataccatgccaggaacaccacagtgtcccgaaaggacactgtctcctgacaccagcccctctttccacagtctgacattttgggtgttatttcgtcctctccatcaccaagtgttcagacaacagaggcaatgacgggttgggctctgagagaaggcgtctgtgtgcacatctgagtgtgtgcatcagtaagagtgtatctgggtggggtgtgtgcacaggggtgtgcctgccaccaagggcagccatgtagatgtgtcccagttgtgtgtgcttctatggaagcaggtatgtatggtggaattgactgtgtgaacggggtgggactggggggatcctctcttttgccctgcatttggtggggtcaagaggtaggattgggaagtggaaggaggtcaggtacactggccctttcctgggcccaagattacacttaatggggggccacaggcctgctttcacaggcaccttgcctgggcagtttctgggaggctggtgagctctaaaagccctaaaagcactcaaggattaagcaggagcccctgtgcctagagctccgcttaggtcgctgagccaaagagaccctgtgtgaccctgggcagtgagctgtggtggggtagaggacccttccctccctgccaggcccaacccatgggagttgagagcggggacctcggtctgccgtgaggtgaggggctgtggggcaatccggggccgcatcaatgttggatgagcctgcacctcctcgataccatcttccttggtctcacttttagtgtaactggagagcccagggaccagtccgagctggccatgcgcgatctgctggcagtggccgcacctgcgaggggacaggagctggggtagggaggctggcgcaggcccacggcgtgtcctggaacagcttgggggccacagggccagtctcgcagggcaggggtcgattccagtctggcctctgctcgggccctgggtcccggtgcagggttactcccccgcccccctcgggccacttcgccttccgcggggtgtcatctgtctggcggcgtgtccttgggccagttcggtcccatccccctgcctagctctgggagtttcctgctcgggaaggggctggaggggcagcagctggacagagagagaccccctggggtaaggaaggggagcagccgcgactgcacagagcctcccactgcaggtgagtgtcccgcctggggaaaggccgggagcgcctggggaaaggcctggggaaaggccgggagcgcaggagtgagattgggggtccacagtggccaagcttctccccaccctggactttcctactccagtcctgaccctttatagccttgtgacaccacaagtgccgcccccacccccaactaccaccaagtatcgccctacaaggcagcagtgaagtaggctcgtagccggtgaacacctggtacttgttggcagatgttgggatgaagttattactgcactgtggcctccatgatcagcatggacggacactcctgtgggcagcaagtttggattggatcagtgagccatggcgagtgggcagcagcctgttttaaaaaactgtttattggaaaacagacacatctatcggcttaaatgttgtctatggctgctttcacactacaacctcagatctggcccttcaagaaaaaattttgccgatgcctgagatattctcccagggcatacttccctttaacctacacgtgttcattctcttcctctccctcacacctgggcacctatcctccctcctccctttgcacctcccgcacatctggctcacgccaggctctccacacctgggaacatttctttggggaccattcacctcacatctggtcactattccttcctctggcaagagaggaaatgactggggcaacaatttcagaatctaacaggacagccgagggctgagggaggacctttgcctgaccccaagttgtcagtgagcccctccctaggctacaggagcaaggcgagttaactgccgatgagcacagctgctctgggcccccaaatctgttttgtcacccgagagactaagcaggccagttctgggcatgggctttctgtcactccctctgttggctggtgacagtgctgaggtcccgatagagtggtagggagaccctgccgaacagataattagagggtgccaatatgatctgggggggaacctgggagacagggagctccagaggcaccgcccctcgcctgcccgcttccctgtcgcttccacaccctggggcccatcgtgccccacttcctccaagccccaagcctttgcaaacagaacaaaagccgtttccttggttcccttttgtacgtctgagttcaggggtccgtttcagggcctggactccgggagactccgggaaactccggcgcccgaagacagagctgcattcctgctgtgccgccacaagatggcactctctaggtgtccgccccagtttgagcactccgggagtttctgacacttgctggcctttcgcccagtttcagcctgaagattgtggtcagacacactctgaatcccaccaggcttgattagctttgcctgccccctgaggcagctcatggacttcttcagactctgtagttcaggacatattgaccccttctgaaggggccctcaggaactgcctgcagtgtaattacctgcctgcttatactcctccccaccaggcactcctgagagcgggaccgtcttattctcctcggggccacctgccccaacccagggcctggcacggcagagatggcagaggtgtttggtggggtgtaatgtgtaaacagcagagtgctgctgtcgtcattcatcccaccatagtttgtctggtgaatgcatttttagtgtcaagctgcctgaaggagaagccagggataaagacccaagctcagaatgtatcctggggagagggattggttcacagagagaagctgtcttgcagcctttccccctctggcctggttctggctgttgccagcattctaggagttctctagacgggctgaaacgcaccgcagggatacagggagggccggagaataggcgtttgtttccaggtagaattttggggcatacccggccttgtctgggagcaatcagggaccagaggcaagggctgcgatgggctctggggcctactgtggcctcatccctctcacctggccccagctcaggccattccaagagcctcccagcctaacagcaacgtgtggctatccaagggtcccagacagaggattggagggctgcacctgtgtttaggggacagccacccctccccctaagcacctgctctgacagcatgggatgatgtcaacaagggacttccatgaagcccaagggggaaggacagtgggagtggggtctgaggtctggactctgcttgaagattgacaatgatgggtgggagtccctcacccactgtaagctctaggaagagggtgagcattcctgttgatactgtggcccattgtgttggcagagtccaggccagtttgtgctcttggtgtgaccccaggagggagtcctttgctggatcatctacctcatgggctggtactgacatgcaggtgcgatttccctgcctaaaacaggctccagagtaagactggcatcgctcaccagggtaattattggtttgggttcaatttccattcaaaacagtaatcccagcctgagctgggtgtcagatctgaaggttgattattagtaacatttatcaacagcctctctcagcttcaggcaattacagctcatctgccattcctgctcccagtcatgcaaacttgccagcttcttccctgcccaccccctccattcccctctccccttcttctcccatctcctccccttagcagacaacctgacggagggcaggaggtgggtgccaccttatgactcactatcaccctgtatggagggggtccatgtgcatgctaggcacctgtgctccccagcagcaatattcatgttgcagtcttgtgaaatctgaatctgattctatcagaactgaggagaatctgtgaaggggacagatgggaacccatgtctcccggctccttgtcgcatgatgcgttttcaatggcactgtgctccttcctgctcctgactcagtctgtccctcccctccagggctgagactagggtgaggctagaaagacattgacctcaagtgcaacattcaaaggacctcgaacaagctcagtaattaagataaatgatatttcaatatagtatttttttaaatcaaaatgaatgcaaagcacatacaacaaaatcaaacctttaataaagacaagatacaacactggatttgcgggccttgtattggcctcacttgccttaccctaactccagtcttgtttatcatggacagttttgctttgatttgctggaagtattaaatttcttggctgctgagttttttggcaaatctttaaattctgcgcctcaggcgagagctttattcagcttaccctggtgctggccccactgctctcacttcccgctgggccctaacctcctgctcccttcagctcttactgcctactgcctcaggcagggtggctcagcttctctcttcgcaggtgcccagggcagcaggggacccaaagggcccctccatgggctgtcttccagggtgcccatccttcattccatcccactggaccctgcttcagccgtcagacacctcagggagggcctgcaggttgccagagtaactgctgtgataactggaggacagaacatgctggtcttgctctgctcgtagaatcacatccagccagggctggatgagtgcaagcaggcacgcctgacagcgtccctgacacgctgatccaaaacgtcactggacatgcatggaggtggagaacattccatgtacccacattcctctagggggaggacagcatgaggctggaggaaaactgtggtgatctgtttgtgacagggaggtgagacgctgaagtagacatggatgcttcctaaccagccttccgcagagggtaggtctcattcgctgaagggcttctgttctgctgagcagggtctgtcagtaggggggcacacctgtctccagagaataccctcctcctgtcctcccctggctgtgctccactagcctaaaaggtaaacagacattttagaaagatcagtgttgaaggggtacccaagatgccaaattatatctgggacttgagacactgttatgtcgaggtccaggcctaggccagctggtcacagtgtccagatgcctgtcacggtgggaggcctgagggtctcaggggacatgtatcagaagcacctctgccctgcctgttccactctgtaatctcccttctgagcccctactgcagcacagagccagctggtcatctagcctggcagtagtaagtcattctattttcctgcagataggaatacatggttcctgttcctcctatgcactctgccacttaaattcccctctctgagtcctaggttccccttttgtgaaatatcaatgatagcatccttcttagaaggctgtgctcaccattcagtgcactaatgcaaagcactgtgaccgactgaagagtcatgttctgtggggccatggaggacagaactaggactgaagggaggtgtgtttgagctttaggtgaagcagcaatggccaactacaaagatggagggaccgctctgggaagagcaaacaccctgatgctcagagtgtgcatgaggaggtttcataatcaccatccagcagcttagcctcaaaagggctgcctgccccagggagctatgacccttgagagatgcagtttatccagccctgaggttctgtttgaccatctttccccggttgtcctccagggggtcatggcacaagtctcagtagcacgggccccatggtccagccttaaggtaagaatggacctccctggaggaagctggcttcatctacagttgataagttcaccttttttcctggtccactttccttggtttaaccctgtgaccaaacctgagagctttggcaggaaggaaaccagggaggatgttgtgcttgagaaagtgctggcctgagcattggctttgagatgtccttttactctgactggagggtctcattccacctgtagcaagactaaagacacctgaaagagagtttctgggagatggaggatgaggtctccagttgcaggtgcatgcacacgtccacttccccacctggcaggtgccggcatgcaggatgtctgtgcgtgtgccccttgcactgactcccttgaggctggctgtgcagctttggggcatgtgtccaagcagagagaatggaagactccatattgggagccttggctttgacctttcctttctctgagcctgattttcccaacagtgttatgggaggggaaggatgagatgcgcttctcagctgatgtccgtgattcttctgttttctggaggccatgagtgttaacagaatgtgttcacttttgcacccttcttccatgaccacttacagtctgtctgcttagcagatgaggggtctgggtctccagcgtccatttggggtggggtcagcaatgtccagctttgcatctgggtatcacttttccttctgatacttgaaattggattctgaagattcctaattattgttccaagttctcattgaaaatctgggtgtaatttttacaagagcatggctgaggatggacatggaggggaagtagtggggctggagggagggaagggacagacagaaggtgatgttgtcattaggagttaaagccagggcctggtagtagataaggctggacagttggcaggatcatcgggcggactaaagtagcttagattctgtccagaggaagtgggggtcttctgaagggtttaagtaggctgggaggacatgatcttaggaagctcactctggtgtcagttgcaggatggatttgagaggagcaagttaggtgtagatgcccatgatgatgccaagatctgggcaacagacaggaaggccctagctcagaagtggctctagggaaggtgaggtgcatagaattgagagatgctcagtagatggcatgagcagtgcttgatgattgtctgggttggtggaggaaggtggacagggaaaagcagaaagctacgatggtgcctcaaggggctgagtgatgtcactcacagagacagaatgtatagagtgaatgttcagactcacaggaagtccaaaactacataccccaacgtgaggtgctgtgggacatccggggtgcagggtccagagagcaggtaggtagagtttagaagagggctgggtccacaatgcagccttggatgttctcaatgtaagagttgtgggagatgaagccttgtgagtggatgggaacacccaggtgcatttcaggtgaagcaaggggacaagaggctgaggacacagacaagcaaatcctagatcttccatcagtccctagaaggcacgatgtgtgcccctcccagcacacagcctgagccctagcacagagctggccgcagagagggcagcagtgaatgtgtcctcggtggttcctccagatggggcctttgtccgcagtgcacttgtctctgcctgggttgctatagtaacccacagatgcagagagacttggcctccgtgttgccatggaaaccagcaattgggtgtccctgtgtggcatggccactgagaccttgaggattcagtctggtcctgaagggtttggggggagactgcgaccagaagatgtttccatgtcctaattaatgggtgatggtggttgttagtctgactgttgccacggtgatgaagggagacatccaagtgctggtttcagtactgaggcgaatacagggaatttcaacaggctccaggtcttactatgcagcctgaagtgggaccatcccttaaacccactccatcctgtggccacgatgggggccaggacacctttgccttctttctgggtttctttctttgccgagacagggattttgttcccaggaggcactccctggcccatgggatctcagcattcaaagcagcacaggaaacctgggcccctgaaacggggccaccgaagagatcggtaagctttcaacatcctgcctttagcccatgggcccaaccattgcgtcagctccacccacccaccctcactgacctcaaccctttacagtcccaaggcctccccttcctgatggtgctgctcccctatcaccacgtggagccccacaggtatatccccgcaaacccctcttgctccagacaggtgatcagggaggcttcattactccaggagctgcccaggacctcagggaggtcccccaccatgggagtaagggcctctcccccagcctccagggctccggcagctccacactccggccctctgcctcttctggagggctcctccttccagcttctgcctgtctccccaccccccagtgcttcattcccatggctcaggtcatcactgccctcatctggactgcctgcctgcctgcctgccatccggggcccacagagtgagcactctatggaagtccctctaccctgatccatcacgtaactcacctactgaggcagctgagaccagggcactgaaggaggccttgagtgaccaggtgtggccaggcagcaggcagggatgatgaggtgaggctgcaaggatgtggagagtcaccccttcttttcctcctcaggagaacaaccaggaggaagtactggaaggaaggaagggagatcgctcggtgagctggaggggaggagggcgtgccggccctgggaaagggccaaccacaggagactgtgagggaggtgggcggaagacgtgggtggctcaggggccatgaaccccatatgcgcctgggagtgtgtgtgtgaaatggggtttaggggagggtgtgaccactggacaaagcctgctcttattgtgtgtgactattgtggccttgggtttgtccctcttggatcctcctgtggtctttttgccttgactctaaccgggtgatgctgatgagcaggtccagaggcctgggctctgttcactagcctgtgctgggactctcagccaagccttctcagaaaggaggtgtcctctacatgtggtcacaccatagcctaggaccacagagggaatcatggtggcagagcctccagcccccctgccctcccattgcccaaacacccagatgtggagatgccctgccccggggtgccgtcccaagcctgctttctaacatcaggaggtgggtcttgcctaaggctcctaaccaggacctcatttgttgtttacacatgttggggtcccaaggatatgtttcttggcccacagaatggtcataaacaactgccctgtgaaggagggggtgctgtcttgtgtacagatgaggcaaaatgacaggatcctgtccccagctgcagagtgtctgctgggcgtccccaacacctgggaagtctgtctgtccttccaagggaccaggccagagaaatggggggcacctggggctctgctttgcctcctcatggatgtcagtcccgggtttctgatggggtttgtgatgatggcgccctaaagggaagctctgtggagagccaggggtctcgagtatggccttcatggcagggaccccattgctctccttttttacacatggcctcaaaccaggttgactttttagcctaaagaaaatctcatgaagagaaagacagtggtgtgggggagggtgtatcacttgagcctacttcacaggctcttgggaaggagcagtaggaggaggaggggtgcaagtagtgaaccccagagggatgactctgctgtgatgactgttaatgaggcttgagacttcagctcatttgtcatgtgcagctggtgtattttgagtgatataagttgatgacagcctccttcctgaacccactgtcaaggctgcaagaaatttttgagatcccacatccaaccccttgtgtaacaggcaaaacaggcctcaggttctgaaccaaggtcacactgcaagtttgtggtagactcagaattagaacgcaggccacctgctcagggttctttctctgtactgcaggagagggaaccagcatcactgtgtgggagtcaaggggcttctcaggagtgagtagtcctttggccatgaccttgccttatgtgaatggaagttctgagcatagtgtgaactgtatgtctacagctgatggctgcctggcagggactcttggccatactgggtttctgggctggctcatttctggtgtttggtatctctctacttcacgttgaatggctcttccctgttgaaaggctctgccagtatcccttaatatcaggtaaaactgcacaattcaagatggtgccagcaagcatgatgtttcccccatggtgacacagggctgtaagtagggagatgaggagccaggcatctttggaattgagggctgacttatagggctgacttatctccgtaggtttggaatagtcataattaatggcaaagttaatggtccagccacttagggatatagcaaagcaagagaatcttggcttgttgtcttcaacttgttgaagaatatcatctccatttcatccacccattacttggcatcttgggatcatttgaaactgttccacctgtgaaaccttaatctttgtgtacctcgtatgcattctgcctcccatatctccaccatgtctgttcatagagacctcaggcccctgagccctagtttttctcctcactctgaatcaactcttgttcctattctatctgagctctgttgcttgtcacttcaactgcccaccattcaccacctggcctcttagtctcctacctcaaccttagagcagggtcactgcctgctttctctagtcctggtttaaaggtgtggggggaattccttcgtgaattgacattggtccaaattcatggcccgcagcctccagcgagcccccagcaatgcccagcagtcctgtgacctgggcctgctccaattcctccacaactatttcaaagctctcacattacccacttattgggatataattcatataccatacaagttgcctgtttatagtgtacagttcaatggttttaagttgtatgaccatcactacaatttattttagaacattttcattactccccccaatgaaaacccatacccatttgcagtctcccccttttcctacaccccccagccttaggcagccactaatctattttctatctttatagatttgcctattctggacatttcatgtaaatggaatcacataatatgtggtcttttgtaactggcttctttccttagtataatattttctaggttcatctgtgtcatagcatttatcaatacttcatttctttttattgctgaataatattcaattgtatggatataccacattttctttatctattcatcaattgatgaacatttgggtgtttccacattttagctattataaataatgctgatataaactcttgtgtccaggtttttatagggacatatgttttcactccttgggtatatgcctaggatctatgttcaaccttttgaggaactgtcagagtgttttcccaagtggttgctgcattttacatccccaccagtagtatatgagggtctcagttttttcatattcttgccaatacatgttattatctgcaattttaagtatagtcatcctagtaagtgtgaagtagtatctcattgtggtttggcttacatttccctgatcactaatgatgactaacaatgtgcttatggaccatttgtatatcttccttggaaaaatgtctattcatatctcttatccattttttaaattgggttgcctttttattattgagttgaagcattctttatatattctaggtaaaaacaagacccttatcagatatatggtttgcagatattttattctattctgtggttgtcttcactttcttgatggtgtcttttgcaacaccaatattttacatttttatgaagtctaatttatctagtttccttttgttgcttgtgcttttggtgtcacatgtaagaaactgtaggattttttacaaagatttttgcctatgttttcttctaagagctttatagttttggctctttcatttaggtctttgaatcattttgagttaattttgttattggtgtgaggtaggggtcccaactcattcatttgaatatggatattcagttgtcccagcaccatttggtgaaaaaaccattttacctccattgaatggtctcgctatcctgttgtaaatcagttgactgtaaatgtaagtttatttctgggctctcaattccactgctttgacctatatgtctatctttataccagtaccacattaccttgattactggagctttgtggtaagttttgagatcaggatgagttctccacctttgttctttttcaaggttgtttggctattctgtatcccttaattttttcttacaaattttagaatctgcttgtcaatttccacaaagaagccagccagtattctaatggagattggaccgaatctgtagatcagtttggagagtattgccatcttaatagtatatagtcttttgatccataaatacaggatgtcttcttgtttattatttaggtcttctttaatttctttcaaagaagtttatagttttcaatgtataatattgcacttatttttagcagtttattcctcagtgttttattcttcttgatgcttttgtaaattgaattgctttcttaatgcaagtgtatagaactatgtataactgattttgtgtaatgatcttgtatcctgcaaacttgctgaacttgtttattagttacaatcattttttagtggataacttagatttttattacacaagattatgtcttgtatgagtagagatagttttatttgttcctttctaatctggatgccttttgtttcattttcttgcctaatcatcttggctaaaacctccagtacaatgttgaatacatttgtctagaatgagcatctgccccaccccaccccccttcttctggctgctcttaagatttttctctttatcgttggctttcaacaattgattatgtgatgtcttggtatagttttcttcacgtttcttccactgaatgtcttttgagtttcttggatatatgggtatatggtgttcattaaatttgaagaaacattgggcattatttcttctaatattttttctgacttttcccctgaaactccaactatgtgtatgttagcttgcttaatattgttccagagtttttcatttttcagtatttttctgtgttttattttgaaatatttctacctatgcctttgaatttacgaatctttgctttgcagtgtctaattccatgaagtatatattttattttagatactatgtttttcatctcttgaagcttgacttgcatcttaattatgtatttcatttctctcctcatcatagtcatatttttctctatcttttttacgtggagtgagtttatcatagctcttttaacatttatgtctgctaattctgtcatctgtgtcttcctacttgtactgtttttacccacaacacttctaacactaaatgtgtggtttctttccacaccaacaaccaatttggcaactctctagatgccaactgagggtcctgcaatttaatttgattctggtactaattattataactgaagttaatgcagaccccacagtttaagggctcagtcccgcaagacttcccccatttcataagtcccaggttgtcacctatacttctggccaaccagctataaattgggggttcctaggacccctgctcaggtatgaacatttgctagaatggctaacagaactcaggaaagcactttatttactctttactgatttattataaaggatacaactcaggaacagccaaatggaagagacacctagggcaaggtatgcaatggcgtggagcttccatgacttctccaggtgtgccacctccccagcaccccgatatgtttacctgccaggaactctccaaactctgtcatttagggttttatggaggtcctgttacataggtacaactgattaaatcattgaccattggtgagtgaactcaatctctagcccttctcctttccccagtggcttaggggtgagctgcaagttctaatcctctaatcacatggttggttcctttggcagccagcctccatcattaagctatctaggagcccaccaagagtcacctcattagaataaactcaggtatggttgaaagtggcttattgagaataaaaaagatgttcctatcatgcaagaatttccaagggttttagaagctctgtgtcaagaactggggacaaagaccaaatatatatttcttcttgtgtgcactggtgattgatttttctcctagttatgcatcttctcctcctccttttttgaatgcctgggtaatttttgattagatgataaatgttttggattttacaatgttgggctttgttttatcctttaatagttaatggtgggctttgttctgacaaacaattaagttacaggttgagtatccggaatatccgaaacctgaaacgctccaaaatctgaaactttttgagagccaaatgacactcaaaggaagggctcattggagcatttcagattagggatgctgaaccagtaagtataatacaaatattccaaaacttgaaaaaatccaaaatctgaaacacttctggtctcaggcattttggataagggatattcatcctatacttggaatcagttggatccttctggggttttcttttaggctttgttagggcaggtccagagcagcccttggccgagggctaagttggcctcactactaaagagtgctcttctgaggaccctccctgatctgatgttctgtgtattaggaggtctttctgctcggactggtgggaacacagagtatttccacccttctgtgaatttctgagattgctctgcttacttctctctgtggttcattccccagccttgggtcgttttctcacaagcatgtgcagatcagtactcagccagagataagggaagccctctacaggcctccgaagcacatttgtgcgttatctccctcccctccctccatccctccttctctttctcagtctcttgctctctcactctctagctcttccttctggaaaccctttccagggaataatcagggcacttgcagggttcactttgtttgttctctttcctcaggatcattgccttgcaccaccttttgtccaatgtctgaactgtcgtttcatctatttcaccggtttttaaatgttaaggcagaaatgtaaatctaggccctgttactccattgtgactgaaggcagaagtctctccttagttttaggctcaccattttaagtgcttactctacattcccaactggatatcacacagacccctcaaactcaatgcatccaaactaacatcttctctcaccaacctgtccctcgtcttctatttcctatctcctgggggaaacccagccccaaatcttaaaggccactgtgacctctttttcaccattccctgatatttaattaaataaaatcctttcaatttcatattctttgttaggcccaaatctgtgcatctctttcttttctctctgaccaccagattacctaggtcctcacggtatttagtctaagtgactatatagcagcctgcaaactgcctctttgcctccagcctatcttactccaagccatgggccacactgaagccagagtcagttttccaaagcatagataggatcctatcatcccccacttaatgtatttcagtggattctctgaagcagggctgtccaattttttggcttccttgggccacattggaagaagaaaaattgtcttgggccacacataaaatacactagcactaacgacagctgcttcacttttttaaaattcgcaaaaaattttcataatattttaagaaagtttacaaatttatgttgggccacactcaaagccatcctgggctacgtgcagcctgcaggctgcagggtggacaagcttgctctaaagctttagcacagagcactgcattcttagtggagacaaaaggctgtttactatctggttcctgttatattctccagcatcgtctcctctcctgcctctccccactgccagctgcaccagccccccaaactcatgtactcttttccatttctgggcttcacctgtgactccttccatatgtagtgctcttccctgtcttcacctggtagacttctcaccagccttcaagacttggtatcacctcctccaggaagcctactcagatgtcctcaatcacatgcagtgctaaactctatcacaagtcttagtaaatttatatcaatcatgattccatccaaatctactactgggctgtgatctctctgagggtaagaacgtatcttgcttagctcagtaccctcagtggaaagccatgcacagaataggtactcattataagtgcactggatgaaggaatggaggtgtggagccatggctggtggaaatgagatccaaggccagatgccctcgagtggcctggagtcccaatagcagaagggctctgtgcagcagggccttcctcctagattcaggcaatattgagcttgagggtttgtgctgcctccctgctctactgcacaggggctagacttaaggaacttgccattgctgcatttataccttttgtttcaaagggatccctgatgaatcatccaaacctgcacggagcctgagccccagggagggtccttggggtggctgggccatctcctgcatgtgacttagaaactgtgccacaaagagcctgatgcatcacaggacatttttcttgaaaagagattttagaataggatgtgatgaaggtctttgatgactgtgatgtgccaccatgcaatataactctgctagaaagggtcccatttgctcatccattttaataattatttatatccttcactgtcatttgattacaagcaccatgaaggcagggctgtatcttttttttttcattgttgtgtcctcagcctacagtgcatgtacacagtgagcactcagtaaataattttcaaatgaataataatagctaacatttgttgaggacttataccacacatgagtctaggccatttacacacattaactcatttcatagtcacagtaaccctatgaggtgagtactgttatcattctcattttgtggaagaaaaattagacacatagtggttaagtaaattgcctgaggtcacatagttaataactggtgaggaaagctttcaaagacttcatgaatgaatgaataagtgaatgaatgttttaatttagagtgtccacaaaaagggactacaatagatgaaggtgctttttgttttgtttgttttcttttttagatttttttaatgagatgaggtcttgttctgtcactcaggctggaacatggtgatgcgatcatggctcactgcagcccagaagtcctgggctcaagtgatcctcccacctcaatctactgaggacctggaactgtaggaatatgctgccagacccagctaaatctttgttttcttttttgtggagacagggcctcattatgttgcccaggccagtctggaactcctggtctcaagcaatcctcccaacttggcctcctaaagtgctgggattacaggcatgagccactatgcctggctgaaagctgtattttttaaaacaatcatcagagcatcagactttccataatttggactattcatactcaatatcaattaatatatttctctatataatatgtaatgttgtaatgttatgtaattatatgtaagattaaatatatgcaattaagtataatattacatatagcatatatcatttgacattactgcatgccagactctgtattgttttacataaattatcatatttaatattcgtaattctgtcaaagagatatgagaatccctatgaattcccatggtacagctaaagctcaaagtggttaacctcaaacatagagagcttactgcaaggcaggatttgaacccaagtctatttgactccatattcgtgctcttacctgctttgccatcctctctcttctgtagtcggcccaaagcatgggctaccttgtgctttccaaacccttgcccttctaggaagctaccaaaccctatggcatagtcttcatttcacagcctaacccaaggggactttcagtgccccaggcaggttttcccaacccccatccagtaggaagagctgaggcttccacagctcagaccccatggtgtgtcatcctgctattttagaacttgaagggtgccgtattggaggccatcctagaccaactaaatcagagtcattgagagtagggcccaagaatctgaattttaaatagatctccaggtgattctgatgtccaggcagatttgagaaccactggccgaggcccagcaaagagacaatgcatacccctcaggaaaagaagtagtggcttattgcccaggccaccttcacagcaccttttagaaccatggtggtattatgtggtatatatatatatatatatagatagatagatagatagatagatacacacacacatacatataaaataaaatcacattacttttattgtgtaattttattatgtaattttattatataaccataataacatatgtatgtaatcactacatattcattgtagtaaatttggaatacataaaacaatataaggaagaaaaataagatgacctatagttccaacacccagaggtaattcctactgacattttgattaattttcatctttaaatttttaattgaagtatatatagtaacatggaaatacacaaattataagtggacagcttatgatgaatttgcacagctgaacacagacagtcatgttaacactacccagaccaagaaacacaacatttgccagccccctagaagcccacgttgagcccttttctgataaatgcaccctcccaaagtagtgatcccgacttttaacatcatagattaattttgcctgtgtttgacatttatataagtgggataatttattatctactctttgaggctggtttattttgttcaatattaatttgcaagatgcatgtatgtcaggtatgtagttatacggtagttcatttattattgctgtatagtattcaattgtgtgactgttgtagtttgtatatgcattctaccgttcatggacatttggaaagtttaaagtatttggcagttacgaatagtgctgctataagcattcttgtacatatcttttggtgcatgcgtctgtgtttccatgaggtgcgtacctaggagtggaactgctgaatcttatgttccattctagtggatgctgccaaagttttccagaattgttgtaccagtacactttcaccagcaatatatgaatcccagctgtcccatatctccaccaacacttggtcttttctgtctttttattttagctgttctggtgagtgtgttgcatgtggtcttgtggttttactttacattttcctggtgaataatgaagttgagcatcttttcattcatgtatttctttttaatcttttacttattcacccactcctggtaatccttaattcattttttttaaaaaagtgaataaggccaaaaagctttccataaataaaacggcctggttaaagtactattttatttttcccttcagcgaagtctgtcatcttaaaaataagtgccatctaactagaagatattaaagaaaatgtgttttctgctcttctgtctcttagctcttttttcctatgctttcaataatcttttaacttttactggttccacaataaaattgcatccttttgagggatgtaatcttatgagacaattgcacacatattctccaaagaaagactagtaggaccattaaaacagaggaaaagcttaaagtcaaggtgagacaggaagctttcaagtagctaacggccaggaccagttgttccactgggaaccgtcaggaggggagcccggggagtggagtagtgagcatctcagagtggatgctgaaaatgaagttgtttcttttatttgctttgtgttttgctctttgttactgaaaaaaaaatgggcttaaattcttaggtgctactttgaaaatgatctcgggtgttacctgaaaaaaatgtgcagtatgagtttgttcacaagtggcaattacatatgtttgtgtgtgcctatatcctaatgacattgtgtaaactgttttgtcatctaaatttttcatgtaacatactttcccatattgttaaatattatcgggaaaatactgtttttaatggctatataatagctcttttatggatttgttgaaatttaatcattcctttattttggttatttccataatttctaaattctcaatgatgaatatatttgtacataaatctctgtactcttgtgatcactttcttagaatagcttcagagaaatgaaattaatggctcaaaaagaatgaatctctttaaagttctttgatacattcatattatcacatttctttccagaaaggctatcaatccactctctccgcacagtatctgaagggccaccctcactgcatattcgccagctttgcactcacttcaattacagtgtctcttgccatatagaagacggtgatttttacctaataaacttttatggcttctggatttaggaacatgcttagaaaagctcccccactccctgcacatgactagaagaatactctctaacatgttctacttaacagttttcttttttgtaataaacctttaatcctctgttatttgtttttgtatgtgatgtgaaatagggatatagctttatttgccccaaatggatagcaagttgatctctaagccacttactaaataatccaatgtttcttcagtattttgaaaggccatctttattgtaaaccaatttcctctatatacatggtactatttctgtactgcattggtccattggtcattctcacgtcgataccactgtttttggtacagtttcctagtacagatgatttattggagattcatagcacagtttgataactggcatggcaaatgcctcctcattcttttacggttacaaaattgtcttggctaacttggaaaactggcttatttctccagatgaattttggaataaatttgtccagttgaaaaaaaattctgctgcatttatgattagaatgggatcacacctgtcaatttatttgacaaaattgcagttccatacaggaacaggggatgcatctccttttatcaaggatgttaatataagtaaaattttatagtttgttttattattaatagaattgtagtttgttttcatgtatgtcgaaggcatttcttgtgaagcttccctagataggttattttttctattgcttgtgtgaataggaccttttttttttttttttttttttgagacggagtctcgctctgtctcccaggctggagtgcagtggtgcaatctcggctcactgcaagctctgcctcctgggttcatgccattctcctgcctcagcctctcatgtagccgggactacaggtgcccaccaccacgccctgctaattttttgtttttgtatttttagtagagatgaggtttcaccgtgttagccaggatgatctcgatctcctgacctcgtgatccggccaccttggcctcacaaagtgctgggattacaggcgtgagccactgtgcccggccggacctttttaattatatttttaaattggatgtttctgatatgtagaaaagccatttatttacaggtagttattctgtattaatcaatgccactgacttatttattaattctaatagtttttcagttaattttcttagattttgctaggtagacagttggatatgcaaataatgatcagtttatcttcttttctaataattatgtgaaaaaataaattattgcattggctagaacttataaaacaatgcttagttatattctttatcctgtcaactatacttctgttcctagtttactaataaatttcttttaaccaaaaatgagtgctgagttttatccaagacctctttggtatctgttaaaacttacgacatttatcattaggcttattaatgtgatgtattagattaatagggttactcatatataaaccatctttccatttccggaaatggaatgagctctatatggtgcatgttacatttttcattcaacttacttctaggtttgatttgttaatcttttattgagaatgctaaatatatttttaataagtaaggctattaagtattggagttttaggtttctggggagttagatttttatatcagggtttgattaaccttgcagaattagttggttgcatctcatctttttttatgtattgctgagtgattcctctaactcaataattgtctgtttttatttatttatctttatttattaatttatctatttattttgagacagagtctcgctctgtcgcccaggctggagtgcagttgcacgatctcggctcactgcaagctccgcctcctgagttcacgccattctcctgcctcagtctccggagtagctgggactaccggcgcccgccacgacgcccggcgaatttttttgtatttttaatagagacggggtttcaccgtgttagccaggatggtctcgatctcctgacctcgcgatccgcctgccttggcctcccaaagtgctgggattacaggcgtgagccaccgtgcccggccaataattgtcgtttttaaaagtttgaaatacttggccgggcgcagtggctcacgcctgtaatcccagcactttgggaggccaaggcaggcagatcaagaggtcaggagatcgagaccatcctggctaacacggtgaaaccccgtctctactaaaaatacaaaaatattagccagacgtggtggcgggccctgtagtcccagctactcgggaggctgaggcaggagaatggtgtgaacccgggaggcggagcttgcagtgagccgagatctcaccactgtactccagccggggcgacagagcgagactctgtctcaaaaagaaaaaaaagtttgaaatacttgtcccaaaattcatcttggtctggcacctttcttgtctggagctgtttagcaacatttccagtttcttctatggttattaatctaatcaacttttctacttctttttaagtttagagatttatattttctagaaagttcattgtgttgagatttttaatttattagtctagaaatatagtaagattcagatgtgtacagtctcatctgtatctttgattacagccctttcttaagggtttgattcttttatggtcctctgactttccacatgcccctccttgggcctggcaggggcaagggctggagagagagagagagagagagacagagagagagcacaagtgggagtagggaacagttgtgggcccatgtccatttccatcaattggaatggatatgtgtgagcctgtagacatgtcctcacctgcatgccatgtcatctcccagcccgaatgtctgttgtggcatatctatgcatacaccttgatgtgtgtcctggcatatgtatgtgtgtatgtgttcctccatatatgtgtcagcatgcatgcacacatggtctctgcagccatggagatttccactttgtgtgaatattgtgtacatgttcctgtgtgtactgtacctgtgttcatacatgtgcatgggtgtatgttcctgtgttactgtcactgggaggcacatggcacatctggctaaagggatggtagagtagctcagcacagccttggtgcttacatggcttattctctgccattttaaacaatctctcaaagggccagaaggtgaagaggaggtgggcttgggcaagatggggtgtggaggctggcccgtcctagagtcactctgtcatgactaacccaagtctggagcccaggcctagatgctcagcctgtgtcccctggaaaccccctcagctagacagagaggagagggtttactgtaactcatcagtcagggcagctgtctgctgttgccatggaaatctgaaggcagcatcttctgcaaggaccaggatgtagagtctagagaggacaggctgcatcagcctggtgggatcagtctggagtggcctgtgtgtgtgcgtgtgtgagagagagagaggtgggaggagaatgcaagatagtgagtgagctttctgaagtgggtggcgcatacctcaccattgctctctaaggcctcagccattactctggattatcgctgggtggcgctgtaagaaggggtgtacccctgagatggcttccctgtgcccatcaggacccggtctggcctgaggctgctcttagagtgtcctgggaccacctagacagatgtgctggcatctgcccatcatgggccccagagcccacccagcatctgctgcacactggctcctccttgctcagatgatggggtggtccaggaggcaggcccttaccctggccgcacagatgctgggtgatgggagcagacagacagaggcccctcaccccaggactcagctctgctgctgatgggctgggggtgggggcaaggacagggcaagagtacaggatgatgactgggggacaggatagagtccaaccttcaggtggagctgagggctgggacagccaatgacagtgtgtgcctctgccaccgcctcagtctggcaaggcataggaaaggagcacccccttggagtcctgacagcacctgtggagttggaagcaggagccctggcctccctgctcaccttcccactagccccttcgctcagggccctgtgacttctgatccctccctgtgacaggggagcctgggctcagcgttcactgcagcctgggcaaggcccttaagcccccaagagtcccgctctcacagggcatgggaggagcttccagaagcagatgggtgtccttgtttgggttgggggtgctggggagagcaggaaggagctggctgctggagccgcctgaggctggatctggaggacacagaggtgtttagccaacagttctgtcctatcccttctcagctctctgaagtcctccctgcacctcaagccagggcctgacctccagggaagcaagctgtcaccacgaggaagtgcaccctagctttcccacctcgtgctaccaggatgcccctcactctccttaatccagggcatgggctcagagggctggctggggtctcctgtcctggaatgtgcggccatatgggaatgccttgagtgtgtgagggccatatgggaatgcctgtgcgtgggggtggcatgagtgtgtgctgtgaggtgtgagtttggagagaagtataaataaatgatgggcacatgtgtgtggtgcgcatgcttgtgctgacaggggaaggcagggggacgtctggagtgtcagtgggttgtggtgggcagggtgaggcatccatttctgtgaaatgcctggggggagggaaaaggtatttggcacagtacatgtgggtacaaagcacacgaaggaattttgggtacatatgcgcatgggagcctttgtggggtgtggtttgggtatgcaggtaggctgtgtgtgaggtagagctggaggaaaatctatctgtggagtgtctgaggtgatgtgtgggaggcagctgtctacaggtgagcttgtctctgagtggtatatggggtgacatgttgttgtgtgtgatgtggtttgggagggtgaggggtgtgcaggcatgtccccaaaacaagcacatggtgtgtctcaagtaaggtgtgggggcagtgatgggaacgaactacagtatgtaggccaagtgtgtgggggaagggcaagtgggcgtttcattctctccacacgtcacgagttaggaggcaccattttccccctcaaagttgaggaaactgaggcccacagagtggaaacaagctggctggatcacacagcagggtctgttagactctcaggatcccagctctggcagctcacaagctaggctctggagggctggggaggggactggccctctgggtaatggcagtaatggagggtcccattcagttctttagggtgactctcctggaactggcccacagacagctcatgagaatcgattgcgcaataaaggaaaatgtttgtaagccctttgctcaacatagctgttattaagcatcaaactggccgggcacagttactcgcgcctgtaatcccagtgttcctggaccaaaccgagggtcagctgcttattctcaaggcccagtaacgagatgcagatgaactgggagagaggggagtttttatttctgtaaccggtcacagggagaaggcctggaaattattgccagaccaactcaaaattacaaagttttccagagcttatatatcttctaaactatatgtctatgtgtaagtgtgcattcgtctaaagacataagtgattaacttcttttaatctataactaagattcgagtcctgaagaccttcctctggggcctcagtaaatttacttaatctagatgggtccaggtgccaggggtaattaccctccttatcttgtcccctgcgaagtcacggaggtttggggagttccttcagccctccaataaaacttatttgtggaggcctggggagtttcttcagacccccaataaaacttgtttaaccttaaacgaggcctgttaagaattccttcattattttgtcatgctttaaggcccaggaaaggcctaggcaaaactcttggtgggcttttgttacatcccagcctttgtataagggcactggttctgtcagcttttaatatttgacttaaccactcagtcagtactgaaacagttgttatggaggcctgtgttagtgatgcctggcctgccgcaccagcactttgggaggccgaggcaggaggattgcttgaggccaggagttcgagaccagcctgggcaacatggtgagacccccatctctacaaaaaaatacaaaaattagccaggcatggtggtacatgcctgtagtcccagctactcaggaggctgaggtgggaggatcacttgagcctaggaggtcaaggccacagtgagccgagatcacaccactgcactccagcctgggctacagagcaagatcctctctctcaaaaattaaaaaaaaaaaaaaaaagaagcggtataaatttaacattaaacaagttatgtttacaaaggtaatatactgaaaactcaccacttcgtattcattttactgcctttccctgcgcttgtctgttgtgtctgcggggtggaactgccacgtgaccgtgcactgctgagcatctcctcgcacttcgatgctcagtcacatcacagattggccatggcgagggtggctagaccaggggagtcaacaggtgctgcacattaagacctggtttattgttttgttgattgtctagacctgagaaagtgatgggaaaaaatactactaatgcagattacattttaaagggtgtcatgtttatagttgctccatggtgaatagcagaaaacaaagatttttccagtattcagaaactattaacctattcagcaaagaagtcactccgaccaccagtgaaggagtgaagttctgacatgtctttgttgtttcactttcaacttacttgttaacataaatgaaaatatcaagcagcattaagctggaactacagtaatttgtcattgcaaccgtaggttggctacagataaagagttaggcgaaactcattgaatgggttgatttctgggacagtcatctggctatatggaatttacaataaagaatattggatatttcattagtatttgtaaattatgtgctatacatcctttgtgtcagtaaaatttataataaacttattgagtctacgcatgcagacattttctggagagcttgttgttaaatgtcactgttaacaccccgtaggccctccattacacatagtcccaacatgtctccttactgtgcagacggtgaggtagggtggggtggagggacagatgtaacttgcagagaccctgggagcagtgtcttaggtttccagacaagctgtggcttgtcactagatcagcctgacctcctcctggccgggggcactggggctcaggtgggggtcccgttcattggtcccttctctgtagcaggctcagggatttacaggtcagaggaagaagacgtggtcactgcctgtatggagctcacagcccagcagaggagacatccagtcgcagttagttacaccctggagagtacaggggcaaaaaaagaagaaattgcccagctgaggcaggagcgaggctgggacaagaggagctgctcagcggaacagtgcctctcgacatttagtgtgcagcatccacagatttgtgttaaaaatgcggagattctcttttggcaggtctgggcagggtggtgcccgggagtatgctaggggatggtgaagcaggtacccaagggcacactgggaaaagccttgatctgaggagacgagagggtgtgtgctgaggcaggagatgagaaagaagttctgcggggagatctgccgggagtttaggagtggctggagctaagccagcctggaggggagacagcagagcaaggcaggagaggggtcagggggcaggtcctgcagcctcgtaagcctcatggaagagcttggtttgtatcctttggaacgaggagcagtggaaagagccttgtcagcagacaagtgacatgctcgggttggcttttaaaagtgtaatgttcctggagcaggcagaactgcagtcaaggagaccagaaggaggctggggacatgtgaggcctcgatccgggcagaggcactggggacaggggaggggaccgataggagggcttcatgggtggagccacaggcgagatgaggagggttagggtggggcctgggtttctggggtgatgactgagcgaatggcaggactatgcacattgccagaaaacaggaggaagagcaggtctggagtaaggtgagttgctttgaacctggagacttagaggtatccctggaggggcccagaggcatttggggctcaggggagccatcaggaagtagatttgggagccccatggataggtgggaaagccaagagagtgaagaggtcacctgcggagaacacagtcacaagggtccagaactagtgctgaagggccaagaactcaggcctgcctggaccttgtttctggaaggggtgccagatgccaggtccctccgtacaggaaaaccagagagtgggcaggagaaggttggaggaggtcagaaccatgggtcgggttgctggccacctctgacttaggagttggaggccacagtggttaggagtcatggggcctcagttctagctccagccctggctctgctaccaacttgctgtgtgacctttggcagatctctacccactctgggcctcagcttcttcatctgaaaataagaaagctggaccataccagtgattttcaaatgacatttggagccccagggtcacccagaagcatctccaggaagcaggagttgagggtgatggggagggagagactgagagtgtggaaatctagtcccaccctgtccccagcttcatccagagccacttgcatttatgttttctgttagcctcttcatgaaaggatgttttccaactgataactactgggccagaggatcccttatactgttgtacgtatttggggtctgtgaatccttgccaacatagaagctgatggagtctgaggaatgacacacactgagaaaaccaagcatcatcattacagacactgtgtgaactccctgcctgccacccacacagcacagtcatggttatgtccatgcttatgtaggcctgggctctgcctagctgcgggtgatttcatcagtggatgccgctcagtttgcccctgcctgctggctggctcgtccccagccccaggcatcagggtgccccatggtggggcctgtgtggccctggcccttctctgctgccccagggctgtgaagccacaggtcggccccctcgttccttgatgctctctgtccattgtctctacaaatacaaagagagtctctgaacaggacaaagcacatttcctccttccttgggcctggcatcagcgacgatgccacctgtgtgggggaggactcagtgggtagtgtcctggcttcccttcagccccacagagcttccctcaaaccttgctgacagctgggcgctctcagtaaactgaggcaagcctgggcctagaccagtgtgtgggggcgtgtgctgtgggcagggaggatgagagagctggcctcaggatgggggtggaaacaccctgcggtgcctctacagggaaaaccaggtccttcaagtctgtgtgacctcagatcccaaataagtcaatgccggcctcccctccccgtccctcagagcagggcctaggagttggggaggggcagctttgcacaccccttgccctgggatcctggggtgcaagagtaggacgaggacagtcggctcagaggggacagagatcttgctagtttgctctgtgcccctttagcccacactcatgtccctgcatacactggaccctcctattgcctggaagttgtcctgcctcctgccgctgcccctacccgctaagagatccagatccccaaataaagccacactggaccccaggatcccaggcttggagacagtgcttttggggaactccaaggtcccccagctctcttgctacttcaggaacagtttggaggggggcccagtagaagtgaccccctccctgtcacctactcaacatcccagatagggctcagaaagttgctccaaaactcctgggaagagaccccacccctggagttccttcctgctcctcctcctctgttctcgctcccccaggactatggaggcttcagcccgttctcactcggcagggtggttggtggggcagggtgacgactctcggtgtttcctgacaacaggctgggggactcaagcgccaatgtgaagctgaagagcgtcctggagacagggggcggtgagacggagtctgcccaggccacaccagtggccggggtttggacctgggcctggggagggtcgctgtttgagaggaggacgcagctttataaaatgactccgtaagtatggcctgggcaggtgggggccgcgggcccccactgccccacctgggaccacgggcatggaccaagagctcctgcagcaggagaccctgccacaggacgtggggaaccagaaagcttgggaggttgcagtcctggggagatacacatgcttgggctgaggcggaggctggctcttggcctctagggatctagggagccaggcgctgtcaggggcctgtggagggctctcccagatgctctaggctactgggcagggccttcctctgaaggtttgtgtgcgtgtgtgtgtgtgtgtgtgtgtgtacacatgaggggttgcagtttctaccatggctgctggctcatgataagagccttttgaacccaagaccccaggaaggcaggctcacaaccttctttcttaggcatcaaaggctctagaacagtggtttgcatcatgagaagccctaggaatatttttaaaatgcacattcccaggctctgcccacagggactctagggcagggcccaggaatctttattttagaaagctccctgggtgattctgacaggctgcagctgggggaggaaaccactgctcttggcggacacctacccggggccaggaagcccaggctctgcctacagggccaccttagacactcagacgttgtctctggaaggtgttcaggtcatctgcactctcgtgggaaggagaggccgacatactcttcggtaaccttttcctgaggcacaggagaaagcatggagcacagagtgggccccagaggaaggaaggctcaggaaggggtgcgacagagcatcagggccagggactgccccatcacagtgtctgggcctgctgaggccggggaccctcacatctgtctcagggcccagcgcctccggtccacagcagcccctgtccagccacgtgtgtgagcccaggtcctcctgcatagacacgaggaaagagagatgagatgtcagaaaggactccctggagatgagcgcacacaaggacagttatgaaatctcctccacggagttccttgtgagcattttaaatgtcttcttaaaaaagaattcagttaattcaaaatgacctttagaaaaagaaagtaaaataaatgacctttaaaaccctcataattgacatgaagtttactgacttaactgaattaacatgaaggcagcatgaagtagccgactgcacgtttgcttccatggttgaagctggagtcaggccatctgattcggtttatttcccgtcttgccggcccaaggatgcacattcattttgccccagactgcacatgtccacacctcctggctgtaaagcatccgggagtgttcactcgacccagtttgctttagtcaatccccaagtgctgaacctttgggctccttccaatttcttgctattataaatatcatggctatgaatatctctgtacaaattactttcttagtattttactgggaggcattccccaagtggaactactaggttaaagggcatgaacaattttatagttcttgtcacatattactagatggttctccagaaatattgagcccgtttactgtgacaccaattatgtatagctgtccccacagccctccagtataaaggttcatcatttttatttatttatagctgttttatttactttcttttttctcattttgcgattttggtcaggagtggtgtggcgagttgttttaatgccgttgtttcaatgattggtgacattggacattctctgaaggactttgagaacctcataggcgtcatttgtcccacagggatatggcaggatcggttctgagtctaagagctggatcaggactggaaaatggatagctctgagttttcagacttactcagttctcagtctcccaccaataggccagaatgtacgtcagggccatagtttccaaagctctgaggctgaacgatgaatatggttttaaaacagcatcacttgccccagggagaagactgagatgaaggggagaaggagaacccgtggccccatgcttgtccccaccttgatggactgtgcctgagctccactggacaggctgcacagcctcttaccccagatgtgaccttctgggtacacagattaccatgttatgcttgtggctgtggccatagggataaaccaaatttggggcttgtagtacacttgcctgttgatcctaatgagcatccaggagctgcaccaagagtttacccagtacctgtaaaaccagggctctgatggtggctagagaggcctggctgggtaagatcagtaacatttgctggggtctgggccctcatgtcttggctgaggtctaagcatggggagttgtggaaaaggagactgttagggaactttgacgtaagtggggtcgaagactgtggccttcagataatgacaggggcctcctcagtgataccaggaactcaaggcagagacagtgagggtcaggggcatgaaacccagtgatagaaactaggtgccatggctgttgcagacagggccacagggcctcctgggatctcagagcaaagaggccagatgatgaggacagtaagtcagggcagacatggctggtggggcaggaggaactagcataggatttgaagtcagcaatttaaatcgtggtatcaaaggactccgcaaacttgggaacaaataagcagttatggatactcaaagatattgttggtaggagcagaagagtgatttgtgcaaccaaaggaggtcttggagtcccaggggcctctccatgttgaagcaggatgctaggggatgagaggacacagggccaatgtataatataggtagcaaggcccagcctcttggaggagaattggtggaagctggctgggggatcatcactccagactacacctggacttgggaaggaccctgtctacagaggccaagccaggatcatgaccatcaggctaaggaggaagtgtgcatgttgctggggtagcaggtgtcttgggcccactaaggtcctccaggctttgggaaggaagcagactccctttccctctcattcctggcctgctccccatggggccagggcattggtggtgctggagcgggtggtaatggacagaggagacatggtgtgtgccccaggttcaacaatgggagtgacacagagttaagaagtggtttcgtgtgagtcttagattcaggtagacctataccttactgtgtgacctcagttcttgagcctcactttcttttctctaaaatggggatagtcgtacctgccttatagggcagtcaagaagattgaatgagaaaataatacatgacagcactcagcaagaatagttgttaacaaatgtcagtttctttccatttgcctcttttagtacctagagcagagttgagtgtatctgtgggcccaaataggcctccactctagacgaggtggagggtaaaggaaggggcagcatgccctctggtaagcctaggagcagagctggaagagcagctctgcttcagggtttatctgacccaagggtaatgatgaatttggtgacgtggaatagttaaagtctggcaagtttctgagcctcgatttccttatctgaaaaataagttgtgtgtggccttgtgacagtgcatggaaagcccctagcaccactcctgcacatagtaggaggtccacacatacatgacagtgtggattctgtggttgcagacactcctcttgccctcagagtcatatcgcggtgaagcgtttctctctgtgagctcagagtccagcctgggattggtcagacatgaaataggttgtgcatggtggtcagtgcttgggcggtggctaatcatgtcaccccagagttggccgaggaggaaggggcccggggggaggctgccctgaggctgtgggggctccaagggtactgccaggggaagaatgggcactctgcagttctctcctctagcccagggtgttctgagagtgtccagaaccaacaggtctgctcagacgctggacatgaggttccacttggcacacagcatgacagccttttcccctgcaggagcgttaccagaggcaggcaggcagcatggaggtgaagggaattggaagggcctggcatgagtcaggaatgagtgaggatgggggcgaaagcaactccgtgcagtccagagggagctggctctgggttcagcccctgtacagctccacagcctgtgccctgacccggatcccagtcccagccagttactgtgcacaggggactaagtgatgaacctcgttctctggaggcagcagggctgtacagagggtccagacaacctggagagagagaggctgaagctgcctcagacttccctgggcagccaccctgcttggggcaacaccgctcagcagctagaggagttcagggttctgaatcccaatctgtcgcctgcgagctggagacctggggcaagcctagcctgtctgactcctcctgccctcttcagagctcacgtctaggagaggtgtaataactgcgggtgtttgacgacttcagcactggttatggaagcaggttgaagagttgtgacgagacctgcatgaacagcctaccaggcgtgcagcccctgcactttgcaaatgacctctagtccttgtcaccctgggacaaccctggatctttctggacctgcctgaatcctctggataacctttgcagcccattacctcccccaaatgcacacacattcacacacacagccatcaccgtgtacagatggagctccttcctctcagtaagtttctgacctccatcctgcccctcccgctccaggcagctccactcccggctcctgatctgctcccattcctccaccgtctggcctcaccaaatactggtctgtgaatggcctcactccgtaagtctgacgccaatgaggtccagcttctccagctcattcttctggctccccacctcctccagcaagatttaaaaatactgcgcatatgagagccggcacagggcattgttgctccccgtttcctttcttgctgagtcagggtctaggagagcacccacagggagtcctgcagccccaggtttggcccctggctctgctcctcatgaggtgtgtgaactcagccagttgttttaccttttgagacctgcttcctgatctataaactggaaataataatagtaccttccctccaggctgtcgtaaagattaaatgggaccctatatgctgttagcatggtgcctggcacagggtaagcatttaataaatgttagctactgttattattttgtgcctaacaaaatacttagagtgaatgacaggaaaaattctcctcatgtattcacccgacaaatatttattaaactcctgttttcttccaggcactgtactaggcactggggatacagcagggagcaaaacagtgaaaacccctgtcctcaaggagcttctatgctggattccacagccacacactcaagtctttgttgtcagccctcctctcccttagtctgcaccctcccctgagcctctgcctcagcctcctcccgggctcaggattccctgaatttccctctcctcacacatcctgtctctaagctccagatgcgcttttccagtcacttgcaatggggtgacctgcagacgctcaaacctggcacatctgaatagtaactcacaatgcccaaccccttctcaaacctgctattcccactgggttccctgaggagccactgtccagacccctcttcctccaacatgcagctcttctatcgccatcgccaccatgaatagagcacttagtgcaggcaccatgctaaaagcttttatttattaaatcatggaatcccctgacgtccctaaaaaccattccacttgtttgcagataagaaaaccgaggcggaaatcgttaaacagccttaggttacacagttaggcagagcccggacaaagagcccaggctgtctggcctcagttgtgcttttcctgccgctgtgctgtcctgcctcgggtcccatgggcttgcctcagctgtaccactgacctcaggcccctcctgggccgcatctagctctgccctgggctattgaagagcctgctcactggtatctctaattccctctggcttcaccacagaccctgctgccagggctgcctatgatcccctcccttacaggcgggatcacttccccagcaccaccacacccctgcacccctgcaattttccattgtttacaggcagcctggccctgttccagaccaacttccccagtcccatataacctctccaagacccttcttctccctactcattccccacgtgttacagccaggcaggccgtccaccccaatgctttcctaactcccgtggcttcctcaccccgtctacctttactgagctctgtatcctttaatacccagcctcaaaggccgtctctgctgcaaagccctgcctggttccctgtcagactcctctggctctctctgctgtgcccccacgggtcttcacctctggctgggttgacttcataccacctgggattattgtttgttatctgtgtccatctgtgtcctccagtaacccatgatcttcacaggccagtgccctgtgttagtcatctctgggtccccgtgactgacggggctgggtgcagtgcgagcctcagtactgaaatgaacagggccggcctacgaggtcactccgcgatttggggcaggaaagatctgagtttctttctgcactcccgtcgagtcctgctgtagaaaccacaaatggggaatgatcgttgaatcccagaagactgagcaggaagggccgctgcaggtcatctgtgttaattctttatctttgaaatgttggagtgaggcccagaaatgagaaagacctagcccacgatcactccacagggaggagttgtggttggaattcagacccctggcttctagcccagtgtgctttctgctttgctgaaccattccatctttgctttttctctacacaaaccacctactacaataacaacaattgcttatgctgaaaatcagcccagtctcatagctctggaacctctctttgtccccttccagataaccacaggacactttattttacacttttgtcataatgattttacactctcatttttaaatttagtattctttgtattctttcggggggggggggtaattaaccctaaattcttgtagagaaattaagttcttagagtagatttctgggttgcttgttttcttccattgacgtttcacatgacattcctgtccaccgtcacactgcttcagttgttgcagatgtgtattttcctatctaatgggattggtgctcctctcattagccgtcatcagaaatgtcttttattttcctatctaatgggattggcgctcctctcattagccgtcatcggaaatgtctttgcttttcttacctgttttgtttgtttttgttttttgctgttgtttttttttccttccagataatctatacctgggttatctagaggaattaggggcagacgagtagcttatcccagtctgccctaatcatgggcatccacacaggtcagctgaattggccactcttaattcatggctctgaaaatggtaaaaacggccattgattgagagaaacaggcaaaaaagagagtagtgggggcaccaatgccctgactaccccaaactctcactgctgcccactaatctgccatcctgggatgtggggcaggatggccgcaccgtgtgggcatgctctcacgggaaaatggaggtggtgttgctgatcgacactagccagcgaggcaacatggccacactggctttcttatcacagagcccacgttcacaaaccatcttggggctcgccctcctttccttaaatcatcaccacagggaagcataaaaaaatctctgtacattatcaagtttcagaatccccttggaattttgctttgaactaaatgaagtctcatttaggaagaatgactgtctttaaaacagtcttcctatcatatagaaatacattaggaatctccatttcttcaagttctttttataaatctcagttgcattttataatcttctttatatgaatcacaaatcagtctcattggtattattttaaaacttttcatatgtagtcttgtaccactgtaaatgagatctttttcattctcattttgcaaatgataatttttttatagaaatgttcttggctatttttccatctttttatctggcaactttactcaactttctgattctgggggttttcttgttgattcccttacattttctcaggtccagtacagtaatcatgtgcaataatataaaccatgagtcctttctaacatagtagactaataactgttcatcaatgcccccctcaggaactttaaagaaatacaagtagttgggccctcctcggtccccactgaaccataacttcagtctcagccatagggctttggcttgcggggcagggatgggaagtggattccagacccaaaagtctgcaaaggtggagaaagcctggcttctctaaaagcataccagtatagctacagaccagaaacttcattgctttgtaggaactttttaaaattttggtctgtgagcaagggaagtgagtgaaggatttgaagcagcaggtgcaaggatagatttgcattatgaaaaaatcactctcactgccatgtgagaacagactgcaggggggctggagggaaagggggtgcagatcattatgtaaccacagctaactcttaccgcctgttttaagtggtttatatatattaactattaagtccccaggacagcccaaggcatacaggtggttcatggcagagcacatttgaattgttcctaagcactcatcacctcgactctttttcacggagagggtgggagggacttcagacccacttacggagtgcatcctgcgctgccatctgtcttctgggtgtgtgactgggtgagggtgggtctgtactcaccgtgcctttttcataggggtaggtctagcctgagtgttctgtacactgctctcccagggaagtgggagcgggaggtgagaaatgtgtatccttttaacataaattatcagatggggcccatgatgatggagctctagtgatgttgggtgccttggaccttatctaatccaaccccctcatcttatacactgacacactaaggccaaggaaattgggaaggcacttctttatggtcatataggaggctggggacttaggcctaaacttgggattcctgacatccaagacactaatggtgtttttagatcaagtgagaacatgggcctacaacatcagcaaatgtctggtcacctgtaaggagcaagggaagttttatatgagattcatgtccttcaccaaaccgcttcagttgtctgtcagagccaggaggatggggtggaatacagttcagaataggcaggctgagatgcagatatggggagccacagcatgacagagagagctggggtgtgtgcggtgcagggccaggaggctggggccaagcagaggatgacctgagctagaggaacacacagtggcccgaggcccctcccactggggaagagagacctctgaagtccatctgagggccaacccaacttgcctgtctccagggagaccccagaaatcctcagaagtgtaagggctgggacagggccacctggcatgagatgcccagctcagaatcccagggcctcgtcctgctaagctgagcccccatcctcagagctcccacctgtgccttcctcaggatggaggtacaggaaggggccactctgcagcagcggagagggtggtgacagctcagcagacacagagacatggagagcaggtgggctgtgatcggaccaggagtcgggagagagacacagtgatgcaaaggacgcagagggggaaggaggcagaggcgggtactgccccacagccccaccacccctgggcgtgatctcacctgaggaagcctagaaggagtcttcacgcgtcgcctcctccaggccagagctcagcttggagatgcagagggggaagggaccctctcccttccttcccttcctccctcctagagcctaggcagggcagcagtggtgggaccacctgttctcaccctcatctgcggtgggcggcggaggccccatgccacaggcttggtgaggctgagtaaatccttgctgctgtgaccacccacagtgcttctgcttccttctgtataatagctcctcggggagctgccagcaatcaatgagacaatacaagcgagcacttagcacagtgctggccctgtgtgagggctcagtgagtgggagctctaagtactaaatgttgtcccatctccgtggtgctttggacttccagcacagcattcacagacacacgtcccttctcagttcatcctcacacactatgtgcagtaggcaaggaatacgttgtctccaatcaacagatgaggaaactgaggcgagcctggggaaagtggtctctggtcacccagtgagttagcagcagagaggataagaattcagctcccctcagtcttgtgtgttttcacagctgtgtttcttacataaaatacaagaatgctaacacaaaaaacaataaagcgagaattctcaccttatttcagagttgagtaaactataatcatcttcttttgtctcctaacagccctgctttaaagagtcaaagtatcagagaacgtttagtgctaaaaggagccttagagacagtcccactctctttcatgaagcacagagagaggacatcctcacttaaggtcacacagcacattagcaacttagccaggattggaacctggcactggtgttctttcctctatagctgctgcctccataggtcttggaacttttatccccacttcagagtctggaaaactcagctcacagcttgactccaatcccatagcaccaccttttttgggactctgcctcctcagtggtggctctagagtctgatatttagaatcagcagcagcaaaagggaagggccatggagcaaaaaggtggtgtgttgggagtaataaattttcaaagagtttaaattgcatttcagggactgattcctcttgttggagagattggtttgtgaattcagaataggattgtttaatatgcatttcacattttaaataatcatggttttcttagagcagggagaaaaacaggtcaaaaacacaaactcataggcttttctgaaaggttacaaaataaaatgttctttgctggaggatataaaggaaatggctcttgtttgacaaaggagagggctctgctagataaattctgcatttatgaataaatgaaagctctctcccgctcttcctgatcaccttaattccttgttgcctatctgcaaatccaataatgctggtgaaacaaacccctcctggaggctgagcacaggggcctgagcgctcagcctcagaaccactctttctatttataatctcagcctgtgctccccagagagctgggcttagatgccccctgggcaagtgggcaagaggacttgctgggaacagaaccttccccgggtcagagaccctgtactccagccctgggtctccctgcctaggaagcactcagcaaatgcctcagaataggtaaagagcaggtaaagagcagaaccgtagttcagcatcatccttcctgcacttcctctgctcccttccaagataaataaccaggctaagaattgcaggtgtttcttgcagccagttggctattgtcttagtgacacaccatattacactaggcaactgaggatatgtcaactcgtaaggcgttactatatatatgggtttttgtggtttttttttttaccaaatctattttgtaccaatagtgtgtgtttatcgtctgtcttctcttaacattgggggtggggatgttgtctgcactgttcagggatcactaggaggtcttaggggccaaagctggagctaagaggaggttcaaacacctggaagaaggggccacctggaatggaggatgtggcccctagggtggcaaagctgagacactggactgtgtctctcactctaggcatctttgtatgaaaccacatatgtgtcagctggtggggcttttttatagagcattatactcacctaaaatattgtattccatctgataaatccattactttgtcattaaaaattctctataaggctgggtgcgatggctcacacctgtaatcctaatgctgtgggaggctgaggcaggagggttgtttgactgaggagtccaagaccagcctgggagacatagcaatactcaatctctacaaaagattttttaaaattagccaggtgtggtggttcacacctgtagtcccagctactctggaggctgaggcaggaggatcacttgagcccaggagttcaaggctgcagtgagctacaatagcgccacttatactccagcctgggtgatagagtgagacctcgtgtctttttttttttttttttttttttttgagacggagtctcgctctgtcaccgagactggagtgcagtggcacaatcttggctcactacaacctccgcctcccgggttcaagtgattctcctgcctcagcctcccaagtagctgggattacaggtgcccaccaccacgcccagctaatttttgtaattttagtagagacgggtttgccatgttgcccaggctgctcttgaactcctggcctcatgtgatccacccacctcagcctcccaaagtgctggggttacaggcaggagccactgtgccaggccaaccctgtctcataaaaacaaaaattccccataaaggatgcttagtgatccatcctatgaacactgaattatttacttaaaggagtcctaattaatagacattttgtttatcttcccccagccaatttcccctattagcaataaagtttccatcagtatctttgtacataaacttttgacttcgttttcaatttcctttgactagttttctagaataggaattaatgagtcaaagggctaaggcgcccatcatctggttttctctggaggaaggtagttctctgggctctacaatgctcatctgcctgaatctgaatttgaactctatcacttcttatcagtgtgactttcagcagattatatataaccttttagttgcttcatttgtaaaatggggattataatagtacctaccttgaagtgttgctctgaggattaaatgggagaagtgatgtgtaattgttaagttgaataggcataggcatgactcatgagatgtaatcataaagcaaactttatttttgtctcccacagtctctttaaatttattctatagggctgttttcccttctaaaattatattaaatttagggtaagtcccatgacttttctgaccattttcaggtaaccagaggttgtcttgtcagtaattaatgcatcctgtctgctgtaataaaaaaaaaaatcttgaaacgtcagagttacaccatctctttcccagcacggtctgctgtaggccagctgcctgtggggaccttgcacatgacagtcctgaccctttccagggtccaaggtggaggggcaggtaggtaggagaggagatggttgggaaaggtcttcaacgactgtactctgatgagttgctgtcccgttgttctctgggccctttctctcactgggctgtttttgtgggttggtggagaccaccccatcgctggagtctcaccctgcacctcccttgatgagggtgatactttctccccgtagccgatcctatggtttctttctcaggctctgggaaacctggtctccctcagtgtcacctcctcccttggaggagccctcttgtcctggatctaagacagtcacatctggctctcttgctgggtgctacctctgtccacaagagacactcatgtgtgctttgccctgcaaaccagggagcacaggctggtcctgaagcagcagcactcttgctgctctttggatttctccactgtggcaccaagaccattttggccacatatcaactgacttaggggtctcctcaaggccccactgtctggctttgaggtgaaggtgatagcaccctgtacccctcccatttatttgggatcactggaccccaaaggctgtctctgaaattcattctaaacctccaacaaccttttttcaacctctctcccattttgtatgcattagagatgggtgtcagctaatggcatggacccaggttttcgccacctcttttccaagaggtgtatcccacttcactttggaatgtggtatctgttcatttggagccccaagtggatcctagactggaagcatcccatctcatcctcccattgccatatttgtctttatgaaacacacagaggagcacctggcatagagcatgcactcaacaaatgatagctgtgtatgatccaggctcacggactctctagttacattcacctcataaccattcgatctggttttattcctattactttgttttatgccctatgcattttatgtttcctgtagattatgcttttgtgtgtttgtgtgtgtggaaatgatttgctattattttcagcagtgatttggaaaatagacattgcttttaattttactagtggttgacctacattttttttcagacattgtaagcctatttatctcaatcatcaacagtggtgcaatggtctttgtatattctgcagttatttaaatgggaattacagagggctttatctggccacccatagttatgctaccatcttgccatgatgtctacccacagcttcaaaatggcacttgactctgttttagggctggctcatctttgtcctggactttactcatagctgtctagcagtttgccataccactagcctttctcccgcaatcctccattctgctcccaattatttctttctaaaggttacatctgggcagattattcttggcttaaaaccctctagtggtcccccactgggaaccacatccttagaacagagtctataggatatttccaaattataggataattgcaaacgccctagcttgatgttcaggatgacatatgacctggccctgccttaactttctaggcccatttcctgccacaccgaaccattcacctattggttgaatgctgccatgctggtttgcaccttggttttcaagtgcattgggcatgtactctcatgtctgcgtaactttgctcatgtcatcctctgtctgtatggccctttggtaaaagaccctagcacagtgcccggtcaattgtagaatctcagtaactgttacgtttccctcttcctttgttatcagcttatcaatatcctattcatctttcagggcccaacacaactatcatccttttccactcttgggaaggcttgtcctaaccttatctccccccttctagggacttccattgactgcctcttttctgtgtccccttgcccccagcacattgtacacttgtgttgtaacaccaacaccttaatgtagggtacagtcattatttcttcctatctcccttgccagaccgaaagctccctgagagcagccatgcacctgacccccactaaggccactgcagccctgcatcagcctttgaggggctagttgatgtttgattgatttgaattgccttcctcagactgcaaggtcacaatgccaagccaacagacagggcccaatttgaatggatatcatttatcattcatatccctttgcttccaaaattgactagagatggcccacactcaataaaaatgtcaccttaagtatagcacatataagactccatataggtggctaagtcccaaaatgctaaccttcttccctgggtgaactgattctgcttgggagagggggtggccctggggtcctcaagctcaggtggcagatgtgagggtctctgttgggctgcttcactccccatgcattccttcactccccctcacaaacatttcatcaccacgtttgaaaatgcctaaaatgcaaacaggatgatttaaattcatagcaaatatcttacccttgcaggatttgggcaggtggtgagggaggcatgttgggattgctgtgtggtggtgtttcagtccagataaccttgttcctggggctaaatttgaaaagcttatgcccttcttcgagggtcatggttatagtgcagttgtaaaaatataacttttgatcatggcctagtataatatacatcatatgactttctggagtagctttttgatggaagccaaggacgtaaacttaaaatgtcaaccacggaagtcatttgagtggaaaaagccatcatgcattctgagtagaatgttaacactcatgcactccatagaactcgaagaagcacacacgtcattctcctgcacgcgtaccatccaacaaatgttcttgtgcagtcctgttcagactgcagggccatctctcacacacatacacacattgctgcgtacactgaaacagtcctgctgcccccaacttcccatgcacacacacactcaaggcatacactggcacacagtcccttgtgtgccagtgtatgggactcacacaacccatgtgcatacacacatgtacacacatacacactcatattcatgcgtacactggcgctcagtcccactggctcccccacatgtacacacactcacactcatgcatacactggcgctcagtcccatggttcccccacatcccatgtacctatgtaacttctgcagaaagagacttggaaagccatcttacttctgcacctcactctgcctccagattttgctcccttaggacagagcctaaactgtctatttaatagattcaattactccaggctcctgagaccttccaactaaattctgattgctttaaggtgtcaggtaatttgggaataaagggaggaaaacagcttcaaattcttgaagggaaagtcttttagactctagctgtctctgacatggtagctactaattgcaactcaggaaggggtggcctggagggcgcggcctccaggggtcaaagcttctgatctctaggcaaggttctgccctgaaggacagaggcctctggggcaatgctttgctgctctgctgcggtctccagggtagggaccaatctctgctgcccttcctggaaggccagcagagtccaggccaagcatcccagcaggcaacaaaacagccctgctttctgccttctgcaccccactcccaggtgttttattttgtctgctctctgtccccagtgacagtgacagctcttggaggttgataaataatcagaggtcatagtgttcagagagcatcaatgttgtgcccgacagagatggatctgacctgtcctgagctccagaagcctggagagagaggccatgtgtgtgtgcatgcatgtgtgtaggtgtgtgtaggtgtgcgtgtgtgtgtgcatgtgtgtaggggtgtgtgtgtgtgcactacatgaactgtgattggccaaaaggaggctgagggtaagtgctgtagacccagaccttttgtgtgtgaatgctagcttcatcattgaccagctgtgtgactttgggcaagatccttgccttctctgtgactcagttcctctgctgtgaaatgggtatgctaatggtgcctaccttctagggtggctatgaggattaaacgaattataatatgtacgtagcacctaacacagctcctgacgcccagcaaataatccaaatattgtgggttattgtgttttataattaatgggcaagagaaggcaaggctgaagggctgggagagccctggggtgggggtctggctgtagccccagggcagcaggatgagccccctccctcagcccccttggctgttctcacactctctgcggggcagtcctgaccgcctatttatcatcagaagatccccgcacaacactcttctggcgcggttggcgcggcagaatccaggatgcacacgaggacgcccacggggcgtgtggggaccgtgcccctccgcagacctctcccggatcacctgctccacacgcaggccttggtgacccctcagcctgctgctccttgcttccgcccgccctgctgtgggtcccgcaccttctcagtgtgccatgccttgcattcaagctggtcctagtcacagccaggacctcctcagcgcgcagagactttcagatgatctttgtaggggtttttgcctccggtcaactgcgccccttaggaagggctttggaggacacagatcacagaacagtttcagctccaccacttcctagctttacggccttgggcatctcagcattcctattctctgggttatagggatatgatgtttgtctctcaaggctactgtggagattacatactagaaatttgcaagggctgggaatgcaatagaccgtaaatgttccccttcccttgacgctatagcttagatgggagggagccactgctgaggaaacacctccttaacccaaagacagagggttccccaggcgggggtgtgggaactcggaggtgggggtgagggaaggccaacctccacgcttcggcccggaggttcccccgcctcttcctgcacgactggattccttctccatccgcgcctccggcccggtccctgccccgccaaatccgcgcatcggtttcccatcccatagcgcagataggtagggcaggtacacagggaggtgttcgaatgatccccgtttcacagaagacgaaactgaggctgggaggcctggggactggcccggctgcagcgccgccgttagccgaaggtgggagccggcgcggtcacgcgcatggagcgtggatcgcgacgatttcgggggagggggcaagggcgctccgcaggccctgagccggccggggggtggggtctctgcggggcggggcggggcggggcgagggagaaggggcaggccgccgctgccacgcagtactcccgccttggcgccagaggggcgcgggacggtgcggtcggcctccccgcctccacgcgcgcgcacgacccgcgcactcccggagcttcgcccatctcgcctcgccgcgccgcgcaggcagccgctcgcagagccagcagccggggccctggcgtgcagcgcgggcctcggcggggcccagcgccccggcccgggaggatgcggcccggggcggcccgggagctgagcagggcccccgcgccggcccctccgggccccggcctccagagccgcagccaccgccccgcccccgagagacatgacttccaagccgcattccgactggattccctacaggtacgcgggcgccgggccggggcgcccaccactcccgactcgggacgtgagctggctggggatacgcggccggggcgcagggcaccgctgccctccccacctatcccagcactggggcgcgggttggagtcgctggtccttcctccctcaactttgagggcccctgcggactgctcccgcctgccccgctccacccccttatctgccagggttgctggaaggggcctgtgtgggccttgttgggtcaggcagcaccatgtggccgcctggggaaggagtccacactgctctgagccccctcctaggcccagaaccccagtcacacgcctgtgcagggtgcgcgcacacgctcatacatctgcacgcatgcacccacaggacgtccctgccttgggccaaagacgctcctgctggtcggttcacactctcaaagcatggatccgtgaagacagttattctgaaccaagagcacaccagtggtcatgtggacatgcacccgtatattctacacacaagaattcttgggctcacaaagacacatgcctgcatatctgtgcacgtccacctcctgtatctggagaataactgacacctgcttctcactcacaagtgctactcagtctctttcagacactgaataatctacttgctagcaggtctatacctagacacacaccagctcacagtacatagaactgccctcacatgcagaaaggcactcaagaatccaggcacactcagggaagccccccaccctctgctgccaggcactgtggtctatctcaaggatggctgggctttcccatttgcctgggaagggggcggggaggtggtctctggggggcccctcacaggtgcaggtctttccctatccactctactccattctattaccagggaagggagctcatcgccatggcagcgccagattcttggccacccattggctccttggttgccatgggctacggggctgtctctgtggaaaatgggtgctggactcctaaggcccactgtgttattgtcgacccaggtgcacgtgctagcggacggcaggatgagatcctcaggtcccgccttgtaacacagcttgctctctgttagagcctcataccagtcactgatagaaaatagttctgacagggctcttctctgagtctgtccagacagcgtcccaaatggaaaccagctgaaaccgcccaaggcttcttaaaagcagatccttctgaaaacaggcacgtggcctgggaactcagggtttctcttgagaattgttacctctaatctcagctcctgtgggggattcaggggtttccaggttattttgtgtctctccccacaaccaccagcaacaccctcacacgtgcgcacatacaggtcacccacaggctctcctgcagacacatgtagtcacacttcagtctcacatggattagggagctgtttccatcatggaaccagggactggggctgtgctgactgagaagagctgctgcgccagacagacgtccaggctggggcacaggtagtttctggaggatcctggcctttcttggcacatgtgggctgaggaccttctagaagacagtgcagccccatggagcgtcatcaaccttttctagccacgcggcagaggtgcctgggcggtgcttgtgggctgagtggactccggtgctgtggaagtacctgtgtgcgggggtccagatggcagggtggtggccatggaccgaggagggtgggaggggcagcacttacggctgtggagattatgacgtggttaggatctggcaaactggaggttgggccaggccaagacatggttctagaaagcttctcccagggagccagggactaaagccacttgtagagagtgtgcaggggtcttagagaaaatatgcctcaaacggaatggcttaagcctgttcctgggaaaggtggcccaggaaggtagaactgtctctaggaaatgatcctgttctagcaagtgcctagggccctggcatcctgcaaggagtgatttggcacttgcctcagcccaggtccaactactatctcccctccaccgccacccctccaattcctttcctgggccgcagactcagccctgaagcatagaatcctgcctccctggaagcctggccccgaggagcgtctcaacacccttatagccctgcactgcttgctttccccatgcctgtcactccacctcctcgttctgttgtagagaggggggtgtgtagctggaggcaggctatgtcagcagttgccaggatcccccctgccctgctggggtctttctgggcacgcactgagtgtggcaaagtactggaactggggtgcagacttccaaaatgggagacttgggctgagaggaggagattcaaattgcctcttgcattaactgggctgctgattgcagtcaaagccacatgctgtctgatcacagagaaaactggggcagaagacagacaaagcattttacttgcagatgggagtgggggcagggggtggcatgcacgtgctttgactggtgtgaggtttccctaatgtcacagcatgtcagagctggaatgtggcatttggtttgggagagaggggttggctggcttcttgctggttctgctggtgagggttttactccctctctaatggttacaccttgcattccctgggcccagcttattttctttagagaaatgatagttggtgataatcttcttatgggtaattttggctcagtgtataatgatcatggattaatctcacattctgagttcaaagggagccattgagtttataaagtttaacaattggaatgtttttgtcttttgtttctgttagtactaataatttctaattctgccagtttctctttacctgtgttcttgaggaatattaaatgcccttagtacatttacagccttttataagttgtaagtggagcagtgagagtcaggaaggactgcggcccacggcgtattggaggactatgctgggtgggattggggtggccccgtcctcagtgcccttgtcctcatggtcctgaggccattgcctggtgtttctctcacttggtcatgaactaattgagatcagggaacttatctggttcctggtcatgtccccagcacagacaagacgtccacttctttgaatcaaagtggcatcccgggatagcctctagggcttccttggctttcccagccccacacctgggttctaagcacacctgagggatacagtactctcacatcaccatgggacctcctggagcactgcttgaaaagcattctgtaggtcacagaaagagaatctcagactggaagagcctttacaggtcatctagttctccgtgtggatgctccctgtagcatccctgccacacggcctcccatcagatggctgtgatttctttcaagttcttccttaggttgaacctaagcaagtctccgggttccccctcctcctggcccttgttaggatcctcccaccacttcctttgttttgtagggagtagtgggactcctgacgccttccgttctgctgctaggttcggcctccgaggtgccctgggcacttggacccaccactttacttctggcagccttataacgactccctgattttcttgttgttctttagagatcaccagctgtggctcgtggtcgcatttgcatggctgagcattagaatcacccatggcacttgcttttacaaagagagagaggagtgggttgattctgggggatgttccccagcagttctgaatgaccaagtcagggcttagtcccgccagcagtttgaatgcacctgatacatttgggaactgctggctggaatggggacggcacatcctgggaggctggaactcctgtgagcagtgtggtcctctgccttctggagctgcactggttcccactgtgtcccagtaagctgccaggcgacagaagccacagatctggacttgccgggggtccagggttgcagccaggggcacagggttgcagccagatgccctggtggcctttcctctcctgacagcccacatctgtgatttcctgggtccagcaggggtagcttccactgtgactgaggggaaagaatgagggcaggaagaggagaaggtgaagtcaacatggaaagtgtggccagagggttgggtctgtccctagattccctgacccctgggcctctggttagcactgatggagtagctggagcatgtaaggtagagtctctgaagagagggagttcggaaacaggctagaggatgttggctgtgtgtgcttttccagggcacagaattgtccttgtgtccttgccccttgttgtcaatcgtggatgactgctctgatatctgtggggtgccttgggggaagtgagtggatgtagaggggcaggttccctgggaggtgaagctgccacctcgttggtgctggactgagcagatggattggtggacactgaagcctgggtttctctgccctcatgagccagtggctttcctgagcctccctgttcaggcccccagcaggaggtgcccgtgatgtaggagactccagggtcagctgaaagacctatccatcagcgccctgtctcttgtctgagtctcctggcggggctgcagctggcagcctgggcttggcagttattccataattggagctgaagtcattaaaaaaccattactgtctccttgtgtggttatcgtttaggtcagcctagaacagggcccatcagaaacaggcaggctggggaagcgtcggtgagaaaggaagatgccttaggaatggtgctggggtggagatgaggaggaagggccatctgggtgggggcggagaagggaactgggcctattgaggaagccaggggagcttttggtgctgctcttcctggagacagccatcgcagttgcccttggtctccacaacagctgctgttggctggggattctttgttattcaccagggagagttgttgcgcacttgtcgttagctaggaacacccacctggtacaagcttgtcactgctaggtaatcgtggtcccatctcgtccccttgcagctcttctagaacactgctttaccaggaatcgtgcccactctcagagcctccccattttagtagatttagtgtagaccctcctagctgggtcttgctcagccaggcacaggtggcttctccccggtggccgccccccagctgtgcatgctcctttccttctgtgtgcttgcacatgcccgctggtgggtgaggtggtaggtggctctctaggtactttggggatgtctgaggtttctggagcctcttcagtagcctagcccttgtgttcatccatatttctctgaaggccagtggttaagtcctttctccctgttatcttacctagtaatcagggtcaccgaagcctgtggctctttatcattctcccccatcaggaaatggaggtggaggcagaggaggagaaaggaatgttttcatggaaagcagcctcctgcctctggcataactgtgcatagtccatggcaagtgggatggtggcctctggtagggaaatgtgccccctgcatggatgagagcattaaaaggcactgggcagtgaggccactatggctggaaatacctttagtcagttgagcagctgctgtgacccagcatttccggaggtggcattgctgatgtgagtcttacctctcagctggatgtccccttttctaaatgactctagatgtgagcgtcagcaccatggaagtcatcttctttgtcttgctcagccaagcccagggctggggatggcccaggtgactgcccagtccctgccctctgaaagtgtgagtggcttgcgacaacctagaaaactgtggaatggcccctcctgctggcacaaagggaagccagcactgtcttgtggaggttgcacaggggccaggccactggcttatgacagtggggtttatagctgccctgtgcccaggcacagagcttggcaagcggagggagcacagttggattccagaccctgttgctcctgtcagccaggggccactgtacagagcttagactgcatttttcacgtgtgtcctgaaagttgtgatgtgtatgcactgtgcgtgtggctgaccacgggggacactggtgttcgggtctgaccctttcaagtccgtctgtgggcaaatgctttgactttgcttattcagtcaggctgttggcttgagctgtagagatgggagggttgtagcctctcaggcctggcagggccctcaggcattttgcgctctggtcctgaaccctttcttcagaagtcttcactgcagtcctccagcctgggtgtgtgccttccacaatgggatgcccagcctctcagccagctggaatatttagggacctggttgcatcctgtggtcctggcaatgccctcagggagccccaaatgcagctgtgccctcttaggcagatgggctgtttcaagaagaccaaggcctagaagtatggctcttgagcggtgttttctcctgtgctctggcagctgagggtttggtgaatgaggctgttgtgcacacagccccagatcacagctggggctcctctgacatgcagagcagctcgtgggtacaaggaaagaccttcccagatgtcaagtaggcaggacacctgctagttaaaaaacatgcatagtcctcatagatcgtggccaaggtggtgggcagtctgtgttatgggggcttccttctaccctctgactggctcccttggaggtgcaagtagttgaaggctcatgtaggtggtcaatgattgttccagctagaaagggctagccatcaggaggaggtgaaagtggcttcactttgtcctcagggtgatgtgacctcctgtttcccctttgcacgcacactgcgctcaccttcacacgagcacacccacttcttcacaggtgtctgcatgcacatgtgcacacacatgagatattcacacacttccttatggcctcacacaaacctaatgcactcgggcacgcctgtgcaggaacctggacacagtctggttcaggggcagcttcagaataactgggccagggccgcctggggcttccccagagctcagatcctcaggctccaacctcacctcatgcagctgtccacaccttggcctttatagcatttgggcctaggtctcatgcatgtgtctctggctagcaaaaagctaagtgatttgagttaccagttccctacttgtgccctgccttcctcagaggcatggccagtgcgggtgagatgaggctccctgtcccaagactggtggggctcaagaatttgatgtccccagggctgcctgtgccatgtctgcagcccgggaaggacctggtagctggttgctgggctgtacattgatgtgttgtgtccaccctgcagacacctctgtgtggcccaaaccctgtaggctgagggactggttggtctcttagcttcattctctcaaatgagaaggaggaccctctgccctctttaagtggggaaggggagtagacaaagtcaggactctactctgcccacctggaaagctaggagtttgctttcaacggatggggaaagggtctgccccagaggacgcagcctcctctagaatggtgggaaggaaggaaaaggctggggctggtgagatcccagtagggagctggagggagcagccccctgggtttgtttgaagcctggcctcgggcctggcttgttgctgggatgcctctggatagttctcttggatctcagtcaggcccggccctgctcagggatctgaggggagggtctcatccggtatttactggggagtccctggggaaacaggggtcctagcaggcttccaaagtggcagctcgagcccttttggttcaagctggtttcaagatggcaggctccacccttcctccttctaccatgtgggctcactgagtcccagcagccgtgatgggatgggtttaacgggcccagatatgctgggggtgggctctgggctgtatatcctggcacctcacgggcaagccctgaaaacccctctttcgctctgcagtgtcttagatgatgagggcagaaacctgaggcagcagaagcttgatcggcaggtgagtaggcctggggccgggtagaagggaagagtctgggctgggatctctgagggcagaggggcagggctgtccatcttccctggatgatcccgtctgattgggggatgggattcccatgtggaagaagagaggtgcactctctcccagctcagcactaaccctgccgcggcacatgggctcctgccttcaggcagctgggtgactgcagttggagggctggctgtgctgtgatcctgccagggcagccacctgggccctgttttgcctccctttcctggaccccaagtgttggggtgccaaggacatggggccttggcccaaggtgggctgtggaccccccgataactgggagcccgcccttcctggtggaggcagtgggtcagccaacctctgtgcctccatagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaaggtataccttgcctgctgccccacatcccgtcactgcttcggggagcccgtcacttcctgcccacctaggcaggtgcggactggtcctgacgggggatgcccaggctgtgtatggcttccagcccaggcagacagctgagtagggagggcagagggaaggtggacctgtagccttgggcgcctgtgtatgctccagctgacacctcctgaatcaggcactgaggccagaagcctaaaccttttatgaggccaggagttcagaagtccaagttttgatctggagcatttcactgagtgcaggaggtagcttctaagagtagatgacctgctccccaccagtattctacattctgagaggaatccgtctcactgtcctgccccatatcaaccagtgtctcagtacaaacacctttttccttccctctctgcaccgtgtctgcctggcttctgacttgcagatccctctctctggctcacaactccttaagagctgtagtgacctggagcctgcagctcccatccttaaatgttccaggtctcggcagagcccagttgggagaaattctctgcagctcatcctggagagagcacatctccagagatggctgcagcacatctctgttctcaggaccctccttcctgcttgggttaggtgaagagtaggccaggccagactgaggggttgggggtctctgagcttgaaaggaggactcagactcagtctccactgccccctgctggtgctagtaatccaggctgctacttcatcaaatagtaattctaaaaaggttgcaggcatctggcttttgcggttaggaagaaccttagcagtcgtggtgctcccctccttctgtggcttcgttatgacctggagcctccagatacatcgaactactggtagttgcctcacctcagggctgagcttcttcatctaactgctggcccataccctgcctcgcagtattttaggttcttctctgggttccactgacccatagctccctgagccctttgtctgcacattggagggcagcaggtgggtctcacttgcctggtgcccagtttgtggctgggcacaccatacaggctcggtcccctgtgtgcatgtgtaccctccgaggaagcctactccgtttcttctaacaaaggctggctgtacatctgccagtggctaagtacagtgctagaggctttacctgcattatcttgtttcatcctcacaggaactcattatcctcacatcatcagtaaggatgtgggctctgaggggctcagtgacctgctcatagtactctgctagtgagcagcagggctagaatttgaacccagacctaacagacgccaaatggtctctcctccatattatgttgcctccctgatgaaaagctccttcatgctaattcccctgtgtgtgtgtcagttcagcaccctggccatacctggtatgcctgtactctacttgagaggccttcagaaaaggggaccagggacctcagcccagctgtctcacagaggcagccccagctgctcctcacagagctggccccagccccaccctttgctggcagccagctcctccacttcctttgtgagtgccatcccaagggtggtagtggtaccctgccaggaaggtggccaatgttctgggtcatatggcgtgtggcctgtggctgtgtggcatcacagccccagctctgccaagcctggcacctgggcgagtgaggctgcatacagaataggggcctgcacccaggattgtgggccctgccaatttgtgccagaggccaacatcgtgagaggtcattgacgtgcagtcgttttggaaggtatttcttggcagctgtgttccagatgatgtcaggacatcagaaagactgtggtacaactagcgcctctggcgtaagtgcaggactgaagtcaaaagacagtttctgtgctaggtggctcacacctgtaatcccaacactttgggaggccaaggcaggaggattgcttgagggcggaagttcaggactagcctgggtaacatagtgagaccccatctttaaaaaaagtgagcagggtgtggtgacacctgcctgtagtcccagctacgtaggaggatcacttgagcccaggagttcaagactgcagtgagctatgatcgtgccactgcaatccagcaagaaaaaaaaaagaaaaagatagtttctggtcgtgccactaccagttagttacctgctcgcttgtgactggggcaagccatttaccctctctggatctgtttcctccattataaaatggggaaacttctctgtcttagggctttggaactcgaaggagccacggtgtgttccaaggtccaaaatcagggaattgctattccctgacattccagagtgggctgggcctccacgacctttttcacagaggacatttgaacatgtgacatttgatttctgggaggtgcctactgcttctctaggggcccagtctttgtccaggttcaaatggtggacaaagctctggggaggctgctgcacacacgcgtggcctacccaggaactggtgtttccaggccactcccaccccgcctacagcattagttgcctccctgtctgccctctactggctacaggcgttaaattcaggggatcattccaagaggaaaaggagggagtctgatacacatcagacctcacagtttatcctggtttttgacctgctggctatactcattcatgttacacattcattcagttcttaaatatttattgaggtttgtgtcaggctctggattagaggctgtaggtcccaagtgagcacaaatgggtgtggtccctgctttcacggaccttacagtctaggtggagagacaatgttaaacagatggtcacggggttgctttgtggaaggaagccaaattctgtgagtagatgacaacacctgctctgacgagggaggcaggcacagcgtccctcgggaggtgacatccaagctgaaatctgcaggatgagtgggagttgatcactgaggggggcgagggggagggcagtgcaggcagcaggagcaagggccctgtggcaagagggagtgcagtgcatgtgaggcaacagaccagcctggtgtggctgcaactcttggtgccccagaggtggggagtatgtgtttattttagacctaggggaagggagagaatgttggtcttcagcttaagagcaatcagaaaccattcaaggattttgagcagattggggttctgcagtatggagaatttggaggccaccagctgggacccttctgagacctcactgttggtgcctgtagcttcttgtgtcccagagttgttgttctgagcactcctacaccccagcctcccatgggctcatccccgcagagccccctcgtaggctccctggagtgcttgccctggttgtggtctcttccagaagatgcagcctttgttctttcttccccgtcttcaatggccatatcctctcagacattctccctgcccctgttcaggctcagtatggtttggtggcccagaacttttgagtgcgcactttgttggctgatcacaggttttggtctggctgttgacttgattacactgggctgggggtgccgcctccttccagctgggcctgccctggaatctttgcctagtagagatgagtgggcctgatcctgtgggctgtagaagtggtacaggggccctggtgggactcggggtgcagtcaaaaatgctgtgctggggactgtgttcaggtgggagctctggtctcacccactgcctgtttctctctctccatctggggatgtttcctgagcagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggtcagctcacattctctacagccctccccagcaggcctggcctccactgtagggctggggaaggtttgtcctcctgacttggaggggagggataggatgaacagcctcagggaagacacagactgccactctgggcaccccctcaggtggctcacaggcctcatctagcttgggaggtgcctgggctgcctctgggtgtgggcatgcctaccacactgccaggaagtgaagtcctgctcagctgtggcccagaaccaccgtcccccacctcagctaccttggcctgagcaccctttatcatgacccctcaaggaggatctcacccagcctggactaggacactcactgcactgggggctgactgcttcccaggcagcttgccccatccttatgcagccctcgccgtcagctcttcgtataatgtggacttcccttgactccatattctagtccaggttccaccctctggaccacagaccagcctgttccctctgctcctctttctccagaaaagacccctaaagattaaggacagtgattggcggtacctgccccaggtcctgtctcttggctacacaccccgtttcctcaacttttgttcacggacagtggtttccaggccactgcgtcacggttggacagtgatgtgtcacaggccatgggcttctggagctggccgagcactctgggcatagctcagtaggcgggcagggtggctgccacctgtgtgggtcaggccttgcttctgttgctgaagctctgtggtaacgggcaggaaagctgacgtaggatgggagatgctccatttgggaaggcgagtgtatgccaattgcaatctttctcaaggggcccacgtttttaatgatgtatgtgagttactgcacgtgtgtatgttgtgtctgtttgtggaagaaaacaccagcattgatggcttgtagctggtcgtgtccatgaatgattgctggccttgcctatggtctggatcagtccttgttctccatcttgtttttccactgtgcagttggttttgtagatggctgccgtctgctttaaggacgtgaggtgttgtaaaccaaccctcggcaattaatttgggggaagagcagaagaaatgaagcccacatcccttactagcttaccagttgttaacaggctggtgcaatcattagttttataaaaatcacttttgcaaataaagttttgcagagggtttccccactcttccctcatccccttcatggacgtctgagaatccaggccctcctctcctcctcctggatgtaactcaggcgtgtccgtggcctgcaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggtgagccccatggggacccagtgatacccccaaaactcagtcccaggttctcagatgcacctttctctgggagcatggccttcctgtgtccaaacccctccctggcaatggtgggtgagggtggggcacacttcggagacaaatgagaaactcttaggcagggcccctgctaaggccccagggaggccctgatttgggggcagatttccttttccttttgctccttagaaaaagctccttttgcaagaagtttcccatatgtttgctgagctactgggagcagggccaggataccaagagacggggtagatcctccgtggaaacctgctgttcagttttcccaccacaagccctgccctagggagcccctggtgcagggtggcagagggaagaagcctggcagtgccacacattgtgaggaatctaatcaaggatggcttcctgtacaaaggactttgagacaacttgaggatggggatggcattcccagggaatggcaggcgggaggacagctgagatagaagctcagggcaaagatgaggagtcagtgggtcccctccacattgggctgaggaaggagctgaggcctgtgccctggcagattccgtggtctatgccagccaaggcctctaataggcctgaggtcagaaatggagattcccagttcaaggtgagctcagtgcaggccttgatacacaagagacagtggtagggtggctgctaggtagtggggtaatgtagggactgagctgaaactgggtggtggggatatatcctgaggattgtggccagccccggctcatgtgtgtacctgagagaatatccttttatatctggacatgtgtgggaatatatgtgtgaatgggagtctatatgtgtagatatggctaagagtgtgtgcataagtttgtgggggtacaggtgagtcagtgtctgaacatgagtatgtgaccatgtgtatttcaggggcagcgtagacttctcctccttcatcccttcttcttctctccttggcccaggcatctccagcagcatgagctttgacgaggatgaggaggatgaggaggagaatagctccagctcctcccagctaaatagtaacacccgccccagctctgctactagcaggaagtccgtcagggtgagtgagtgagtctgcatccacagcagtttttggaggactgctcatccgttagaggtggactgcatgtgaagagatggactcgtatgcctttaggagcttctctgctggcctcttatgtccctctaccttgcctcctaacctcttcagctaggccagcagggtgatgtatggggggagatgcagttggacaggatgacctctgaggacctcccgtatctcccatctccacctctaggaactgttgagggcagggctgggaagatagcttctgaccccaggcccaggctggccaggccccaatcccaggatccttccctctctcccaccgccacgttaggaggcagatttggatcccagaccaccaatttgggctgcttagggtccttggggctcaggcacctattctgcatccccataggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtaaggttggtctgggcatgttatcatctaggctttacagccctttgaaatcctaggggctgaaatgtgactggaagtctcatatctaccactgacctctcagttcctcaaagaaactgccttcgtgtctggtctgtgcacatctttgtgttttccagtgcatttgtgtgtgtgcacatatgtgcgtttgggagctgacgcaacggagagagtctgtgtgagtggctctcatgactgtgtgcagaccagaggctgagtctggaatatgacctcattccactccccaaggtgttcctcctggcgggaaggaagagaaagaagagtaaaacttccaattacctcatctctgtggacccaacagacttgtctcgaggaggggacagctatatcgggaaactgcggtactagcattcccccaggaagcaggcgggagtgggagggaggggcaggggcaagctgtctgtagagggcctgaatcttcctgaaggagatctaggccagggatggatactctcccaggatcctctctgataatcacatccaactggaggcctatgtctatgccagcctagagccagacttggagatgggaatcacacacccgaccccaagctgttcccaggaggtgggtgcaggcccaccaagagtgatggatccaaccccagggtgtcactgataacgcaggccaccatggaagagttgccttggctccatggtcaatgccaagggacagggctgagagtgagctcttgagggaagagacacacagcaatcttgggggtggggggcagtggtgaaggggcaggaaggctctgagcctaggcctccaggtgggggcagtggggaggtagggtttgctgaggaactgagtaccagatttggggagcataaataaagatgagaggtcaggagctaaagctggagatggggctggactgagacttaggctggctgcgacagaggagatctcatcctctctccacgggtgctaagcctcttccactgtcttatcagatgccattctgtttgctcacctcccatgaggagaactcccatgttcccccagataaatcttctgaagaatcctgattgacctccctgaattgctctcactgaactgaaatgcactttgagtcaactcagagcaagtccaggccttctgcccacgaagtgtcttcaaagatgtggattcagtgagcagtatgcctccctgggcctgctcctgttccagcccagaatgttttgcaggctcctcataggacagacgatgagctgttccctgctctggggcagagggtgcatgactctatactgattgtgcctttatttcaggtccaacttgatgggcaccaagttcactgtttatgacaatggagtcaaccctcagaaggcctcatcctccactttggaaagtggaaccttacgtcaggagctggcagctgtgtgctacgtgagtcctaggttcgggggtctctgatttccaaggtagatatgaaatccaggacttgatgcctgatctaggggctatcccatccatcttagtgggtagacaaggctgtgtggagaggggctgtcctctgtggagtgttcctggcctaggacaggggctctggctctctcctcctgacttcagagctcacaccacagccggccatctgcttggggagctcagaaaaccaggcctggctctctgcagtccaggccaggagtctcttagacagaaggagacggtcgccctgggttcttgtctgtgcatttcccagatcatccctctggcatgccaggttctacatggattacacggcactttgtcatctcactgaacgttcaacctaagaggtagatcctattttctttatagatgaggaaactgaagctcagctgcagatgtcacacagctcaaaaacgaccaaactggaatataaatataggggattactctacccctttgaacctttttcttcatttttaaaatcaggggtgggtatctcatcaacctgggcatgggcacttcttggaggccatcagtaagtaatccacagctactttgtatgatcctgtggtgccacctgctgaccagttttggggaggcagcctgagtcttcaagttcttactgagctccaactaagcatattgtttgaggcactaaggatatagtaatgaacagacataaatgtatacctttatgggacttaaagccctagcagggcagacaagctatgaaacagatctatcagtgaagtaagtatgttctttataaacactaagaagaaaaagtaggggaggggagataagaaatgtcaaggtatgtgtgagaatttcagaatggcagggagggcgtcactgaggtagctcttgagtaaagaccagaaggaagtgaaaaacagcagtgtacgtgtctaggggacacagtgaggacaaaagtcctgaatgcctggcatgaagaaggaatggagtggataccaggcagtaaatggtgaggagaggaaggtcatggggccacgtgcaggtgaagtcacatctccagctttaacttggagtgagctggagagccactggagagttctgagcagaggagaaagatcatctgacttaatgtgcctgagcactggctgctgtgttgagaacagatggtgggaaggaggaataggagggccaacaacagaaaccaggagtccaggcaaaggctgttagaatgatcttggtgagagaagctagtggtgaaaagtggtggaagtctgggtataattggaaggtggagctgacagaaactgctgatggattagacgtaggatgtagaagagaggactcgagtgtgaccaagtagtttgccggagcgagtggaagaacagcattgccgtgagcagaagcaaggatgacgcataagaggagctagttctggcagggtagagacccaggggctcagttctggccgtgttaggtttagagggatgtgtgttagacttcggagtggagatggtgggaactagctcttcctctttattcccgtcccccccaccttctccagtaggtaaatagacgcctcaggtggccagtgttgcgttctctttcccaggagacaaacgtcttaggcttcaaggggcctcggaagatgagcgtgattgtcccaggcatgaacatggttcatgagagagtctctatccgcccccgcaacgtgagtgtctaccccttcctcccctctttccccatcatcctagtctctgcatgagcttctaagggcagaactccagctgatgtgtgtatgtggaggggtaccatgtgagaaagccctggaggtctagggaaatccaaggacccccattcccgggatagatccctttctggggtggtcatggtgccaaaggcctgggcctggctcaggtgaggctgccctcccaggagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgaccgtgagtgtttctgtccctactcattatggtccgtaggatacccaaggcccttagcgtagggttcagcccacctagccctgcctacactggctagagtttaagaatgtgagctatacagctaaggttagatgtatggaactttctaaccctaatgactgggaggtcctggaagaaccttctttgcagccctggtcctagattctgtgtattcaacggagtctcaggcacgggaacaccctttaaaaggacttttcctcttttctgtcccctggtgttcacatgcatcttactttgtcctttgccatctgccacctctttcctgccacttctcccaattggcctttgttttacttccctttgtgattcccctggcatctctgcttctcacttgttcttccctcatgtggtttgggtgtctgtctatccttccctggctctaccattcctgtcctgtccttttctctgtctgtgcctgtgcttggccccagcggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagctgagcaacctcttcagctgggaaggccgcaagaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcctgtcagcttccccaggagctctctgctgagcagcccagcacaacccccaggaaacacaaatggggtccaggtcaccagcctgactgcacacagctaggcatgcctgggaatcctgctgccagagaaccattcccaagccatggcatgctccttgaagaatctctcctctctctctctctctggaaagacccaactttctcactgctgtcagccaagtcatggttggtaaccatgtaggttcttgggagggaatgggacagggtgaataaagcagggaatattttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctgggggcccattctgcatgccctccccacttcccccgattcagagacttagaagcatcagagttgataaattagattgaaaccattccagtaggaaatcaggcagttccctgttgaaagttgtctggctttttgcacgtgagtatgatccaggattggcctgtgtctggcccctccgcgagggctactcagcagtaagcaggccttagtacggctgctgcacacttctcggtctaggtgggagagagtgcataaaggttctggggctgggcctgagcctaactccctccactaccgctatttctccttggatggcaccatccaccctgcaggcttgggaactgtaagctcaagcttttgctcatttgtcatttaccctggtggaggcttcttgcccagatagagatctgaaattggtgggaagcaagcaggggtcgtaccttgctttagagtagatgtttggaaaagctaagtagaaattttttaaaatagaagttgtattttaaacgtgttaggctttataggtgaaggacttgttttgacttaagtagaagtaatatgctctcatttctttgtaatctagattttcctatgttgaatgcttaaagcaaggcatacctgtcctagcaggatctgcccacacctcggccgtacatctctgtgagagaccccctccaacgattagcttttgcaacatggtccagtttctagagggcactagaactttgtgccagcgctggcgagataccatggtgccatcctcctttctatagttccagtttagcccttccctgcctttaaggagaagagatcttcatggtgacatttgagatgatggaaactagatcgtctctaatgttaggtcaagctatttctctggatctatgattttaagatagaacaggctggttctgagttctggtgagacggagaccccggtggcagtggaaaaatcagaagcacaaaggaaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgtttttttttttttttctccattctgaaaatagcaggacatttacctcttaaataaacttagcatttagaggtaattctaaatttaacaagtgacagggttggtttcaaagaaaaaggtccatgctttgcttacaatggagtctgcagtgaggggagatgctgggatagccatttccatggctctgttatgcaagcacaaatttcatctcctagatggacttcctggttttctcttactgcagtaacactggccttcccttctctaattccttaccccagctgcggcatccctgtgttaactcaggatgccaagtggccctcagattacacttctccagatagctgaatgagtctgctttcactgtgactgggacctgaatgacctgcagtcagggcccagagttgggactctatactaccctgggctctggtctgtaggtttgtagtagccaccggtaataagccaagggctaggctcttgtttgagtttatggccacctggaattttcagtcatctcatgatacaggcgggaggggcagaacagatagattacgacaggtttggtttttaaattttccaaccaagtggaaaggcaagttggtcttatagaaagcactactgcacttagtagctatgtgattttgagcaaaccacataatctctctaggtccattttcctaaccacaagataaagatgttacattgtcaaagcttgccgtaggatttggggtgaatgaaaattattccttgctttcatcactacctttatagctctcatcactacctttatagctcatcactgtgcctttttttctttcctaagaaagacatcacatccctctcctctcctcctctgtgctcctgtccctccctccccctagcaaggtccaggcaaagctggagatgaggctgagatccagagtttcctagaacgcaacttaggatggctaggaaagggaagcctgactgctcggtcaggagggtgcagtatctcttgctgggaacacagccagttttcacaatgcctagactgtgtatgtctatttgcacaagattgtcttttcctattttggagtggtcagacattttatttttgttcaagattatctggcgttttagacaaatttgcaaaactgtgcttttattgactttttgaataaactttggtattctggagcaaatgtatttatttattggtatgtgcaatgacaaacttggtattttcccatgttgacattatgtatgttgtagaatttagtgtttgtctaagtacacacatatatcaacaaattaaacttgaatcgtttcaacacttctgtgtacttttttcataaaggggaaaaaagccctgtttacttcctaatttttttctatacctttcattcattgtttcctaggagcctcaggtgggtaagtaggtgataatagcaaagagatcataacctcaccaatgacatgtgggtcaacactgtccttcctctggcctgtgcctttcaagtttaaggttcatcagaaccacacccagaggctggaaaaatggtgaagtcagaaggtacttaagttagagcagttctcttcagggtctgctgtgccgcctgaaggggctggtggttcctcagtatcccctgtgggcctggccttaggaagagaacagggctgtagagatgaaaaaggtataaaagacccaaccacttgatgtctcagggcttgcttggaccctaacccatttaaacaggacctcgagatgcttaggaatctttttttgttgccgggcagctgtggcagatttgaaggcaaaaggaagggaggctacagttgtagctagaagcagacatgaaagctaatggtctgacccagacaagaggttataactaaaggcacccggagactgcagaagggccctgggccactcctggcaatcagggtagccttagagggtgtcaggtgtgacatctcagcaacactggacttgacagagtggtgacagggatcatgctgtcaccaagcacctaccacatgctttgccctggcacagacactttataaacagcatcttatttaatccaaacagccctgtaaatagagcattattcccaattcatggggaaactggttctctgagaggttaaggaatgacctaagaggagaaatttgggctattttctttgtataaaaaaagggaaataaaggaaaaggaagcacattttagaaaagtcaatggtcaaggcaaagtcataaatgtgttcatgttttttctcaatattgctgaatagctaaagcactaaatttttctttggaatacaaatagtccagattgaagagaactttgagagtgtggtaataattcgggtttgtttattcccccagatctagagttctgatgtgaccaagagcatttcctacctgaaccatggcctatctcctgtggcctctgcctctggtgggaaatagcgcatacaggatattctaaaaaggaaagagggttttgtttgtttagtcatcaggttcaaaaatcttaaatggctatagacaggggtgaccctacgtccaggacagtcttagtttatgcctatcaccttggcataattatattaaagctccctttttccaaagtgtttgaatttggaccttaagttatttgatcacccaagccatataaggtgcattgtatggttctcaaaggccgttgattctacaggccaaatacacctccactcctcatcacgactccctgggcccagcttctggagctagtcatggagataatggtttctttgtgctcctgttgtgaccaggaaaggggatctcctggctgcaccacccacctgatttaccaagagtgatcccagattatgcagttgttttgtgagctaactgtccataaaggtatgacttgtgtactctgccacagtgccaaaaggccaggggactgatcaagttcccagcaccctcgtgagaaatgaagaccgcaagaaaagagacagcagccctggcaacaaaaaccggacccatgattttgtcatcctgggttgtatatacacatataactgtcatccccgaaggataaaataattctggaaaatccaaaaagaattttctaaatcctaaataactgaaaggtacatccaaatgtctgatatataaatacacaaatatattccttatatataaaccaaccaagagctagggcaggaagaaccaccataagggcttagtacttctggcaggaatttccataagccaattttccccaaagaccaacaacactttacataacagcctcaccaaaatacttgaacatccatgtattttcacaccctactgcttttttcaacaactctttctgccaagagtgtcctctcttctttgcctacctgaagaagttctttgcatgcctcaaggcccacctcccaagaaactgtgaagtttcttggcaatactttagcaaaaacaatttatctttcctgtagttttgggcccatgtctgaattacagcatagcccttataataaaaacataattaccacttaatgagtggttatcatgtatgagctagaaccaatgctgttttacacacactgatgatttcatttaaccaggacctttaatacccctccctttactaccctgaagccaaagctcagaccagttaaggagctgacccaagattccacagctagaaaatgcagggacagattatggctcatgtttctctgcctgcaggattcacgatcctgagccctcttacagggtcatagttcattttatctgtcaggctctctctcgtcacactgagttttctgagggtagagattgagcctctgttcctagcacctggcactgagcaattgactgctaaatgaatgaatgagctagaagagaacagcagtatttatctctaataagggaatcctatcctaaggccaaaagtaaacctgagccaggaacccagggctctcctcatgaatcaacccctcacagtgaacgaagggaaataacacagaaaacaatttatctaaacagtaaagagcacctgttatttttcacctttcgtgtacaatacatctagattgcattcagtatattttaaactgcattcttcacaatgtgaatcaaatgttctacacagagatagatgcaatatgctttctataaactcagtcttgaatgactttctgtaactcaattaacaataaatgcctagtagtagctgacagattatcttaatatgatcccataccttctaacagcagtctgtatgctgatgtataattttaaactgttttcctggcaccttattcatgccaagcataatgtaactctaaaagccatatctacctttacataatgtcttaattttccagtcttctacatttcatgactgggaatgtctttgggaatgtgccctcttcgaactctcaggtcttacatgtaaactgaattcacgcatacctcatgatgtaattcatgggtgctatcttgtctcaagaagacacacgtcagatgcagtaaggagaaaaggcctttagtttggtcaaaatcctcccagtcttaatctagttgctgctactttccccagctctctcaaaaagacccaaatatccgagtatggaacacatggtctctacccctgggcactgctatattggttctctgcaacagacatactccaacttccctcttgagttggcactttgtatacaagatcagtcctcatttgtttcaatttatggttctgagaagaaatttctcaaagggtgcaacattcagaaacagctttaggtaaggactgtccataagcacacagattctctcccctattgctggcttcctggccttctgagctcctcatggcaggagcagaattcacaatcttgagccctcttatagggttgcagcctcctcatggcaggaccatccctgggcagggcttcctgcagcttcaatggcctcaagtcttgactctgcagggcagggtctaaagtctctatctaaagcttcctctgtccactgaaaaccaggagtgcaaaggtacttctgggcttggcagttctgttaagcagaacaggggtaaaggaagctagatatccaggtagtatcagagtaaaacagtccccaaacaagcctctgggctcattctcagatcagtgggagtcttccctactctggagaaaagaggatgtctgaggcagcatcaatgttcctaggaagaccctcgctgcgaggaagaggcttcagcttagacagcagagtcttaccctcctctgggcccattagccccacaaacaaaatgttctcttctcaccaggggactactaacctgctcaaggcccaaagaataagggatcttggagtctgaaatcttcattcttgcaaccttaagtcctcatcatctgtaagctgatgttcgttcacaggtgaactatctgttacacctaccaggaagagtcagacctttgcccctgagtggtcccatctgtaattacaatagaccaaacataattacttaatggatcaacttctctgatagaggaaaggcaggaagagaaagagcgaagctgtcctgtgttcacactaatgtccgtgttttacaaggtgacaggtgtgtgagcaccaggaaggatacatgatatccatgatagtggcctgatagctatgacacttgaacacagtgaagaaagtgcagggcacagggccaagaaggaaatctgaggagagagaggtcaccttgggacttgagtaatggatacttcagactggctgttttcactctaaaccctgggggttacgcttcctcagcatgctgcctgtatatgctttatcggtgctgatgcccaacccttcatctttaaagtcttgggaccactcttctttggtggtttcctcttgctcagggtagctatctgcactgaatccagcattctctgccaagacagcaggatcctcgtcttcatgaaaacagcaggaacatgtttctggctttggatcacacgaggtaacagaattatcttcctgggctctggggtcagtgggcagactttcccaacccaaatgatctgattcttcctcttctatcattcccattctttcagctatttcttcagcagaaagttcttttgggtcagggtaatccaccaagattgtttcttgcctacgcttgatacagtctgaaaggtcataaattgggtaagtctcttcagggtaacctagagagaaaagtagcacaaagtattacaaagaatgtctcctcaaaaaaaaaaaaaatagtgtcaggttcaaagaggattctcaggcagcagccatcctatcctaacaaatccattcaagacatctctaagattccaatagttctaaagttttacttgagcaaattcttagcaatctggctatcccagtgctctttgaaatacaaactaattcagatgaaaatcccttcttatgtgtagggtgcttggggcagagttaagtcttataccatgtgtttttgcagtactgatgaagattaaacaaacaacatgagcctttagttaaaacaaaaaaagcatcaaaaccagacagagacagcacagctccaggctaatgtttataatttctatttggaacaatttccaaatcttccttggtggagtggggagaggaaaggaatgctaagctctttgaaaaatacaccatgaagctttctatttatccaaacaattgaaatggcttgcaagtgtcaaaaatagagagcactttagcaaggcatgcccaagatcccgaaaggacaagcactgcattttcggaagacagaattcctgttgttggcttcttcatcttcacaaaatggaacaaaagaaaacaacaaactggcaaacaaaatgagtaacactggtactgaatcccagctaggataatgagaaaagagaaactgttgccaaattaccaaactaaatgaaataaatctgtgtccgccaagcaagcctgagcagcagatgggccgtgctggagctcacacaccagtactggcaccagcggccgtaatcacgatacagtgcagaaagctggaggattcagaacccatttgcccattatgataattggcaaattcaaccctaacgtaaaccattttttgcctacaactgtgacaaataagtcttttttggtgcaatgtagggtgtgtgtggagacatttctacatttactgctttttctgactataaaaatcatacagactcatttgtagaaaatttgaaaaaaatacaggctagtttaaaaaagaaaacacaaatcacccataatatcttcactcataataatttgcttttttctggtctttttttaaccgtatatacacatatattttcttttcttttcttttcttttctttttttttttttgagacggagtctcgctctgtcgcctgcccaggctggagtgcagtggtgcaatctcggttcactgcaacctctgcctccccgattcaagtgattctcctgcctcagcctcctgagtagctgggattacaggtgcatgccaccacacctagctaattttttgtatttttagcagagacggggtttcactatgttggccaggctggtctcaaactcctgacctcaggtgatccacccacctcggtcttccaaattgttgggattacaggcatgagccaccgcgcccggccaacatgtattttcttattccccttttttaaaaagaaggatcatatttgtgtataaaaggttatatcctgatgtttttcaattcaacattatatcatgagcatctctccatgtcattaggcatttgaaagttggttgcaaaatatctcatcatatagctacataactgacatgatttactagtcctcttttctagggcatttagattctttccaattttcccctattataagtagtatacaagttaagatttcttaatataaatctatgtccacttccctagttctttaagatagacttctataaatatgaaaactagaccaaagggaatggacattataaaagccttttttatactgtgccaaattactttccagaagagtggtataaattttcaatcctaccagtgatataaagactgtccatcttatgacaccctcaccagcactcacagtagtatgttaagaattttgccaatgcagtctttattccaaggcttaacttactgcggatggaatgctaggtaaagtggagcttagctaacccaagaccctcagccaccatggtcaaggataggatctggagaagctgcttgctagtcagctcccagccactgaatgcttaaaagaagtccatttgctggcatgtccctgtcttcccacacttagaacaaagcttatctttgaattttcatgactatctgctttaagagggaaggtcacccagactcaggctctcagcctaccccaacaccaggcctcagtccagctctgcatccctagtcataatgcctgcacccacagacccagcctccatgctggcccctgcagatacagactccgggcccacccagcatcaggccagcaactatggccccagaatccagtcccaccctaggttccagacaaaaccagagccaggtctgcccacatagcccagtgccaaattggcaccccaatggcacccaaattggagcctgcagacacaggctccaggcctgcccagtgccaggctagtctctatgaccacccccaccttcaggttggcccctgcattcccacaatccagcagaccctgggtctagcccaacccagtagaccccagcattgggccggccctcagaaccccaggactgcccctatggacctaggttctaggctgaggcctgtggccccaggacccaagccagccctaatgaacctagccttcagacacatccatcagactcagcctccaggcccatttcagtggacccgggcaccaggttcatcctagcacctggccaatctctgaagacccaggctcaaggcccagtccagccccaggtcagcccttgtggacctaggctttgggatagcctctctgcacaagatacaagcaccaggtccatgcctgaggatccaatcaacaggtacaccccagtggatccaggcttcaaccccaaccccacggactcaacaccaggccaccctgcctaaggactctaccagcaagtctacctgcagatcacaccaaatggcctacccagaatctctgggcaggctgactggtgaatggcttttccggacaaagccagaatgcaaaaaccattcaccagcaaaagtccctgcttcttcaaatgcacagataccaatgcatagccatgaggatcaagaacaatcaaggaaacatgttgccaccaatgaacaaaataaagcaccaggaacagactctaaagaaatgaagatacggccgggcgtgatggctcacgcttgtaatctcacacactttaggaggccaagacaaatggatcacctgaggttaggagttcaaaaccaacctggccaacatggtaaaatcctatctctactaaaaatacaaaaaattagccgggcgtggtggcaggcgcctgtaattccagctactcaggaggctgaggcagaagaatcgcttgaacccaggaggcagaggttccagtgagccaagatcaagccattgcactccagcctgggcaacaagaacaaaactccatctcaaaaaaaaaaaaagaaagaaagaaagaaaaagaagacacatgaactgcctgacaaagaattcaagataactgttttaaggaaactcagcgaacttcaagaaaatacagagaaacaattaaaggaaaccaggaaaacaataaataactaaaacaaaaaatttacgagagattgaaattatattaaaaaaatcaaacagaaattctacagctgaaaaatacgagaattgaaatgaaaaatgcaatagagagtatcaacagcagaactgattgagcaaaagaatgaacctttgaatctaaagacagattatttgacaatatacagttggatgagaaaaaaagaatgaaaagaaagcaagcttatgggatttatgggaactggagttcaagaaggaggagacggacacaaagggatagaaagcttaaagaaataatagcagaaaactatacaaatctggggaaagttataaatatctgggtacaagaaggtcaaaagtctccaatcagactgaactcaagtaagactatatcaagaagtattataatcaaactatcaaaaatcaaagacagagaggatgctggaagcagcaaaagaaaaaaagtacatcacattataagggagttctaacagatttatcagcagaaaccttaaaggccagaaaagagtgggataatatattcaaaatgcttacggaaaacaaaaacaaaaacaaaaaaaaaaaaggtcaaccaagaatattgtagttggcaaagctctccttcagaaatgaggaaaaaacaaagactctgccagacaaaagctgaaggagcttatccccacaagatctatcttataaaaaatgctcaagggtgttcttcaagtagagagcaagggacactattcagtaacacaaatatacatatatatatatatgaaagtataggctaggtgcggtggctaacgcctgtaatcccagcactttgggaggctgtgacaggtggatcacctgaggtcaggagttcgagaccagcctgaccaacatggtgaaactccacctctactaaaaatacaaaattagctcggcatggtggtgcatgcctgtaatcccagctacttgggaggctgaaatgaaaactataaaacattgatgaaagaaattgaagaagacacaaataaaatgaaaagatgtcccgtttatggattggaagaattgatactgctataatgtccatactatacaaagcaatctacagatttaatacaatccctatcaaaatttcaatgacaattttcacagaaatagaagaaacaattctaaaattcatatggaaccacaaaagaccccaaatggccaaagcaattgtgaacaaaaagaacaaagccagaggcatcacagtacctgattcccaaatctactacaaagctatagtaatcaaaacagtatgttactggcataaaaacagacacacagactgatggaacagaataaaagcccagaaataaatccacatatttatggtcaatttttttaaacaaagatgccaaaaaataaaacacacacacacacaggtcaaaggacaaacacaaaaaggtcaaaggacaatctcttcaataaatggtgtggggaaactagatatccacatgcaaaacagtgaaattagaccctcatctcacacctcacatttacaaaaatcaactcaaaatgcactgaagacttaaacataagacctgaagctgtaaaactactagaagaaaacctagggaaaaagctccatgacattggtctggacaatgatatttttggatatgacaccaaaagcccatgcaacaaaagtgaaaatagacaaatgggattactgaaagtttctgtacagcaaaggaaacaacagtaaagagacaatctatgtaatgggagaaaatatttgcaaaccatatatttgataatgggttaatatgcaaaatatataaggaactcaactccacagcaaaagaaaacccaatttaaaaatgggcaaaggatataaatagacacttctcaagagaagacagaaaaatagtcaacaggcatatgagaaagtgctcaacatcattaaacattcaagaaatgaaaatttaaaccacaatatcaccacatctgttagaatggctattatcaaaaagacaaaaggcaataataagtgtcagcaaggatgtagagaaaagggaacccttatatactattgctgggaatgtaaactagtacagtcactatggaaaacagtatactggctcctcaacaaattaaaaatagaactatcatatgatccagtaatcccactactggatatatatccaaaagataagaaatcagtatgtcaaaaagatatctgcactcccatgttcactgcagcattattcacaatagccacactatagcatcaatctgaacatccatgaatggatgaataaagaaaatgtggcacatatacacaacagaatagtacttagcatttttttgtttttggagacgaggtctcacactgtcacccaggctggagtgcagtggcacaatctcagctcactgcagtctccacctcttggactcatctcagcctcccacctcagcctcccaagttgctgggactagacacatgccaccatgcctagcaaatttttgtattttgtggagacagggtttcaccgtgttgcccaggctggtcttgaactcctaggctcaagcaatccacctgcctcggcctcccaaagtgttgggattacaggcgtgagccaccatacctggcctactgagctttcaaaaaggaaatcctgttatttatgacaacctagatgaacttggaggacattatgttaactgaaataagccaggcacagaaagacagatacagcgtgatttcacttacatatggagtgtaaaaaggtcaagctcattaagaaaataaaatggtggttatcagaagctagggggatcagggaaatgctagtcaaaggacataaaatttcagctggataggaggaataaataagttcaagagatctattatacattatacagactatagttaataacagtatgttgtatatttgaaaattgctaacagagtacattttaagtgttctcaccacaaaaatccttaagtatgtgaggtaatgtgtatgttaaatagcttgatttagccatttcacagtgtatacatatatcaaaacatcaatatatataattttatgtattaattaaaataaataattttctttttaaaagaggaagaggcccactgaggaaaatcaaataataactcataaaactgctgaggtagcctatgtaagccatcattactggttactcaaaaacatcattaaggctgggcacggtcgctcacgcctgtaatcccagcactttgggaggccgaggcgggcagatcacgaggtcaggagatcaagaccatcctggctaacacggtgaaaccccatctctactaaaaattaaaaaaaattagccaggcgtggtggcaggcgcctgtagtcccagctacttgggaggctgaggcaggagaatgacgtgaacctgggaagtggagcttgtagtgagccaagaccctgccactgcactcaagcctgggcatgacagagcaaggttccatctcaaaaaaaaaaaaaaaaaaagaccatcattaaaaatataagcaagcaacaaaaattcactgctcctatgaggaaaccagcagttcaaaatgagggaacaaaactaaccaaaacaaacaatgccaatagtctctaataaaatagttagtgcaggagataaaggcgttaacatcaaccaatttatgattgatattcctaataatattcaagaagatactgcattgataaaacctagccaggcttcaatttaaaaaggtagcaaacaagaaataaaaaggagctattgaatagaaagccataattgtaaaaaaaaaaaaaaaaaaaaaaaaaaaattaatgctcaggcaagaaaacagcagattgggctgggcgcagtggctcacgcctgtaatcctaacagtttgggaggcttaggcagttggatcacctgaggtcaagagttcgagaccagcctgaccaacatggcaaaaccctgtctctactaaaaatacaaaaaaaattagccaggagtgatggcgggcacctgtagtcccagctacttaggaggctgaagcatgagaatcacttgaacccaggcagcgaaggttgcagtgagctgagatcacaccattgcactctagcctgggagacggagtgagactccatctcaaaaaaaaaaaagaaaaaatagcagattgaaatggacatggctgaaaaccaaattagtatattaaaagtccaagttgaggaattctcccagcacaaagataaaatgataaagaaatggaaattatgaggaaaaaagataagctacatggcaaactatcaacaatatccaatctcagaattactggaattctagaatgagagaacaaaataaggtaaatgggaacaataatcaaagagattataaaagaaaataccctttagctgaagaaagccttgagtcttcagatgggaaggactcgctaaatgcttggcaaaaatactatgaaaaatccacacattcgtacacgctcagacacatgcagattatccaaccaaattcagatttttaaaagctggaggcatcatgctacctgacttcaaactatactacaaggctacagtaaccaaaacagcatggtactggtaccaaaatagagatatagaccaatggaacagaacagaggcctcagaaataacaccacacatctacaactatctgatctttgacaaacctgacaaaaacaagaaacggggaaagcattccctatttaataaatggtgctgggaaaactggctagccatatgaagaaagctgaaactggatcccttccttgcaccttatacaaaaattaattcaagatggattaaagacttaaatgttagacctaaaaccataaaaaccctagaagaaaacctaggcaataccattcaggacataggcataggcaaggacttcatgactaagacaccaaaagcaatgacaacaaaagccaaaacagacaaataggatctaattaaactaaagagcttctgcacagcaaaagaaactaccatcagagtgaacaggcaacctacagaatgggagaaaatttttgcaatctacccatctgacaaagggctaatatctagaatctacaaaaaactcaaatttataagaaaagaacaaacaaccccatcgaaaagtgggcaaaggattatgaacagacacttctcaaaagaagacatgtatgcagccaacagacatatgaaaaaatgctcatcactggccatcagagaaatgcaaatcaaaaccacaatgagataccatctcacgccagttagaatggcaatcgttaaaaagtaaggaaataacagatgctagagaggatgtggagaaataggaaggcttttacactgttggtgggagtgcaaattagttcaaccattgtggaagacagtgtggcaattcttcaaggatctagaactggaattactatttgacctggcaatcccattactgggtatatacccaaaggattataaatcatgctactataaagacacatgcacacgtacatttactgcagcactattcacaatagcaaagacttggaaccaacccaaatgtccatcaatgatagaatggattaagaaaatgtggcatatatacaccatggaatactatgcatccataaaaaaggatgagttcatgtcccttgcagggacatggatgaagctggaaaccatcattctcagtaaactatgacaaggacaaaaaaccaaacactcataggtgggaactgaacaatgagatcacttggacacagggtgaggaacatcatacaccgggacctgtcggaggatggagggctaggagagggatagcattaggagaaatacctaatgtaaatgatgagttgatgggtggagcaaaccaacatggcacatgtatacctatgtaacaaacctgcacgttgtacacatgtaccctagaacttaaagtataataataaaaaagacaccaataccccaaatataatttaaaaaaaaaagaaagaaaataaaacaaatttccagacagaaaacaaacaagctacctaactaaaaacaggtaacctattgagaaaaagaagcagaccaggataagatttctcattttcaatatcaaattaaagtagagaatgaagcaatattttcaaactttttagggaaaatggcataatcaacgattttatacccagccaaacaatttgtgtacaggtgaaaaatatgtacagatatccaagtattcagtacacaatactatatgggaaaaatataaaggtattcttgacaaatacaaaaattagtcaaaatttaaattcaagaaagatgatgctatatatgagacagtggttaagaatgaaatctgtaagaattatcaacataaaataagtattgataatgtggcctaggaatttaatgctgccgttaagaaatgacacttaaaacagaaaaggttaatatctttaaaaattaatatcacttgtagttaaaattccatataatttcaacaaaacctaaaaggtaggtagagggggaacaacgaaaactgcaatttggaggaaaaactgaatttcatttcattaattacttgtgagattaaaatacttttttatatgtttcatagctggttgcatttttttctctttgtgaactgcttatctgtaaggatatcagtgttttctaaattagttctagaactttttaatatattaaatatatccaccaggcgcagtggctcacgtctgtaatcccagcactttgggaggttgtggtgggcagatcgcttgaggccaggagttcaagaccagcctggtcaacatggcaaaaccgtgtctctactaaaactaaaaaaattagctgggcatggtggcacatgactgtagtcccagctatttgggaggctgaggcacgagaatcacttgaacccaggaggcagaggttgcagggagcagatatcaagctacagcactccaacttgggcaaaaaagcaagcaagcctctgtctcaaaaaaaataataataacttttttcaatcatatttgttataaatatttttccagtttattcttgtcttttaaactgtgtgatattctctgatctgcagaaggtaaaagttttatgtatttaagctacacaatcttttcccttagaatttgtgttgcttttaaaaaaattaaccttttttattttgagataattatagattcacaggcagcatataagaaataatacaagccaggcacagtggcatgcacctggagtcccagctactcaggaggctgaggtgggaggatcgcctgagtcccagcatgggcaacatggttaagactctatccctttaaaaaatactactactagtaatacagaaatcccatgtaccctttatccagtttctcccaaaggcaacatctagcaaaactgtactacaatataacaaccaggatattaatattgatatagtcagtatacagaacattttccatcaccacaaggaccccttatgttgccctttcatggcacactcactcttccctactcctattcccctcttaactcctagcaacaactaatcagtcctctatttctataatattgccacgtcaattataaatggaatcatatagtatgtaacctttgggaattagttttttccccctactcagcataattctctggaaattcatctaggttgttgtatatatagttcattcctttttattgctaagtgtataccacagtgtgtatatatatatgtaccacagtttattcacctcctaaaagacatatgggttgtttccagttcttggctattgaaattaagctgctataaatattcacaaagactcatatgcaaaagttcatagctacttgagtcataagagtgcaaagctaggaacaacccaaatgttcctcaactggtgaatggacaaattatggtataagcatataactaaataattagccctagaataaaggctgttctggacccaaactaaaaaatgttaaagctttaaaggattcaactattttctactaacctaaatgctaacctaataaatccaacactatttaaagtactaaaacaaaatccagcacctaacaatgcaaaatttgtaatatccatcatccaatcaaaacctaccaggtatgcaaaaaaaaaaaaaaaaaaaaaagggaaattaggacccattaccaggagaaaaattagtcaacagaaacattcccagaaatggcatggatgatgaaattagcaattaaaacagtcaagaaagctattacagatatgaatcatacgtttaagagagtaaaatatgaataaatgagacataaaaaagacccaaatgaaacttctagagatgataatgtctgaaattaaaaaacactgaataagattaacagtgggttagatacagtagaagaagacatcaataaacctgaagacatagcaagaaaaactattcaaaactaagcatggtaagaaaaaaaaaagtgaacagaactcacatgacctgtggggcaatatcaaacatatatgcaactggagagccagaaggaaataaaagagagacaaaaagacacagatcattaataaaataatggccaaaaatatagatcatgggtctaagcttccaccttgagaaactagagaaaggcaaattaaaccaaaagtaccagaaagaaagaaacacaagtcaatgaaataagaaacaaacaaacaaaaagaaaccaaattacagttctctgaaaagatcaacaaggatgataaacctctgggcagcttgatcaggaaaagaaacaaattaccaggatcaagaatagaagagggtgcaccctacagatcttacgtatattaaatggataattagactatattatgaacaactttatactaacaataaagttgacaatatggatgaactatgtaaattccttgaaagatacaaactatcaaaagttcactcaagaagtgaatgaacgaatagcactatatccataaaatacattaaattcatagacatcttcccacaaataaaactccaggccaactgggcacagtggctcatgcctataatcccagcattttggaggccaagaccagaagattgcttaagagcaggagttcaagaccaggcatgagtagctgggcctacaggcatgcaccaccacgcctggctaattttttaaatttaaaaaattgaaaaattaaaaaattagccaggcatggtagtgcatgcctgtaggctcagctactgaggctgaggtgggagggttgcttgagcccaggagatcaaacagtgagccatgatcacgtgccactgtactccagcctgggcaacagggcaagaccctgaaaaaaaaaagaaagaaagaaagaaaaagaaaaagaaaaagagaaagcaagcaagcaagcaagcaagcaagcaagcaactccagaccaagataatatcactggagaattccacataacttttatggaataaataacagtaactctatgaaacttttccagaaaatagaaaaaggaacacatcccaatgcattttatgaggccaggattaccctgaaatcaaaaccaaagaaattacaggaaaagaaaatcacagaccaatatccctcacatatgcaagacctatacactggaaactacaacacactgctgagagaacttttaaaagatctaaataaatggtgagatataagacgttcatgaactagaagattcaatatcgttacagtattgattcttccaaattgatctaaagattcaaagcagtaccaatcaaaatcccatcaggctttttcataaaaactgacaaactgattgtaaatttatctgaaattgtgaaggaaatagccaaaataatcttgggaaaaaaaatctgaacaacttgaactacccaaaataaagacttactataaagacatagtaataaggaccgtgtgctattggtacaagtagagacatacagatcaatggaacagaatagagcccagaagagacaagcacacgcatggtcaactggtttgtcaagcaaatgtcaagctaattaaatgtaacaaaagaagctgaacaattgggtatttgatatggaaaaaaataaacctcagtcctgacacctcagatcatctataaaggttaactcaaaatagatcacaggcctaaatgtaaaagctaaaactgtagaatttctagaaaacatgggaattgggaaaccttgggttagccaaatatttcttaaacagaacataaaaaatgggctgggcacggcggctcacacctgtaatcccagcactttgggatgccgaagtgggtggatcacaaggtcaggagatcaagaccatcctggctaacatggtgaaaccccgtctctactaaaaatacaaaaaaattagccaggcatggtggcaggcgcctgtagtcccagctactagggaggctgaggcaggaggatggcatgaacctgggaggtggagcttacagtgagccgagatggcaccactgcactccggcctgggtgacagagcaagactctgtctcaaaaaaaaaaaaaaagtaaatcgtaaagaaaaaaatggttaagttggacttcatcaaaatttaaaacttctactctttgaaagatgctgttaagaaaatataaaggcaagctacagaaaatatttgcaaaatacagaaatgataaagaatttgtactcggaatatatacagaactcttgcaacccaacaagaacctaatcaacccaatttaaaaattggcaaactacttgaacagacacttcaaagatatgcagatggcaaataagcacatgaaaaaatgttcatcatcattagtcactggagaaaggtaaattaaagtcacaattaaggtatcattttacactcactagaatggataaaattaaaaagactgacaagacaaagtgttaccaaggatgtggaggaactttaattgccatacaccgctggtgggaagggaaaaagtagacctacttaggaaagcaggttgacagtttctaataaagttaaacaggtggccgggcgcggtggcccacaggcccacacctataatcccagcactttgaggggctgaggcaggcagatcacttgaggtcaggagtttgagaccagcctggccaacatggtgaaactccgtctctactaaaaatacaaaaattattcaggtgtggtgccaggcacctgtaatctcagctacttgggaggctgaggcaggagaatcacttgaacccacgaggtagaggttgcagcgagctgagattgctctgcaaactccagcctgggcgacaaagtgagactgtcttgaaaaacaaaaacaaagttaaatatacaattaccttaaacccaaaaatctcactcctaggtatagactcaaaagaaatacaaatatatgttcaaacaaagactcatatgcaaaagttcatagctgcttgagtcataagagtgcaaagctaggaataacccaaacgctcctcaactggtgaatggacaaacaaattatggtataagtatataactgactactactcagcaagaaaaaaatttcagatacactcaataacaaacatgaatgtcaaaagtattacgctaaatcaaagaagccaatgagtatatgcagtatgatcacttacatagaaaaggcaaaactaaaggcacagaaagcacttcagttgtttccaggggcaggagaagggcattagctacaaagggggagctttctggagtaatggaaatgttctttatcaaaattacggtgtgattacacaaactctatatatttgtcaaaactcatccaaccgtacatttaaaactggttaatattactgtttatatattatacctcaataatgaagctgattttttaaaaatctgtaacatctcttttctgggctgacagctaacaaaaaaatgagaagacactgtttaccttcccagtcctccatgtaaggggcctcctcagcttctttctctggagaaaatctgtcaatgaattttccttctttcatgaccctggtgatttctcggagctgatgtagcaaccgtttctcttggtcagaagtcacagtctgtgctctgcttagaaatatcagacaatccaaccatttagtggtaaatactcctaggcaatggacgtaaacatcactatggtctgtctgggtactggaatagaaagtgcaattgcagcagataattattctaggaattgatcctccaactgcatagctgggaactagagatgttagttcaatgctttgattttataaatgggaaaattaaagcccagaatagatcaagtgattgcccaaggtcccgaaattagttaatgtcaatactaggaccagaccccagatgtctcagcttttagttcagtgttttttcagggtatgtcaatgccctgattctctaatcgcctaacaatttcactgctactcacattactccatttactacaagccacttttctctgaagcaaggtcatcaaaggaaaacgttctgggccattagcatcaaccggggaaaatttatgctactagaatcaccaggcttaatttacgtgtgcaggtataaggatatattctaaaatttcagaggtgggtgattttgaaaattcaatcatctagactagagaaattgaggaaactggggtccacagaggagaaatattgtttatatattcatactgccacttaatgaagcactataactaaaaccacccaggcttctgattgcattctgcgcaattcttgaagcacagtgctcaagttccacattttggaaaacctggtttgaatcccaacttacttgtgtggttctggcaaatatctgcaaaaataacatgagactcaaggataacagtttgattgttttcttctagaggaaagcactgcatcacactgacaggcaaacaaggtcctacttagaagactgataactatctgctttgagaccagttttatctagcagcaggatttaatggaggctacttattctcttcttaaaacccagacacaagttaatacaacacttacaaaggaaaaatgatgtactatgtactagcctgtggagatggtcgtctatttttctaacagccagttctgagcctgcattcatttctctgctcagcctaactttagccttaatgactaataaggaaaatgaaaagagtatttctcctttcaacatgaagatagtaactgaggaaaatgaacattaccagagacctcagtgaaaggaaaatggaaaacaccacgagctccacttcttccacaccaagcagcttcaaagccatgaactactaaagatgcctgtctgttccacattcagctaaaatcctatacttacagggcctctgatagctctattcttcccatcagtacaggagtcctgactctccacaactgctcgtgtgtcccacataacccctatttcttactgttaaaacaacccactttgtgtgaggcttctggggcagactagaagagcttacctgcttatcacaaactcttgtctcttcaggcggcacatgttacttttccagactgtacgcagggcattctgatcttcaatgaatgaaacagtcttaattctgtttcctaagtcatgggaaatcagaagcccttatcctaaaagaggatgggtagactacaggaagcaggaacagacaagagctttcccagagaactccaaaccaaagcatcctcatttcactcttaacaagtatacttttattgtccatatcatgcattatgcattaatcatggtctaccttatgacatcttctgaatttattgcaatgaatattttcatggattccttatcatctcaacttggtttgatactcctagagggcagtaataattaagttgacaacagtatagacacaatgccatgatcactgttaagagctcaataattacgtgttagtttgattgatccccatttcctcaccatccattattttcttccacctccctgaattctggattccgttctatcattttatgaaaagttgcaaaaacttttttttttttttttttttttttgagatggagtctcgctgtcgcccaggctggagtgcagtggcgccacctcagctcactgcaagctccgcctcccgggttcacgccattctcctgcctcagcctcccgcatagctgggactacaggcgccagccacctcgcctggctaattttttgtatttttagtagagacggggtttcaccgtgttagccaggatggtctcaatctcctgacctcgtgatccgcccgcctcggcctcccaaagtgctgggattacaggcgtgagccacagcgcccggccaaaaacttttactcctaagtgatttttcactttactaagtccaagggtctttttctcacatttcattcttcttgacttctctataccatagaccatcctctgcttgaaacctcctcctcccttagctattgagacatttgtattctcccacttctttaaacattccttttatctatgatcctgactcacttttttccacccacctcccaaaacaattttcccaaggctcaatcctaggactctcatttctccattcttataatcatgccctcaggaagttgacccagtattacagattagaccatcacctctatagaaaagatgtcctaatgctactattaatcttgactttccacacaaattcctgtctcacaactccagttatttcctgggcatttccacttggaggccttggaactatgttaaagttaaccttaaattcacctcttgaaaccaggtcccagttggctcaggatcgtgagcaactgcatgaacaggaagaccagaagaggctgagtatggaagattctaagatgatagaaaaataaaaggtcacagttgggaaacaccctcaccagaattttgaattctataagcccagcagaatcatcaagttccaaatgcaagagttaagtacagagaattaaatagatgttaataccattcatggttagaacagaactcagaccagtaaaagatttcaggatactgcagcagagtctgatatgcctcaaagatttggtgatctcacctttctccatggagattttctccatctctcactcccagccaatgacttccaaacctgagccctttgctctgacctcaagaaccaaatttcctattgctgtttcatattatacatggatgttctgatggcatctcagacacactcagtgctgaacttatgatcccaactccaaagccttatgtactttcccttcttttgtattttatcttagttaatgccataatcttccttccagtttggctgtaaatctccaatgcatctttatttatttattcttctccattactcttatctggttagtagttttcttttggggaaccaactcctcttccattcatagtgcaaagattaacgtgagccatccatcccctacctctccttcaagggtggccatgtgacccactactaattatcacattccatccccttgactgcagggattgattcagggatagatataggacccaagttgggccaactgtacttttggaccttgaacacagtgaagcctgaactgaatacttttgacattaaattcatccaggcaacagtccatgaggagactttccctttgttcctgctccctaaatgcccaaagctgctctggttaccacccttcctgaaacctgcatgttcagctgttcctttgatattatgagctaccccacattcttccaataaattctgcctcctcgtactccaaattttttgctagccagagttggctgtctgcaaccaaggaaccctgataaagcctgtgattttttttcttccattaggtccccttaacttgcccccacttttccactctcactggcctattaccatttgctgaaaccttttcaatagccttctagtatgtagtcactctatatattactgtaagagttatttttctaaagcacagcaaatcatgacatttctcctcaaaagccttcagagtcaaaataagtgtgtgttgtgggggggagagaggacccaggcaaacgaaaaagtatatgccaagtccagaggcaaaaaggtacaggtattttagaggaacagcaagtggtcagtgtggctggaccacagagagagtgatgaagaaagataaagcaagagaggtacacaaggccaggtcactcaggaccacgtaagctacgttaaagattctgtgctttttcaaaatcaaaagggacctgttgaaggattaaaacaaaagagataatctgtttggaaaacagaaagaaaaccgaaaggaggcaaaatcagagaaatcacatgagatagttatgacctgtatcaaaaataggcattcattcattcactcactcactcactcactcactcactcactcactcttctacttcatctaacacttttttggagccttttatgtgcctgtgctaagctctacagctaagaaggataatccctgacctcacggagcctacagtcttttgcagcaagacagacttattaattaaaaagaaatgacaagacatggtgattgatgagatatgggaagtaaaataaaaggtcaatcaaggataacatctaatttctgctttgggcaaccaagtggatggtggagccatttgctgagatggaaattaaaggtagaataggttcagttgggggatagatgacaaatgccatcttggacattcattcattcaacagatatttattatatgatgaggctaaaggtaggtatctatgagatatgtccagtgggctctatatatagaggtcaggaaatgaagtaaaggaatggtcatgatttcctcttctaccacaaaaacatacaaatgcttaatcaaaagtgaataggggccaggtgcggtggctcacgactgtaatcccagcactttgggaggccaaggtgggcagatcacctgaggtcaggagttcgagtcaagcctggccaacatggtgaaaccttgtctctactaaaaatacaaaaattagccaggcgtggtggcacatgcctgtagtcccagctactcaggaggctgaggcaggagaatcacttgaacctgggaggtggaggttgcagtgacctgagattgcaccacagcactgcagcctgggtgacagagagagactccatctcaaaaaaaaaaaaaaaaaaaaaaaaaaagaataggtattctaattcaataagtatttccttagtaccgactatacaaacacagtgaacaaaataggctaagtctagcctcaaagagtttacattccaggaattcatggcaaaaatctgtagtcccacatacatagttgacatgcctgccagggccctttgctgccagaggttgcaccctccctgcttttctcatggactgcttgaccataccatgcttctagcaggtaaattgttacaacttggcatgctattccagaaaggaatacagcctgtgatttttttcttccattaggtccccttaatttatccccacttttccactctcactggcctatttattaccatttactgaaaccttttcaataatcttctagcatgtagtcactctatgtattactataagagttatttttctaaagcacagcaaatcgttacattcctcctcaaaagccttcagagtcaaaatatgtgtgtgttgtgggggaagagaggaccaaaatcgtaaggacagaaatcaggacacctcacttctgattcctagaccctttccttagtctcagtgtccttgagttaaacactgtgcttaatatcagacagaacatggcacaagactgacattctaggtttcattatttaaatatgtgtacagacctacatccctcacaagtaaaagctttctgaaaagtttgattagataatatcaaaaactttccccatatttctgttcttacttaagcattaaggtaaagtttcagaaactgcagagttttctaattttaagccaacatcctgcagttatggaatattatataaaaggacttaagaggctgtaaatgaatgtatcttttgctttacccccagaaacccagagatgtgatacaattttgatctgacagaacaaatactggaatattttgggcttttctaataatcataggagcacagacttgtaaaagaacaaatgccacagaaaatgaggttaaaggacacaaactgtaagtataaaagggaaaacatgtagaaacatggtgctatggtttgaatatttgtctcctcctatactcatgttgaaacttaattgacattgcaacagtattaagaggtggcacctttatgaagtgattaggacatgagagcagagccctcatgaacagattaatgccattatctcagtgggttagttatcccaagatgggctgttataaagtgggctggcctctggtgcctccctcttttgtatgtgcttgcttgcccttccgcctttccaccatatgatgatgcagcaagaagaccctcaacagatacctgcctgtaaaccttggacttcacagcctccagaactgtgagctaaataaacctctgttctttataaattacccagtctgtggtattcagttataccaacagaaaacatacgaacatatgggctgcctagcccttacagtctttagggcataagtcccatagggcctacctgtaaggataaaaggtgttggattaaggagtgtcagagagaaaaatcacatctgagaactaaaaaatgagagatttggtaaagagccaggagccatgctctttcttcagtgggaagagttgctccccagttcctaagaggtagggtggaaaaagtattacacaacctttgccatgctgcaggcttcaatcaatatgttcccaagaagtccacaactcagcatcttataaaaagtaaacattctgggctagaacctgtggcccctgaaatgagacagtacaactccagatgtagtacagtgacagcttctctgcctttgcacataaaaaaggagacataaatctgggatgaagaggacagacagtagttagaggttatagtattgcatccctggcttgggctatagatagatgatgtacatggactgaatggtggagtaatttgagttaagggagtctgttactcaacagtaaataataatgagaaaatatcttcatgttgtctcttaccccaagctccaggagttgggtctcccaagtgaggggccctgcccacagaggtttcatctatggttttctttttttttttaatatatatattttttattatactttaagttctagggtacatgtgcacaatgtgctggtttgttacatacgtatacacgtgccatgttggtgtgctgcacccatcaactcgtcatttacattaggtatatctcctaatgctatccctccccactcccctcagcccacaacaggccccagtgtgtgatgttccccttcctgtgtccaagtgttctcattgttcaattcccacctatgagtgagaacatgcggtgtttggttttttatccttgcaatagtttgctgagaatgatggtttccagtttcatccatgtccctacaaaggacatgaactcatcattttttatggctgcatagtattccatggtatatatgtgccacattttcttaatccagtctatcattgatggacatctgggttggttccaagtctttgctattgtgaatagtgcctcagtaaacatatgtgtgcatgtgtctttatagcagcatgatttgtaatcctttctgtatatacccagtaatggcatggctgggtcaaatggtatttctagttctggatccctgaggaatcgtcacactgtcttccacaatggttgaactagtttatagtcccatcaacagtgtaaaagtgttcctatttctccacatcctctccagcacctgttatttcctgactttttaatgatcgccattctaactggtgtgaggtggtatctcactgtggttttgatttgcatttctctgatggccagtgatgatgagcattttttcatgtgtcttttggctgcataaatgtcttcttttgagaagtgtctgtttatatcctttgcccgcttgttgatggggttgtttttttcttgtaaatttgtttgagttcatcgtagattccggatattagccctttgtcagatgagtagattgcaacaattttttcccattctgtaggttgcctgttcactctgacggtagtttcttttgctgtgcagaagctctttagtttaattagatcccatttgtcaattttggttttgttgccattgcttttggtgtcttagacatgaagtccttgtccacgcctatggtattgcctaggttttcttctagggtttttatggttttaggtctaacatttaagtctttaaaccatcttgaattaatttttgtataaggtgtaaggaagggatccagtttcagctttctacatatggctagccagttttcccaaagccttttattaaatagggaatcctttccccatttcttgtttttgtcaggtttgtcaaagatcagatagttgtagatgtgtgatattacttctgagggctctgttctgttccattggtctatatctctgttttggtaccagtaccatgctgttttggttactgtagccttgtagtatagtttgaagtcaggtagcatgatgcctccagctttgttcttttggcttaggactgacttggcaatgtgggctcctttttggttccatatgaactttaaagtagttttttccaattctgtgaagaaagtcattggtagcttgatggggatggcgttgaatctataaattaccttgggcagtatggccattttcacgatattgattcttcctatccatgagcatggaatgttcttccatttgtttgtatcctcttttatttcattgagcagtggtttgtagttctccttgaagaggtccttcacatcccttgtaagttggattcctggttttcatgacccttaggtgtggcctggggttgccaatggcccaggtgagtgtaaagatattttttcagacataactgtctataatagcctgggtagttctccacccagactgtaggtggcagctacagggttagggcagaaaaggccagaaaagtataattgcacaaattggtttagtcacactcatacaaatagtcatatgttagataatgtatataaagcatttagttcagagtgtggtccttagtaattgttcaataaatatcaattattattgtacactcacacagatatattaatgtatctatacaactttggggaacattccagatagtaactctgctttccaggcaaaaagaaggtcaaggctcctgggcccacacaggcaaggttcatcctcacaaatgtcatttcaacagcactgcagacgttgcagggaaatgccaggtcaggaggctgcaatctgaggatacccactctctcatatccagccaaagacaggcaaggccgaagccagtgaacaaagggcacagcgtactagtactataaaggatggcaaatagaggctaaggtagagcaacgatttcctggggcaaaaactacagtgtgctcacaaagatgcaggagggacatttcaacacttccttctgcatgggattctgccactccccctaatattcttcctccatccttgccagaagacctagctgaaactgaacccttctttgtcctccatcttacattctggtttttccttcttggcctttctatatccacgttttcttggttgttgtccacttctatcaacctcctgaagccaccctttcagatcctcagccagcctggtagcaagaggagtgtcttccctttgggacattctaaacggccagtttggctcttaacatctaatttacatgtaattctgtgctggcacagtcgacacaaacatgaatgcctaatctgatcacacttgctctcttctctcattttgtctcaagtagaaagcatcatgttcaataacctggttttacttaaaattatacctattttagacagctaggaaattttctttcttaaatcatagttatttcaccctgtaggaattactcacaaatttattcactttcacaataatttgcacattaaacttttgaaaactgaggttgcttgacagtatgtgaatgaaaaatgttaaatgataaagaatacgtaaatgacatatttacaatttaaaaactgacagtacataaaatgaaaataagtggtctatttatcaaaaaaaaagcataattttgaattttctttccttttctttttttgagatagaatttcgctctcattgcccaggctggagtgcaagggcacaatcttggctcactgcaacctccgcctcccaggttcaagcgattctcctgcctcagcctcccgagtagctgggattgcaggtgtgcaccaccacacctggctaattttgtatttttagtagagacagggtttcatcatgttggtcaggatggtctcaaactcctgacctcagatgatccacccacctcggcctcccaaagtgctgggattagaggcctcggccactgcacccagcctgaatttattttctaaatgagaaatagtctgagtcccgttacatgaaaacctacctctcaccattaggtcccactctgttgattaatttttccatggctgcttctgtctccttcagtttttcttgcagttgagcaagctcaaaactggctaaaaaataagcaacaatctaagaaccatcagagacaactccctaaacctgttaaagagaccacaaatttttaaaaagctattgtactgtctaacttcccattactatctcattgaagaacaccgcagttttattaaaggattctgtgaatatttaagatttccaaaaaggatgcaaagtgtgactgggatatttagttccatagaaaatccagaagtaaatccaaaaagcagttacagcccagataaacatgatttcctgcaatgcttttgccaagtctcttacttgcgggtggtaaatttttcataggttatttttcctgacatacattctagtctataaattcttgaggaaagagccatgttgtataaatttaatttccctagagaacacagaatattctagttgtataataagtatctgatggccatgtttcaacagtcagaagtgttaaactctttccctagatctaaaaactgattttggcaatgatatgatttctctgcctccattttgctctctgctaccaatattttgaagtctgaaaatgagaagtcattccaaacgtgaaatattaatttgctaatatattaaaaagtgaactggtggttttgtactttttgtagtacatcaatataaaaacttttgagaattcccagaactaaggcaaaaatggcatcagattaatttggagcaacttttgagaaatgcttttaagacatacccacagactgtccctgtggctataaaactgtttgactcaataatacctgtgaatatactgagaaggggcacttactaattttcctgtgggtgtttccaggcatggcagtatagcatttcccatcctctgcagttgttttcccctttgagagctgagaattgaaggaggtatagcacatcaacagcagctcagaacctcagtcacggaacccctcatatcaaacaaaaaaaaaaggttgggaaacaaaaatgaaggtcagaaattaaatcaaatagcaacactagagaaatagctcaaaaaaaaaaacgccaaaagatgaggtttccaagtaaaaaattatcaaagcacaagtgtaaaaagtaaagtagagattcctcttcaaagagactttactccccatataattaggaatagtaacttctcttagaagcaaaatttattcaagaacctgtgctaacatgcttagatatctgctagccataataaagaaatcaactgttcttagctcccacagtttagcctaaatatttgccctggcatgcttatacttgtcaaagcaagcatgaggtcatagcctgttcctcttccttatatgaaggtgtttttacctttctcagcattccacaagttagttcctccttcctttgttctcctctgcctttgcctcttttaaaaagttctaagtcgctagccaatcagcacaaatacagaatgtgaggtcccgttccagccaatggaaaccggacacagcagtaaggtggatgcgtcaggttataaatgaccctgtctcctttgttcggtgtactctcacggcaaaaccgctggtgagtgtaccctttctgcagaaagtaaaaatggccttgctgaggaaattaaatgtacgtccaagtgctgcttctttatggcaccagagaacaagcatttctaacacaagggaaaaaaaatctccctacaggtcatcttccttgctcatgctcatctaaaagggatgtgtggcaccctatgggcattcttacagactcaactcagactgcctgcagaattcctgggcgagaaagaactcatcttatttaagcttactctagacaggagggcaaagtgagtcttctgcctctaattcacagtacaggggccaggggcctgcaaaggcctgcctggaggtggaactcaactgggggtctgctttaaagaacctacacccatgtctccccagagctaggaaatatcaggcttaatttcaggagggacagttctgtctcaggagaattattggagataatattaaaaacagcatctcaaattcctgtggagaaacaagcaggataaagtggtgtcattatttggccttacaatggctatttggaaatcactgtgccaatcccaataataaaagctcttcttagaaaatctttattccttttcggcctgtaaagatgttaatttttttttttttttttttttttttggcaggggagtgcattgaattgtatcactcactggattaagaaccaaaagatccatgttcaagtcctagttctgccttgttagttgtgaattttggggcaaaacacttaaacattgagtaaacatttcttatgtgaaactgaaataatggctatcctaagtacctcatgaagaggaggcaggatttaaagagatgatggatttgaaataattttatgaactataagaagttttaatgtagacaatgatttttattgccatattagattttcattgatgtaatatgattaggatgattctacttaccttaaatagaatgtacagtatatataaaaaaatcccaaaaccgtagattggaataatctgccccatcagacctcttccactacctcctcctccagcacctccacctgatcctttggcctttgcaaatgcctcggcaaggtgagacctctggaaacgagccccaggagtctggccatctgagggtgcctggtgatgatgcatcataggtggaaatcggcccaattttcctgagaaaataataatcactttttatctcttctactattttaaagatggctatcatgaaaacaccaaatcattaaggtataaaagaggccaacacaaacaagtagaagaaaaaaatggcaacttaattaaaaggatacagaggtatcacacatatcctaaatatgatgtgatcatctctagctgttcaccaaacccattttctcttccctctgggtccttagctggaccacatttttcagactcccatacagttaaatgtggccatataaactgagttccaaccaaggaatgtgactaggactgtgctagctcaaggcctggtctataaaatctcccttgttattcaactccgtgatcatttcttttctgcagcatggatgctaacacccacggggaccttggaagccacgggtagaaacagcaaagcctccatcaacctgattcctaaataattatgtagtgcagagccctccactgctgccacctcactaacttagagtcatctggacctgtctgtaagagtgagaaatcaacttctattgtgttagggtcattatacactgtggaatctatttgttacagcagttagccacccctaactaatacagataagaaaatacagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatactaactttaaatgtaaatggactaaatgctccaattaaaatacacagactggcaaattggataaagtcaagacccaacagtgtgctgtattcaggaaacccatctcacgtgcagagacacacataggctcaaaataaaaggatggaggaagatctaccaagcaaatggaaaataaaaaaaggcaggggttgcagtcctagtttctgataaaacagactttaaaccaacaagatcaaaagagacaaagaaggccattacataatggtaaaggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacacctacagaactctccaccccaaatcaacagaatatacatttttttcagcaccacaccacaactattccaaaattgaccacatacttggaagtaaagctctcctcagcaaatgtaaaagaacagagattataacaaactctctcagaccacagtgcaatcaaactagaactcaggattaagaatctcactcaaaaccgctcaactacatggaaactgaacaacctgctcctgaatgactactggatacataacgaaacgaaggcagaaataaagatgttctttgaaaccaacgagaacaaagacacaacataccagaatctctgggacgcattcaaagcagtgtgtagagggaaatttatagcactaaatgcccacaggagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaacactaataaagaaaaaaagagagaagaatcaaatagacacaataaaaaatgataaaggggatatcaccacctatcccacagaaatacaaactaccatcagagaatactacaaacacctctacgcaaaaaaactagaaaatctagaagaaatggataaattcctcaacacatacactctcccaagactaaaccaggaagaagttgaatctctgaatagaccagtaacaggagctgaaattgtggcaataatcaatagtttaccaaccaaaaagagtccaggaccagatggattcacagccgaattctatcagaggtacaaggaggaactggtaccattccttctgaaactactccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacaggattatctcaatagatgcagaaaaagcctttgacaaaattcaacaacccttcatgctaaaaactctcaataaattaggtattgatgggacgtatttcaaaataataagatctatctatgacaaacccatagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtctctgtttgcagacgacatgactgtatatctagaaaaccccattgtctcagcccaaaatctccttaagctgataagcaacttcagcaaagtctcaggatacaaaatcaatgtacaaaaatcacaagcattcttatacaccaataacagacaaacagagagtcaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaacggaagaacattccatgctcatgggtaggaagaatcagtatcgtgaaaatggccatactgcccaaggtaatttacagattcaatgccatccccataaagctaccaatgactttcttcacagaattggaaaaaactactttaaagttcatatggaaccaaaaaagagcccgcatcgccaaggcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgccgcatatctacaacgatcagacctttgacaaacctgagaaaaacaagcaatggggaaaggattccctatttaataaatggtgctgggataactggctagccatatgtagaaagctgaaactggatcccttccttacaccttatacaaaaatcaattcaagatggattaaagccttaaaccttagacctaaaaccataaaaaccctagaagaaaacctaggcattaccattcaggacacaggcatgggcaaggacttcatgtccagaacaccaaaagcgatggcaacaaaagacaaaattgtcaaatgggatctaatgaaactaaagagcttctgcacagcaaaagaaactaccatcagagtgaacaggcaacctacaaaatgggagaaaattttcgcaacctactcatctgacaaagggctaatatccagaatctacgatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacctagccatcccattactgggtatatacccaaaggactataaattatgctgctataaagacacatgcacacgtatgtttattgcggcattattcacaatagcaaagacttggaaccaacccaaatgtccaacaatgatagactagattaagaaaatgtggcacatatataccatggaatactatgcagccataaaaaatgaagagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaattaaaaaaaaattaaaaaaaaaaaagaaagaaaatacaatgtggtctcaggagaaaagagaactagaaactggaaagccatcaggatccaggacaggtactttcacattctagctcaatctctctccttctctatggggccataaggttttttctttgtttttctgtgcacatcttctttattctttctctgcagaccatttctctagctcctttgtgcacacaggggaagatggtcgccccagcccctcaatttgcatgttcttcaacaggctagctgagacatcctaatttcaaattccttggaggaggactttaagtactcagcttgggtaggtatacatctctttccaatcagctatagctgaacagacaggatggatatagcacaaacagggtgaaaaagggactcttgaaaaaggggatcttgtgagtggaagagcagggcttgtggggaggggcagaggcagggggaggtgttacatcaattttcttgcattttttttttctccatcaagagcagtcaaaagttaacaccaactaccagaaaggaatctcaaatggccaaataaacaggcatgtatgaaaaaccaccaggagataacattatagaacagaaaatactagagagcataaataacactctaaataaataacactctaaaaatagaaataaaaaaattgttggatttgacttgaacaaaattgacaaagatgtggagaggcatgaatcctcatgcactgtgggtaagtgatacagatattctgcctagtgatctggctgtacttcgtgatattacatatgtacacaccctatgatccaatgatcccactctggtgaataaatcccacagaaaatctcaaataaggttatatatatgtgaactacagactttatagacctatgtaagaatgtttgctgtgacaatagtgtagtagggagtttgaagttaactctgatttccttaactggaagaatggaaaatcaaaatggagtgaatactaatatggaattctacatagctttggaaaccacactttagacatacctacagcaacatgaatacatctttaaaaacataccgttaggttaagaaaaagcaaataacattatgcaggttgaaaacacacacataacgatattaatctttcaagcaaatatgtggatataaagacataaacataaacacatcagagtaggtgcatatgaataggaaagggaactggaatgtgggttgaggataaagaactaaaagaataaaacaagaaagtaaacttgcactaacaaagttaataaaatgctatgaactgagaactgcctttaagttgtcgatgaagagtcaaactaaaacatttcaagagatttattctgagccaaatataagtgaccatggcacatgacacagccctcaggaggtcctgagaacacgtacccaaggcggttagggtgcagcttggttttacacattttagagagacatgagacttcaatcaaatacattggtttggtccagaaaggcaggataatttgaaaggcggggcggggtggcagggggcggggtgcttctagcctacaggtagattttaaaattttctggttgacaattggttgagtttatctaaagacctgggatcaacagacaggaaatgtttagattaagataaagggtcctggcgaccaggtttttcaattttactgtgtaaaggaagctctcagatagcagacttctgagggagtagattgtaaaatgtttcttacatgaaaggaaaatatcatgggccccttcaaggtggggaattggtcctggcaaatctgcctcccatttttattcaaagtcatcttcctgctcactgagacagatgcatatctgattgcctcctttggaaaggctaatcagaaattcaaaagaatgcaaccattcctctctcacctatctgtgacctggaagccccttcaccactttgagtcttcctgcctttgctttaagttatcccgcctttccagaccaaaccaatgtacttcttacacatattgattgatgtctcatgtctccctaaaatgtataaaactaagctgtgccctgaccaccctgggcacatgtcgtcaggacttcttgaggccgtgtcatgggcgtatgtcctgaaccttggcaaaataaacgttctaaattaactgagatctgtctcaaattttgggtgttcacacttatcagacttaaaagggtaccttagttgattgtctcctgggtctggaaagaaagaaagaaaaaaaaaagtgggtggaaaggagattctctatagaatgtggatctttcccacaagagacaaccttgcagggcaatttcaagatacggcaaagaaatatatttggagttaaaatatttttatttcttttcttatttgttatgtgaagttatgccagagtcaggtgggaaagcaggctagattatatggggtgaaataaaacccctctgatgagacttcactgtttgtagggtgtgcctccctaggcctgttaggtagaacttgcgtaagattttttttttttttttttttttgagagggagtcttgctctgtcaccaggctggagtgcagtggcgcgatctcggctcattgcaacctccgactccctggttcaagtgattctcctgcctcagcctcccaagtagctgggattacaggcatgtgccaccacgcccaactaatttttgtgtttttagtagaaatggggtttcaccatgttggccaggatggtcttatctcctgacctcatgatctgccccccttggtctcccaaagtgctgggattacaggcatgagccgaatttgggtaagacttaaaaaatcagaatttagttctcaaagtcaactctgctcctgaggtaagaaagaaggtaggtgggcaggtaggcttggaagttgccttctgccttgtatcctttctcagccaagctccactccagtgatactccttttcctctcagtattgactttaaatgatatggaaaattttgaaaagaaatgcttcttttagagactgggtcagcaacagaagcacagctttagacagtaaaaggaaatcaccatgtcaccaccctttattctggatgctggtgactatgccccttttaaattttcaaggatcttagtaaattaaatgatgagtactggctttggctattatgcaccttcaaaagcatgcctagccagcattcaggaagctaacttttctcttgagagaatctatcaggtggctaatgttcaataaactggatctaatatttgtagtattatgttgtggaacttcaccttactgtgttgagaatactatcttcaaatctggcataaaacaaaaaaattaaaaattaaaaacaggtaattacagaaaagcattattttgcatctctaaaatttaagaatgacattacacatctcccccaaaacttttatagatctgtcagccaggaaaattttaggatcctattatgttcaagattctgccatatgcaagaaaagaagagagcgataaaggtaatagaaacaatagttcccacatggaacaatgccttcaaaaccagaatatctaaaacaaagacataaataacagcagcagcagcagcagcagggtatcaaggacctttttactagataaactaaatattcaagttttgaaaagatgcaaaatctttctttaaaaaaaagaggagttggctgggcgcagtggctcacacctgtaatcccagcactttgggaggcttaggcgggcagatcacgaggtcaggagatcaagaccatcctggctaacacggtgacaccctgtctctactaaaaatacaaaaaaaaaaaaaaaaaaattagccgggtatggtggcgggcacctgtagtcccagctattcgggaggctgaggcaggagaatgacatgaatccgggaggcggagcttgcagtgtgccaagatcgcaccactgcactccagcctgggtgacagagcgagactcttgtctcaaaaataaataaataaataatataataaaaaataataaaaaaaacaggaggcaaatggagtcaattactgaagggaatgaaagaataggagagaagcaaaagcacaccaggaggaaagaagactgtgtatatgagattgagaacaaagaaaccattaagtaggacttactaccaaattagtttggctccatttagggaagtaagaagagataagaagtaaagatggggaggagttaaaatgctaacttgtgtgatatataaatttgatacagtggaccttgatgagaagggtacttgatggggattaatccagcagcagaatataggctctaatatagacagaaactagggtctgggaaaacgtcaaaaaggctattacagtaacttagcactgagatgcaaatcactgaggtggtggctagagctataaaaaggaaaggataggtctataaactaaaaataaaattctaagcccaccaactgactgatgggtcatctcttggccaacgggaccccaaagtaaccttgaaaactaaattcttggctatgacgggatggggggttcaaacccacctcattataccccttccctcgcaaaccacgattagcctttcttctctaactaccaaacagaaactagccatttcaaaaaaatccaccactgctatcaaccaaccacctgatactgtccctccttttttgcctgataagagactaccaaccacagaatggttctggctggtctacagagaatgtacagtaagggctttcatgtcttctgcttcaccttttgatgtcagagggctgaaaactccactctctgaccacgctattactgccattttgtgtgtataagacccatgaaggacgtgtttctcctttcataaatattcatgactccccctacagcttattgaatatgtatatacggccaccctgctcagcatgaattcctgttccctttgcccatccctccaagtgtatgtttttgcttctggctggaggctacacttcccagcctgtcagaatggccaccctgaaggttgtaaccctttataagaaataaagtctcctcttctcttctcaatttataaatcatattttttaagttaacatgtccaaggtttattaccatgtaatcagtgccatttaacactgaacaaaaatagagctcatggaggagttgtcagaaaactccaagatcaagagtttaagatagagaagataatgaagaaacttggaaggcttactgttagggaacaactgaatatacatttttcacacattatattccagttgttgatggaatacagaattttttttttattagactgcagttaggcttaagaggaaactctaagctacctaaatgacaaagctaattaaaattgagtgaatggttcccaataccaaaaggctggaagaatattgtatttatgtggaaaaaagagaaagaaaagaaaaatgcgctagccaaagatgactagaaacaaactaataccataaaagtcagaggaggatgaaattgaaggcaactgagaagcctggaaacacataaactaatggcaatccttgttttcagacacaatatattcttgagaaatggatggccataacatgaaatcctgactgtccacctgtttagacaataacagaaaccaaagtactacaaagcctcagagtcaaagggggccttaaaagtcatccagtcttaataagtggtgtggggacaggtagatattcacatgtaaaagaataaaattggacccctatctcataccatatacagaaattaactcaaaatggatgaaagacctaattataagagctgaaactttaaaatcttacaggaaaacatagacataaatccttgtgactgtggattaggtgacagtttcttagacaggacaccaaaagcacaaacaacaaaacaaaaggtaggcaaagttgatgtcatcaaaattttaaactctggtgctgcaaatgacaccattaagaaagtgaagacaacccactgagtgggagaaaatatttgctaatcatgtatctgaaaagggttagtatccaaaatatataaagaattcttaccacgcaacattaaaaagacaaataggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacgggaggctgaggcaggagaatggcgtgaacccgggaggcggagcttgcagtgagtcgagatcgcgccactgcactccagcctgggcgacagagtgaaactccgtctcaaaaaaaaaaaaaagacaaataaaccaagtaaaaataaacaactgtggccaggtgtgggggctcatgcttgtaatcccatcactttgggaggctgaggtgggcagatcatttgaggtcaggagttcaagaccagcctggccaacatggtgaaacctcgtctctactaaaaatacaaaaaaattacatgggcgtggtggtgcatgcctgtaattccagctacttgggaggctgaggcaggagaatcgcttgaacccaggagacaaaggttgcgatgagcagagatcacaccactgcactccagcctgggggacagaagtgagactcggtctcaaaaaaaaaaaaaaaagagcaagggatctgaatagacatttctccaaggaagacaaacaaatgtccaataagcacaggaaaggatgcttaacaccattcgccaccaaggaaatgcaaatcaaactcacgaggagataccacttcacactaactaggatggctataatgaaaaagataatagcaagtgtttgagggatgtaaagaaaaaggaactctcatacgctgctagtgggaatgtaaaatggtgcagctgctttggaaaacagtctggcagtttctcaaaaggttaaacatagaggaccatgtgacccagaaattccactcttaggtatacagccaggaatatgctcacacaaaaacttgtacacaaatgttcacagcagcattattcatagtatctaaatgtccatcaacttatgaatagatcaacaaaatgtagtatatccacacaacacagtattatccagccataaaaaggaataaagtactgatccatactacaacatggatgaactccgaaaatattataagtgaatacagccagtcatggaaaaccacatattatatggttccattaataagaaatatccaggatagtcaagtctataggacagaaagtagactagtgattacctagagctggggtttggaggggtgcagaggaaggaaaaagtgactgcctaatgtgtatgaggtttttggtggggaggtgtgtgatttaaaaagttctaaaattgactgtagtgatagttgcacaactctacgaatatactaaaaactacagtgactgtacatcttaaataggtgaattgcatatgtaaattacgtctcaataaagctttttttttttaaagacagctagtctaaccacctgtgtttgatactctcatatgcttcaaattgtggtcctaattctgctgaatacctcaggatagaaaacaatgctttctccaggaagctcatcctacctctacacagctctgactgataggactgtctttatatagagttgatgagtgagtaacaggagaaagaaagaaaacaaaaaatagggtttcaaaaagcaatgctgaataaaacatgatgaggtccaaagaaacctatgttagaactgattaaagaagttaattgataaggaaacctgtattagaattaaggttattgataacatcaaagagatgttgaaaaagtaaaaaatactattttcaaagacagaagagggatttggagagcaatggaacatatagactagatagcaaaaaatatgttttatatcctagaagaaatctgagtactttacatgcggtattattgttcacatatttactgctgagcacttaacaatgtgacagacactatgtcaggctctgagattagaatgacaaatagaacagaatctctgtctttaaaaagagtttacagacagggagcatagttacaatgacatggtaactctaccttaaccgtcaaatccaatggctttttgtcagttctcactcttagttttctgcaatacaaaaaagtaattatcacatagtggtcattcaataaatattggattaatctgaataaatccttgtcaaattttcctgccttaatctctatggcacattactcttctctttttccactggtccttcaacctattccttctcaatctctttcactggttcttctttaatccccttccccaatactttgtctcagcctgttctttctttatactttccttcagcaaactcatttattcaaggaatacactgtaatttccaaaatgtgtacttctagttctgacttttcccccaagctcttgtctcttatttcttaatacaatcagtatatatgtcttcttgtatgtctaccacctcaagcctaaaaatgaactcattttcacctcctaaaacctgctctcctcttgtatttcctttctttgtagattcattctctccaaacttcaggcttgagacctacaacctctgctacctgtgacacttaagacggtaggcaacaatgacaatgctgcatttggcaaagatttctcttctcgtaaagttaacaggcctctacaggtagcaacctcacctcttggatcttggtaccaccatgtttcttaaaactgaatagcccagaatctataaaaagtcaatgattataaaacatttggaaatttctagtgggaattttttttttacaaaagaaaaatttgaaactatgaaatatgccaggtatataaaagtatacatactttatgaacatttgtatatccactgcccaaatataactgaagtcccttgtgtacttttcccccacaccctctctgagataaacaccattctgattttggtgcttattatcagaatgcgtgcttttagattttattgcattaactatgcatctataaacaatatataagcatctataaacaacatataatattgccttgaatgttttaaaacttcatattgtgtataggcagtggtgacggttgcacaacagtgtgaatgtacttaatgctactgaactgtttacctaaaaatggttaccacaattttaaaaagtcctttatattatgggattatattggacacatgcttctccaactttccttttctgcctttttttccaggtggggaatgaacactttggccaacaaatgtatccatgttgacatgtatagctctagttgattcatttaaactgcaatatagcatcacattgtatgaccatattataatttatttacccctttttctgctgataaacatttagattattttcaatttttctctattacaaatgttctagttcacagttacattacaaataagatttgtgtttttttaagtttgctttattaaaaacagctaaagagatcagaataaagatatcagaacataaaactgtaggttttctaatctagaaaacaaaacagctatgtgactatctctataggtacttaagtattctgtaaaagggaacatgactaaatcctaattgtttattgaaagctttgcccatattcaggtttccttaattattaaaatttaatcccagcatttagcaaggctgaggtgggaaaactgcttgagcccaggagttcaagaccagtctgggcaagatggcaagacctcctctctacgaaaaacttttataaatcagccgggtgtggtggcatgcacctgtagtcccagctactcaggaggctgaggcaaaaggactgctcaagcccaggagtttgaggctgtggtgagctatgatcacaccaccgcgtgatcagcctgggcaacaggagaccccatcttaaaaaaaaaaaaaaaaaaaaaattcacttaagttatcatttaagcttaactaaaaacttaatgtcaatggattctggccaggtgaggtggctcacgtctgtaatcccagcactttgggaggccaaggcgggcagatcacctgaggtcaggggttcaagaccagcttggccaacacggtgaaactccgtctctactaaaaatacaaaaattagctgggcatggtggcacatgcctataatcccagctactcgggaagctaaggcaggagaatcgcttgaacccgggaggcggaggttgcagtgagccaaaatcgcgccactgcactccagcgtaggtgacagtgagactccgtttcaaaaaaaaagaaaagaaaatggattttacaaagtgaagctctactttcctttgttaataaccatacctattgctaaaaacaaaaacagaaacttcagcactgttaacaaaagagttttctgaaagcaacattaactcatctgcagcatttcattcttggggcaaataaatctataaagaactggacatgtttctattttaataaaaaatagaaacagcggttcaagaaaggtcttaagggggccagttgcttaagatagccaagcttttccctaaatattgaggaagctgtagaagccatatttgattcagcattacttgaagtagaagccaagacaatagctgtttcttcctcaccggtctcctccaagggccctatcttgttacatttcccttctacctgattctgctttgttctctactgctttcacattttctgctaatttaatcagatttctttcatcttttatcaacctctccattctcaatccatcctatatattactaaaagagatcattgtgtgtctaagttgcttagcacagggcccgatccacacactcaatacacatcaattaccactgttttgttaccagaataatcttcctaaagcacaattctaactggtcttgccagttctctgatcaaaagcttctaatagtttccactgatgacaagaggctgtattacagcagaatggaggtagcagagtgaagtggaatgagtgccaccttttcagtcagttactggttaagattatggctgtgcctcccactatttcagtggaggttaaattaatctttctagggctcattttcatcatctgtaaaatgggcatgatatctactttccagagtttacaagaattacagattaaataatatcatatatacaaagcacctagcacatatagtaggtatttaacaaattctgattttccctccccacaaactgaattcctaaacaactgaattccataatctaacccaaaagtgctcttcacactactttcccattacataccactcatttagtcaaactagggttctcaccatgctttgaacctgactttcaccttcttgcttctgagcctatgcttatcctccagtggctttgctttcctctccaactccacatatctaaatccagccaatcctccaaggcccaggccagatactgcccccatgcccccgaagcattttctcatgctattccccatgcctgtaaaacacactgcttgagcctctttaattgcacttaccacacttggccttaatcaagagttttattaatgtgtcttatagcctgtacttaaatgaaccgggaaacaaaaacaggtaacattttccactaaacaccatctctatccaattttatttggtgtatatcatatctgagaactagaaaagcagcctctaacatctaaaagttggcctggtattatcaactaggcattaatactgctatgagctggcttggtactcacagataagttgtggtgttctcctgttacacataagctatttcagaacaccaacattagacaaggccattctgtgatcatgacggatcaagacaaaaaacaagaccactcagtaatctgtctgaacacagacaaaacatgaacactgtccaagccactaaatacctaatatcccccagtgctgagtaatgtgaacgatggggctgctttatcaattacagctttagcctttctctagttggccctccctttagataaactgttaagataccagtcctagaatttgccttacttcctgaaagcatctaattcagagtaaagtaccacatccttaaaccatcctccagatcacctaacacaaacccaaatcctataatgactttttctaacagtgccttattgagatgccccacaattccccatggtgtgcattctcccttgctgcaatgagtaatacactcaacttgttcaactacaggtgtgttcctagtggtctccggctggaagacaaactaagaacttcttgaataaaggcctagtgttttatttgtttgggttcccagggcaggctctggatcttgcctactacaatctttgctgacctgatttggatgaattatactgggagtgttagcctttattagaatctcaagatcctgcccagtcatttgtagggctaaaaatagttttttacttcattatcctgccagttttcaattttatagtttctagaatagaaactggcaattaggatgactgatcaagcaaggtattccatacccacttacctgtacgtttctaaacttgaaaaaatgcctaatttacacgcattcatgggctctcaaattgtctgttgttttctgttcatttccataatacatgaacaggaaaatgaccctctgaaatcaaaatgatttcctaatctctgtccttcaaacattccttcagagtagatctctgatgcttcattagggaaaataaatggtaaccaaccaaaataatatatttgtcttcaggcacttacataccaacacataagaagctagtttaagataacacagaactatgtatgtatatgtatgtcatacatgtatatgtgtatatgtttgtatgtgtatatttatatacacatatacatgtatctgtatattttcacatctcagagagattaagactcagtgggacacaacttacttagggagaacatcgtgacaaagggtctgtgctattccacaggaacagggccactggagaggggctactaaggaaccctatttataagcattcaggcagggtcagcaggaaagatgcccagatacagtgttactgtgggaacaccaaaggttcccagccaagtagaagtagtagataggactctcttgaagccacctccaacacagagtggcacactgtcatcttggagtacttcaactaccctgcaacctattcaaactctcattcagctgacaatggaacaactgacaagttcttgaccaagtgtgctgacatttttatgttccacaggtacacagggagagcagaagaactgctactctgatcaaagaagaagctctgatgaaatgaaaggagaacctcaggagaatgagatcttagtgtttctgacaacaaagtaggaatcgtgtagcacaaactctaggaagccagagttaagaagttttttgtttgttttttgttttattttgagatggagtctctgtcacccaggctgcatttcagtggcacgatctcagctcactgcaacctccgcctcctgggttcaagcaattctctgcctcagcctcccgaatagctgggattacaggcatctgccaccatgcccagagaatttttgtatttttagtagagacggcgtttcaccatgttggccaggctggtcttgaaatcctgaccttgtgatccacccgccttggcctcccaaagtgctgggattacaggcgtgagccaccgcgctcggccacagagcctcctttctaagtaggaaaagagacaataaacaagataatgataaatactaaggagaaaaaataagacagggagaaggggtaggaccgtgttggaagttaagattttagctggaatggccagagaaggcatcaggaaatgcagtttgagagaaaacatgaagacgaagggaaaggcacatggatatccaaaagaagagcatttcaaacaagggaaacagcaaatgcaaaggcactgaagtgggaacatgcttggcatattcaaggaacagtgaggaggaagccagtgtggccacaacaaagtgagacagatagaaaagtagaagcaaatggggaagagaattacatagggccttttgggtcatgtatagactatcttttcatctaagccaggaagccactgtagagttttgaggaggggagagatgtgagttgacttaagcttcaacataatactatctggcagctatattgagaatagactgaagtggggaaggaggaaggaggcaaaccagggtgacagagtaagatggaatagagcaaccaaataaccaactggttgaatgaccctaaacaaaacgtttccatgaatacagtggtgggactctaaaagcagttttaaatgactaagacatttaaaaaaataatttgacctatcaagaaaacatgctgaggctgggcatggtggctcatgtctgtaactccagcactctgggaggccaaggcaggcagatcatctgaggtcaagggttcgataccagcctggccaacatggtgaaactccgtctctactaaaaatacaaaaaaaattagccaggcgtggtggtggatgcctgtaatcccagcttctcaggaggatgaggcaggacaattgcttgaacttgggaggcagaggttgcagtgaactcagatcctgccactacactccagcctgagaaaaaacaaacaaaaagagaaaacatgctgatcataatcaaaggtaaaattgtaaaaaaagaaagaaaaaaagaaaaattataacatggtgggaaaaatttgaacaccaactagatatttaatgacatcaaggaagtattgactttttaggtgtgacaatggtattgtggctacattttaataagaatctgtttttagagatgcatactgaagcatttaaggatgaaaaatgatccaatgtctaggatttgcttcaaaataatccagtgaatggggggaaaagtgggtggggatacccatgacacaagactgaccatgtattgatggctgctgaagcaggatgatatggattcattttactactctctcaacttttgcttatgtttgaaaatgtctttaacaaaaagttttttaaaaatcaagaatggcacacagctaagaaatggtaagcagatacattgaatgaaacattgaatgctctgaaaaaatttcaagagctagaattcttggccaaatttaaacaaataaaatgcaacaaggaaaactacaaattcctacatttcattccgaaacatcaagtgaacagtagaaaatgaacaaaacctagatgagcagctcctattaaaaagaagaaaaaaaggctcagaattctaatatacagcaaagtcagcaaggaaaatgctaaaaactagagcaatccccagaaagcattaagtatagaagaagaagagtgcagggaaacaacagattgctctttcatgaactgtcttagatatgctgttatttgcagttctaagagcctcttctgagagggctgtgttcaaacacttgcacctaggtcataccaggaacggatgagggagctagggatgttaacacaggaaagaagactgaagaaagggacataatactacttttccaattcctggattaatcatcttacacctgtaaaccaaaaagtatctgggacaggcctcaatcaatttagaagtttattttgccaacgttaaggacacgcccaggagagaggtctgtgcctttctccaaagatgattttgagggcttcaatatttcaaggggaaaagtgagctggaggggaaagaagggtatggtaatctatatgttgcaagagaaaaggagcaggtagaggaatagtcaattatgtattcatctggtgctcagtaaatcggcacttcacgtaagatacggtgaacatagagtagctacctgtagagatatttaattttttatctgtagctacctgcttaggaacaaaaggaaaggcagtttcttgcacgactcagctttcagcttaattttttccttttggcatagtgaactggggtcccaagtttttattttcttttcacacacctttaatctacttttcctccattcctattttggcaaaggaaatcaacatctatcccttcacctaaacctgagaataatccagatgtctccctctccctcactttcccattctattttaaaatgtctcttaaaattattctcttccctccaatctatccattgataacctctcttgctctaatatccatattttcctttgggaactcctctcaactccagagtggattcatcagtatattctttctacccacagcaccacaagttaacttaattcaagccattaacgtgaacggatatgtttgctggaacttctgggaaagaatcttgggagtgaggctggaaggtgagagtgatggaggacttaaaagaaaagaggcctggagctgtgcccagcaaagtgctgtaatcccagcacgttaggaggctgaggtgggacaatgacttgaggccaggagttccaggccagctctacacacacacgtatataaatgagacactcccactttctccgggcaatggaatgtgaggaggtaatgtccgaaactgttgctataaatgagacactcactttctccgggcaatggaatgtgaggaggtaatgtccgaaactgttgctataaatgagacactcactttctccgggcaatggaatgtgaggaggtaatgtccgaaactgttgctataaatgagacactcactttctccgggcaatggaatgtgaggaggtaatgtccgaaactgttgcaaccattgctaccaccctgagagggcagccagagcacagaaccaacttgagaacgaacccagagtgaaaaggacacagaaaataagagctagagccccagtgtgacaactgtgagtctctggttcaaaccatactgcaagacatttctaacacagggtcttttcatttacacaagtcaataaattccctgtcttagtcaagctgacttttctgtcacttgtcacaagcaccctaactggtgaacccaatgacaatgacttggtgatgctcatgatgtctcaactggatgactacaacaatcttctccctgaagaaatcctcacaacgcagtgtctacactgctgccagggtgtcctttctaaaaccaggttaaatgtttctcttctccttacacactcaatgatgcctcatctgcctttagaataaaacccaatctccttaagaatgacagaaaaaaaccttcacaatttggcccgtgccaacttctctggtgtcttctctcacaactctgaggatacttcaaggctccatgcttcttcttttttttttttttttttttttttttctttttttgagacagagtctcactctgtcgcccaggctggaatgcagtggtgggatctcagctcactgcaacctccaactcccaggttcaagcaattctcctgcttcagcctcccaagtagctggaattacaggcgtgcaccatcagactgggctaatttttatatttttagtagagacggggtttctccgtgttggccaggctggtctcgaactcctggcctcaagcaatctgcctgccttgggctccccaagtgctgggattatagacatgagccaccgtgcctggccctaagcctctgtgtttctttgctcagtatttcttctacctagaatgcccttctttttcatctggattatttaaacacacacacacacacacacacacacacacacatacacacacacacacaccccccaaaacactttaagaactgcctcctcaatttagccaaggaaggtaaagctgggttaacatctaaatttcaattaatgtaatatgccacatcagtaaaggacaaaactcacataatcatctcataatcatctcaacagacatagaaaaaaagtatttgataaaattcaataccccttcataatgaaaaacactcagcaaactaagaatacaagggaacttcctcaacctgaaaacaggcatctacgaaatgcccccagataacattacatatgctagtaaagcatacttcttaagatcaaggacaagaaaggatgtttgttcttaccacttctattcaacattgcactaaaggttccagctagggcagttaggccaaaaaaagtaaaaataaaaataaaaggcattcagattaaaaaaaaaagtaaaactatctctatatgcagacaagttcagcgaggtgacaagatacagtatcaatatacaaaaactaattgtctatacactaaggaacaatctgaaaacaaaatttataacaacatcaaaaagaataaaatacttatgaatatatttaacaaaataagactttcacactaaaaactacaatctcctttaaaataaattaaagacctagataaataaaaaagaaatcctctgttcatagattgaaagatttaatattggtaagatggcagtactctccaaattgcttcagttcactctatcaaaatcccaactggcatttttttttttttttttggcagaaaccaaagtgatgatccaaaattcctatggaaatgctaggtcacaggacccaaaatagcaaaacaatcttgaaaaagaagaacaaagtttgaggacacatttcacgatttcataacttagaaaactacaataattaagacagcatggtactggctaaggataagtatacagattaatgtaatataattgagagtccagaaacaaactcttacatttagagtcaactgatttgacatgggtgccagaacaatttaatgagaaaagaagagtcttttcaacaaatggtgctggggcaactatatatccacatgaagttggactcctaccttacccatatacacaaattaattcaaagggatcaaagacttaactgcaggagcaaaaactataaaacttgaaaacataggcataaatcttcatgaccttggatttggcaatttgtctcagatatgacaccaaaagcaggagaaacaaaagaaaaaagtagataaattggactttgtcagagaaaatgtaaaacttttcttattcaaagggcaccatcaagaacgtgaaggcaaccactgaatggaagaaaatatttgcaaatcatatatctgataatagatttgtacctagaatatacaaagaactcttacaactcaacaataaagacaagacgccaagtgtggtggcttacacctgtaataccagtgcttcaggaggccaaggtgggaggatcacttgaggccagaagttcaagaccagcctgggaaatatagtgagagcctcatttctgccaaaaaatttaaaaattagccagctatggtggcacacacctgtagtcctagttacctgggagggtaaggtgggagaatcacttgagcccaggagtttggggctacagtgagcaatgatggcaccactgtattccagcctgtgcaccagagtgagaccctgtctctctcaaaaaaaaaaaaaaaaaaaaaaaaaagacaagtaatctgacttttaaagagggttaaaaggacctgaatagacatttctccaaaacaagatatacaaatagacaaagagtgaataaacacacaaaaaatgctcaatgtcattagtcatcagggaaatgcaaataaaatcacaatgagataccatttcattcctactaggatggctatcatcaagaagacagataacaaacaagtattgacaagaaaccagaagccctcttacactgctggtggtcatgtaaaatggtacagctgctttggaaaatggtctggcagttcctcaaaaggttaaacatgtaataaccatacaacctagaaattccacgcttagttccagccacactggaatgctcacattttccaaatgtatacactcaagagaaatgaaaacattaagtctacacaaaaatttgtacacagatatcagtagcaacattattcataatagctaaaaggcaaaaattcaatgtccatcaattgattaatgaataaatgaaatgtggtatatccacacaatgaaatattattcagccataaaaaaagtactgctacatgctacaacatggatgaaccttgaaaacattatgctagttaaaagacgtcagtcacaaaagatcagatattatatgatttcatttataccaaatgtccagaacaggcaaatctatagagacataaagtagatgagtggttgcctagggctggaggtgggctgggggatttgtggagtaatagctaaaaagtacagggtttctttgggggctgaagaaatattctaaaattggttgtagtgatggttgtacaactctgaatatgctgaaacccaataaattgtacactttaagtgggtgaattgtatgatatataaattagatctcaagaaagctgttatcaaaaaaaaaaaagacttccctcctctatgttctatgaaacctgttttttggggttttttttttgttttgttttgtttttttttttggcagagtctcactgtgttgcccaggctgcagtgcagttacacaatcacacctcactgtagccttgacctccaaacttcaaacgatcctcccacctcagcctacagagtagctggggctacaggtgcacaccaccatgcccagctaattgaaaaaaaacaaacttattttgtagagatgggggtcttgttatgtggcccaagctggtctcgaactcccaggctcaagcaatccttccaccacagcctttcaaaatgctgggattacaggcatgagctgtcacacctggtttatgaaacccttcttaagtcccaataacactgaccattgcatacatgtctccattgttccctgcgcagacttgagtaactgtgactgacactcttgcatttatctgctaacatgtctgttttgcatttatctgttgacatgtctactttcctttactaaactgtggccgcctcaaagcatggagttcgctcattttttcttggaatacatagtgtctatacactatgtgcacagtatgtgatatggtacatcataaatatttgttaaaagactatcttaaaggctttcatgtggaaagggaactgtgcttgtttcatgcacatcaatgggcaaaaatggaagacataacaacatgtatttttaagaattttcaaatactcagggttattcctttcttcaaagcagggatttctgggttctgagaattctctgaattgatactgaaattctgagtacaataagagtatgtacctttttctagagagaacatacagttttaggctgagtgcagttgctcaagcctgtaatcccagcactttggaaggctgaggcagaaggatcacttgaacccacgagttcgacaccagcctggacaatacaatgagacccccatctcaaccaaaaacaaaaaaaattttttttaattagccaggcatggtggcatgtgcctgtagtcccagttacttgggaggctgaggtgggaggatcagttgagccctagaagtagaggctgcagtgagctgtgatcatgactctgcactccagcctgggtgacagagtgagacccagggaaagggaaagagaaagggaaagggggccaggaagagaggaaaggagggagggagggacagagggaggaaggagagagaaagaaagaaaatacatagcttttataagattctcaatggtgtatgtaaccccaaaatggttaagattttttgctgcaagtttcagttactggaatgtaccattcaaggtaagttttttcctaggttatactacttcagtagcttctccttgtcaaaaacagaatttacagtattggtagcttaataatcttaaagtatttattgactgcccattatatgccaggtactgaagaaacagtggtaaacaagacaaagtccctacccttgcaaacttacattctagaaggtgaagacaaaaaaacaaacaagtaaacacttaagaatattccatatcatatagtgatgcctatcatgaagaatataaaacatgataaaatagagaatgatgggagaaaagagttattttagttagtgtcatcaggggaagtctctctgaggaggtttcatttgagcagaaatttgaatgatgagaagggcactgagggaaaagcacagcacttcaggaataaagagaactgaaggtacaaagatcctaacatgagaacactgaataccaacacttgagttctcaagggaacaacccatgtctaatctccactctacattttctacaacgttcagaagagtgtctcccactcacagtcaatagtacttgttcaagataattcaccataatggaaagtaaaaaaaaaaaaaaaaaagttttcgaagaatcttcactgttcaggatcatcatgaattgactcttcttcaaagtagacaatatcattagacaaagcaggtaaaaatctttgggattattgcaataagacagaaaggaaaaaaaaagaacaaatacgcaaagatgttttagaagtccgtcccaagtggatagtcttacaagcataaagattatcaggcaaattctgtaaacagaattatgtgttcaacctgccctccacccctaaagcttggtgctttgcatttatagtgtgtatgatgctcaagagaatggaactacagtcaatgtgcataaagcagacggaagtggattacagttcaaaaggagctgtccagcaatcaacagtttaaacattactggaagtgttcagacaccgtaaaatcatgtctcaaagatattacaaggataatttacaggagaaagttaccagtagaacttcatgacctatagaaaactgttctggttccttctcccagccttcagcaccgtgcctttacactcattctgtaaaaggccccagtgcagctaagaggatgaatttttaaacaccacatacatcatgccaacaacgaagaattaacagataaatactgtttcaataaggggaacgtaataatttgttcataaccacctcagtaactgaaactggggttattaaaatcttcaagatatatttttaaaggcacaagaagagcctgaagcagtgagcgcccagcaccaagttgaaaaaacataacgacttaaggtttgctgtaccaattccatttgccttgatttcgtaccaagcggcgcgtcagaaagtacacggaaaacctaaagagggaaacccaactgggaacccttgactcaaagcacgtgaacaaatggtgacgagatgagttaagccagcggggtaagagagaagggactgcgcctaaacgggagtacgcaaggccacctagaggatgcacagacctgcatgcatacgttcctgacccttccagcagcagaaccatctgggccgccacccgctgataacaacggaaccgtgggcattggcccttcaacgccgtctcgcccgccctctccagtcagtttggtggatatttcggtgaaggctgcagactctcagagtcacccctccctcaagcagcgttctccgtactcttcggcgccgggaagctcagagggagctggcctgctcttaccttcaggtgtcggcggcggctcctgccgcttcccgcgggacaggaaggccttgggcagcagcagcgacagagccaggacaagcccagaagccagagcgactctctgcactgtggagtacgccatgactgctcacggtggtcgcaggtgcagacgccagccggaaccggaaccggaaccggagcacgggctgccgctcccgaccgaaccgcgggcggcgcggacggcgtcgcgcgagggacaaggtgcgcgaggcgcacgcatcttcacctccactgtcgggagttgacctgctcctcccgcgtggttacccgtcgctgtaaatggtaccctcgccttcccgttcatactaactaaaaactcctccctcactccccatgttcatcttttactgagtcctgtgcattctaccgcctacacatccggcggtcgtgcccggatctctatccccacttaccaccactgccccccacccacccgtagatcacaacatccagtttctcctcatctccatgatctcgctgtcttccagcttccactcatgcccctcgcattcattatccgtctgcagccacaggtgataatgctaaaacacaagactaattctctttctctccagcttaaaccttttaactctccattatcttcagaacaatagttaaactcctttctataacctcaacgccctgcatgatctggtcttaccaatgctccttccaaactggatgatttgctatttctttagcatattgcttgtcttcagggaagctttgcttgtcctgttcccactgcctggaaaattcctgacaccatctccagttgtcaaaaacttctctgaagaacagcttaaaaacactgctctctcgaaacgttttcagtcagcctctcctttctctacaatcccaccgttctttgttactctcttcattcgttcatttaacattattttagtttttactatgtattagaccctcaacttggcactacagggtctgatgaataaaatggattccctttgtaggacagataattatccaaacaaaaaaaatgcaggaaatattctggatccccgagcagtcttctcaactggtacgaggaaaagtcaagaaaagcccctttgagaaggtgaaattgagttagctgttgaaaaatgagtaacttataggcagacaggtgggaggggttagaaaggtattccggaaaaaggaggccaaaaaaataaaggcaaatctggaagcttcctggtgtgttcagaaagctattggtaattcattttggcagggccatagagtagtgacaggacacgaagtgcacaaatataagcaggagctacattgtgaaaagcttaggtagaacttccagttaaacatgacagatgtaacatatgcatttatctttgctttcctgggacagtgcccaaaaaggaaaataaagaaataaagtatataaactacaagactaaatgcaatgatagaaaacatgacagcagatgagaaatgtcaattttgtaagacgcacacaacactgtccaatagacacataataccagccacatatgtaatttaaatttttccagtagccacatttaaaaagtaaaaataagtaaaatttattttaataatattttaaaccaagatagcaaaaatatttcaaattttatcagcacgatagtgtggctcgttggcgcccacagtagacagtgcaggtgtagagcataaaaagttaaatgcctgtggactgaaagcctgtaaggagtgaactaatttgcccctcagaacccatgctcttaagaattggaggtactgggttcctttaaagccaagggtgcagagtgggtctgaatgaaggattggctggaaatctgattaaaaagcagttgagactgggcacagtggctcacacctataatcccagggctttgggaggccaaggctggaggatggcttgaggccaagagttcaaggccagcctgggcaacatagggagagccctaatctctaccaaaaaaatgtaaaaaattaaccaggcatggtggtgtgcacctgtagtcccaactactcaggaagctgaggtgggaagatcacttgagcccaagagtttgaggctgcagtgagctatgattgtgtgaaaccacaattaattatgatatataagatgataataatgcctgaatgaagccagtaggggcacccactccagccagggtgacagagtgagaccctgtctctaaaaaaaaattgtttgatttttttaaagcaatggatatcttctgaatctctttccttgattcatgcagccagatgggtgccactgctggcttcactcgggcattattatcattgatgttattaacatcactaaaagttagagtactaattatgttttaggcatcttacatatcataattattcctcccaataacttcaagaggtaagcaatattattatatacccatttcacaggtaagaaaatggagccccagaaaacataatttacttgccaacaattacacagtataaactggatgctatgatttgaacacaggcatgcttactcaagaatttgccctcttagctaccaggtttactgtctggggaggtttagtcagaaaacctctggactcctggactatagatgcagcttagggaggaggtgactaatgggatgtggtctctaagaaatacagaggggtctggaatgaccacactcccccccgccctccgccaccaaattctagcttgggtaaatggtagacattaattctatataacatgattttaagaatagaagaatcaggtttgtgagaaagatgaagagttcagattttgactagctgaatttgaagttccatgaaatatccaagtagaaatatccagttggatatatgggcctggagctcagaagagatgtttgggctagaaacaataggaaatcatcagcccatctatagtaaatgaagtctaggagaagatggcattagtgagagtgctcatgtgaagttgtaagaagccacaatggaaacctaggtcacaacattatgttgaagttcccatgtatgaggacagaaatgaggtgggaaatagtgatccaagtgttaaaatctttaatgaatgtggagttactacaaggttggaaggtgacaggaacagaagaagtaatgggcagccagatgacatgctcttctaaggagctgtgtttttttttaattgtttaaaaatttttatttatttatttatttatttatttatttttgagatggagtcttgctctgttgcccaggctggagtgcagtggtgcaatctcggctcactacaagctccgcctcctggcttcacgccattctcctgcctcagcctcccaagtagcagggaccacaggtgcccgccaccacgcccggctaatttttttgttgtatttttagtagagatggggtttcactatgttagccaggatggtctcgatccttgttatgcacccacctcagcctcccaaagtgctgggattacaggcatgagccacagcgcctggccaggagctatggtttttaaaggaagaagaggaagaagcaatttggaagcagcaaggggaaacaagttgggcatctattctattcccaggctttaagctgtgggaagaaaaatagctcttactttgggagatctgcaagggaaacagaacccagaggcaacagcctagttttcattagaggaagacaggccgggcgcagtggcttatgtctgtaatcccagcactttgggaggccaaggggggcggatcacgaggtcaagaaatcaagaccatcctggccaacatgctgaaacccacctctactaaaaatacaaaaattagctgggcgtgatgacatgcgcctgtaatcccagctacttgggaggctgaggcaggagaatcgcttgaacccaggaggcagaggtcgcagtgagctgagatcgcgccactgcactccagcctggtgacagagtgagactccatctcaaaataaaaaaaaaagaaaaaagaagaagaaagttaagagaaacttcaaagaagtcaaggatataggagtttttctgatgatagctcttgactctatacagcacggtaagtggaagctttggaagtcagaaatggagtcaaagtaaaatatgaagtgagcaggatggagatgaggggcagtgtgcaaattgatgaccttgggggcttggaatttagatggtggccaaggtaaatgggcagagatcgtgatctcattagtcctagaagtggcctagagaaaggtgaaaacacagttatagtacagagtatttggcttggaacatattcattgttgcagtcagttgggatgtgcacctggaagacatggaagcctccttaaggcgacagagctggtaggcagctcatggagctggggcagcttggagtgggacctgggatggctgctctctctggtggctggtggtataacatcagagctgggagtgcactaaaattgaagatcttaagggtttaggttttccaataaagtattggtagggggctgggcgtggtggcttaggcctataatcctagcactttgggaggcctaggtgggtggatcacctgaggtcaggagttcgagaccagcctggccaacgtgttgaaaccccatctctactaaaaatacaaaaattagccaggcatggtggtgcatgccagtaatcccagccatccaggaggctgaggcaggagaacggcttgaacccaggaggcagaggttgcagtgagtcgagattatgccactgcactccagccttgatgacagagcgagagtctgcttcaaaaaaaaaaaaaaaaaagtaacgatagggaattcagataaaaaatcaaaagtctaatggctataggctgaagaaggagcaaatgacaaggaagtagagatggcaagtacagcccactgtatatggagctggcatgaaaagaagggataaaagttacagtgataacttgagggtgacttttctaagggaagagaaaagcatgtttacatatttagaggaaaaatgtcagaaaagaagtgatggaaaatagcagagcaagggagaccaatgtaggagcaaagcccagattgtggagcagacatgggagccagacattgagtcccctggcagtagggatcagctcagagaaaagaagatggagtgggttcaggtgcatatattaataaaaggagtggtgcagggacagaaagtcaagggggttcatttctcattgccttcgttttcttggtaaaggatatgtttgggccattatctgagaaaggactcagggtgcagtgggaggaatttttgagtgtagtgaaggtttggaaatgggcaaagaggtattcaggaatcactccagctttgcacaggggctccctttggagtttaaatgcaaccaaggattttctgctgtaaatgcaaccaaggattttctgctctgtccctgggaacttaaaagtattttctaaccagtacattctgggctgaacttggcatccccaaagcatcctttgagactggtagcctccaaggggcccattctagaagactgaaggtggtcaggggacgggagaccgagaggcccttagggattagttgtcagttgtctcaattctctttttattagattaaagggaaaactggggtctacaaaggggtaaagatttgctatggatcaccctgatcattcatgtctgcactgggattgaaacccagttctcccaactcccagagcaggattctctacactacttctgctgtgtctgccagttcttttggacagcaaagaggaaatagtcttcaaaaacaatagctaaacccttcatttgctgaactttagaaatctgtttattccttgggtctttttcctatctgacagcctgtgggaaagtgccccagaatgtttaacattatgagttggaaggcttcgttcatgaaatcactcctaaagtcaaaatttctttaacatcagggcacttgttgaattctaacatgggggaatggaaattgaggaaactgtgtttctttttttttttttttagacagagtctcgctctatcgccaggctggagtgcagcggtgcgatgtgatctcagctcactgcaacctccgactccctggttcaagcaattctcctgcctcagtctccctagtagctgggattacaggcacatgccaccatgcccagctaatttttgtatttttagtagagatggggtttcaccatgttagccaggatggtctcgatctcctgacctcgtgatccgcccgcctcagcctcccaaagtgctgggattacagacgtgagccactgcacctggccaggaaactatatttctagggcatttacttgtaagtcattgtggaaaagcttctcccgggattaagttgacagccgtttatttcctaaatataaggtctccctggaagacaggcccatgaagagctgaagaaagaagtgggaggacagaggagaactcacacaaggtatttggaggaggaagaattcagattggaaaataaaaataaggtgggagagaagctggggaggggtgggaagaaaatagaggaaagaggaagaagaccaagaaggaagaaaacggacatgaagtggttgccttcttatgaactccctgcaagggaaacagagcccagaggcaatagcctagttttcaagagactccatggtctcctaagtcttatccagtgtgctttaccctccagaccaggctggaatctgagcttgggatcctctcctgctcaaaagccttccatgactccctttggctgccatatttagtctcagctcattggccactctttcaaggaccttcatccttgaagcataattcatttctcttgcccaaaatcatcccctcctctctaggccagcatgagctctgtgtattcctcccttaagatgctcctttacccaattttcttccctccttgcctttcatagccaatcttccctaaaatataaggcccaaacactatgaacttttttcaggaggctctcccagattccaccccatgctgactcttcctttcactagattcctgtggacactgtttctcatgggtttactgggccttttcacctagttgggagtcccgggaggatagggtgctcctcccatggcatgactgagcacagaacttgttcacagcagatacttattcaagtatgaggctgctagtttctcaaacacattgattctgccactgctctgagcaactagacctctctccaggaatcagcaatgagttgccttgaagaaacaccccagagagtctcatttcaaaaagtcactgactttgccaccaaatttgtccctgaagtgactgtaatgattaattgtgtgttaatttggctgggtgatggtgcctagatatgtggtcatacttaattctggatgtttctgtgagggtgtttttggatgagatgaacatttgaatcggcagactttgagtaaagcagattgctcttcataatgtgagtgggccttatccaatcagttgaaggcctgaatagaataaaaaaccagttcgccctggcaagaagcaattctgtagccaaccgaactttggatttgaactgcagcatctgtccttccggggtctccagcctgttggcccaccttgcagagtctggatttgccaccttctaaaatcacatgagccaactgcctaaagtaaatctctctctctctccctctctccactgtggagtccccattgtggagagtcatacaccttaccacaggcaggaaatcaaggtggttagcaggaaaatgagacccaggtgcccaaaacactgagcagaagggagcaaggcctgtaactccaaagtttagaatgaagaggttagagaaggaaagcaggagatgggacagaatgcacagaacagcatatgggacctggactttgaacgatgggtagaattttgatcagggttaagggaaatatgatgaacacctgccaatagtagacatccacaatctttgaataccctttcttcatttgacattatccacattgagagtctcaggttctcaatgtagaatccaacaaactacatttcctggcctctcttgctactaggcaaatagttaactgtttccccgatcagacatacccgtgtccaactttggtttgaaagttatctgtgagaggaaacagcagtgcttgcttggcctacctcttttggtgggtgaggcggcagcagaggtgggacgttcctgtggctggtagcggccacaacgcagtttcctgacaggcagagcagaggccatgcaggtctgggatctgtggcactggagcttccttacgaggccagttctgtggtgtggttctgggagttattccaagctctggggccctagttttctcatctgtgaaatggagactgttctgcctccctcccactgagctagcaaatgtgatggaggctggaaggcaatcacgtgtgagacaaaaacagcaacagctgctgccgctcaaaggcaagtctgaagaaagaaaattggaatcagaaaagggaagagtttttgaggaaaacctttgggaggaagcctctagaaggcccatatttcttatcctaaagctctacccaaatggggacaggtgggcaaaggttaggggtacgaggatagaagtttcttggtggtgagtggtcaaggtgagaatgtccttactgctttcctgccaactctcctcactggcctctgcccctgaaagacgcagagcagagagaagtcacagtcggttaccttgggcatttctgccttgaataaggagaaatagtctttggtgccaattaattaagcaaactgatagaaattccctgcttaagtcacactttgcatatccacaatctctgcactacattttctgtatactttacccctgggtaaaaattggtgagtatttaaatgcttcctcacataatcttgctaaagcacactcttgcctataaatattcatgccactgccaaaacatttgcaagctttccccaaaggtgaaatgtgtgtaatgtactttgtcttctgggtataaatattatccaatacattttggttaatatgaatacactaattattcctgcaacccttttaaaaagggtcatcttcatgatgtgaattttttaaaaatgtaattacaataattggatacttaatctaattaaaatttgctttatctttaatgggaatttgtctaaagaggcagaatgacaattggctttttgataatgactgttttctttcttcaggggatcaagctggtgaaaactggagaaccaggcaggtttgtgtctgccagttccctgcttactgggcagagcaaggccagtctctcttcttcttacaattcactacttaagtagcaaacatgggttgtggttactggaaaaggactaggggaaccttttgtattccaacagatgaagctgctcctcttcctaggaagcagtcctttgttcccctggacctgtgactgatccacagcaggcatgtgatctaagcctgatagatcaggtccctcgctgggcttgctgcagctggagaagaagcagctccatgctgctttggggggggcatggtgctggaaggagttgtagtggatggtataggtgctccactcatatcccattggttcacccttgaggtcatcttcagacagtccctgcacacaaactgagctcctatgtctctctgcataaagctgcttctctggcctggggagcaagctagggagagttaccactcccagagcaactcttaaacaatgaaggagaggagctggcagataaacacctcagcttccttgttcttcaggggctcaattctgagtggtgctccacacattctttttgaggcatcccagtaggattgagatctacttgctccagctgtaacccactcaccgagacacccgtttggggtttccgccccttctttgtctcacttacctgctctctcattttgcttctggtgtcatcttccaaataaagtggtacacccaaacttttgccttggagtttgctttgaggggagcccaaactaagatagaggaaaagttggggttcccaggcaactattttctctaccacatggagtaggtctgtttgaagaaggtgagagagaagctagcaaaaataaggggggtggagagcgagcttggtggtgccgaatggtttcacccccaagactccttttgttccctctcattctttgattctcgaagctgccctgaactcttcccagccatgtgaaccaatacattcctccctgtatgtgttaagcttgcttgaattggatttctgtctcttgcaactgaaagtattaatgactcttacaaagaataagtgagttcgcatgcaaagcattttgaatagagcctgtcacagattaaatactattactggtgcatattattattatttaatgtctgactcgcttccagtggagaccatggatcaagaagctagagcctagaaaagaatcacaaaaaagtcagtttaattctacctaattcctctcttttgtgtttttcataacttgattatgttgatggctaccttctttgccactgggagatactttatacaataattatagctttaatatcttcttactcatcattaacaatgggcaattaagtattattctgttgtgcttaaaagtcatgttggtttggccacaactttgttaccaagatctgagagacaaaccacccagcatgaatgacccagtcaggttcaagacatggcaggctctgcctggcttcagggactcactaagactgccatggtccttaggcatttttatcttcatggactcccattaatggggattaatgtttatattatatgaccacattggcataaagataaatatgttagtattatatattaagacatgttctttgacctaaaaatctatttttttcctcctgattttaagagaaattaaaacatgttagtgctcactgtgcctgatggttaaataggccctacctcgctaagttcacaaactgctgcttggttagcaacttacaccccaggaacctgggtgtgcggtaaacaagtaatgtggctcctggtttatatttttcataacacataatagttttaaactgtatcaagtatcataggagcaaaatgttgacatgtttagaaaagctgctgggagatgtttctactttctagggcctgtggaagacttcatcttggcagagggaaaaggcttccaagaatcttccagttatgcaaaggcaaggcccagcggtacatctggacagagtagggattgagacaaggatgaaggggcttttccgaataaagttgtgttttcctttgatgaaaagttgttgtgtggtaaaatttgggacttcctctggtggcccagagatgggaatttgacagcctggggactgaagaagagaggacagggtttaaagacctaggatttttggaggagctgggcctaatggagagtcagccatgaaagaactccctagggtgggagatggcaggtgggccatggtttcagtaagatgctattcaggttttcctcctgcactgtaatcctcttatggtttcctcaagcctttagaaaagtctgggacacaccatgggctgtgtcagtggtcctagggtttaaggaagggcactcttccctgtttggagcaagggacttcccccttataaggctagggcagaggcagcagcagtgaatgaatgataatgctgattccgactcccagtaactagaaacagcgtgaatggggggcgctgtggtgccaccaggtgcaagcagaggagcaggctgcagtgtgtccaggtcaaaaatgcgcttgagacaaaggctgtttctccctagtacactggaagacattgatccttgaatggaaggaggcagggagaggaattagatcctgtttttacatggttaatggtccccaagaagctgaagtttataatttcctcacctctctgagcccatctcttattatagtctctttgctcccagctccagccacattgggctccccattctcactcaaacatgcctgggaagcacccaccctgagcctttgcacttgtgccctccatctgggatgctcttacaccaagtatgtacatggctcaatctctcacttccttcaagtctttgctcaaatatcgcctttctcaatgaggctttccatgaccaatgtatttaaaatacaacactcctgatcttcctgccctgctttatattcttccttgcacttaccaccttctaaagcttatccccttccttgcttgcctgtccctcccctctggagtagaggctgcattagggcaggcagttttgtctacttgcccacttctgcatctgcagtgcccagagcagagcctattatatggtagacttcagcaaatatttattgggtgcatgaatgaagataacagcatctgggttatacaaagtgctttgaataacctctctaactgaatgtaagcttatagatatgttatatagcaactgaaaagcgtaattgggtaaataaggtggggacaggtttgcattgagtgactgatcattcacagtctcgtttggcttagatggtgtttatcaagcagtaggtggctggttttaaaatggtgttttgtagaaacctaggtgctgtagggtgtctttcaatgtttgttcttaattttgttttcaaatatatttttaaatatttttgagagtaaaacgcatgcttgaatgcattgtatattaaatttgaatatattggcaattcctgaggcacattactgtcaggttaactcactttaaaaaaaatacagcttgggaataaagatcattctgccatttctatgaatgtatttggatttcttctaagtgtgtccataaaatgttattttaagtttcactcgtgacactttatttctcacaatggatgtaagcagttaattttgtgattttttgttggaaaaaataatgattttctactgttctctttcaagcttctgaaacgagttaattgaagatcatcttgagggtgcaaggtgaactgaaaatacattgttgttttctctatgtttctctgagtgtctggattttctttttattttattattgttttttatcttattttagattcaggggtatgtgtgcaggtttgttatataggcaaactgtgtgtcacaggggtttagtgtacagattattttgtgccccaggtaataagcatagtgcccgataggtttcttttctgatcctctccctcctcccacccttcacccacaagtaggcctcaatgtctgttgttttcctctttgcgctcatgtgttctcgttgtttaattcccagctgtaagtgagagcatatggtatttgcttttctgttcctgtgttagtttgcttaggataatgtcctccagctccattcatgttgttgcaaaggaactgatctcattcttttttatggctgcacaatattccaccatgtatatgtaccacattttctttatccaggctacccctgatgggcatttaggttaattccatgactttgctattgtaaatagtgctgtcgtgaacatacgcatgcgtgtgtctttatggtagaatgatttagattcctttgggtatatacccagtaatggaattgctaagtcaaatgctaattctgtttaagttctttgaggaattgccacactgctttccataatggctgaactaatttacactccaccagcagtataaaagtattcccttttctccacaacctcaccaacatctgttattttttggctttttagtaatagccattctgactgatgtgagatggtatctcattgttgttttgatttgcatttctctagtgattagcgatgctgagctttttttcatatgcttgtcagctgcatgtatgtcttcttttgaaaaatacctgttcgtgttctttgcccactttttaataggggtagtttggtctttgtttgtaaaattgtttaagttccaaatagattctggatattagacctttgtttgatgcatactttgcaattattttctcccattctatagattgtccgttgactctgttgataatttcttttgccagcagaagctctttactttaattaggtcccatttaccaatttttgtttttgttgctattgtttttggcatctttgtcatgaaatcattgccaggtcctatgtccaaaatgatatttcataggttactttccagggtttttatcgttttaggttttacattaaaggctttaatccatcttgagttaatttttgtatatggtataaggaaggggtccagtttcaatcttctgcatagttatccagatggttttcctagcactatttattgactagagagttctttccccattgcttgtttatgttggctttgttgaagatcagatgattctaggtgtgcgtcattatttctgggctctgcattccgttccaatggtctatgtaggattttctcaatactacatgatcaaaacaaaaggcaaagataagatgggtgccaaactaatacgtagcagaaactctcctcaatagccttgttttcaatatttcttcgaagtggtaatgtgttatacttttgtatttgttgtactttgggtggtcttgctttatttttgttttttgttttcctatgaaactgatgcagctatgtaaatgagctcgtgtcaccataaggatataatctcatgtcttcctaaagtcatggcacctgtagatccaagtgttgttctgtacctgctcctctgatctactttctgggttaatgtaactttatatcaagaagattttgaatgtggaaagctaattttacacagggtgtggggaggcagtgaagtttttaattgacaagctgtcaaattcacttttttctatgagtttttacatttacatagattcttgtaaccaaagcagaaaaattccaatgttccaaagaatcccacctcctgcccctttattaagacccatcctcatcacatacccctggcaaccactgatctgttttctgttcctatatttttgccttttccagaatatcttataaatgtgattatatggtatgtaatcttttgagactgggttctttcacttagcatgatgcatttgagattcatccaagttgttatgtgtatcaatagtgcatagctttttattgctgagtggtatctagtgtatgtatacagcacagtttatctactcacgtactggaggacaattgggttgtttccagtttttggtaatcacgagatattgctataaacatttgagtacagatttttatgttaacataagtttttatttctctaaatacaaaaaaaatgaaatggttgggacataggtgaacatatgttttgctttttagggaagcgcttatgttttccagagtggctgtataattttgcatttctaccaggaccatctgagagttccagttgctccacattctcatcagcacttaatattgtcagttttgttttagttattttagccatgttagtgtatacgctggtgtgtcattgtgtttttattttttacttacctaatgactaaagatgttgagcatcttttcatatggttatttgttatcagtatacctttggtgaagtgtctatttaaaccctttgccatttaaaaaaattgagtcgttttcttattgttgagttttgagggttagatatgtgatttacaaatattttctgctagtctgtggccgatgttatgttttgttgttgttgttttgagacagggtctggctctgtcgccccagctgtagtacagtggtgcgacctcagctcactgcaacctctgcctcctgggttcaagccatcctcctccatcagcctcccaagtagctaggactacaggtgcatgccaccatacccagctaatttttgtatttttttgtagagatggggtttcaccatgttgctcaggctggtcttcaactcctgagctcaagtgatctgcccacctcggctgcccaaagtgctgggattacaagcatgagccaccatgcccagccaatgttttcatttccttaaccatattcttcacagaaaaaatttttaattttgctggagtttaatttatcaatactttattttatggattgtacttctagtgtcacatctggaaccctttggctaacccaaggtcaaaatatattcctatccctgcttctatgagttttatagttttacattttacctttaggtctattacccatttaaagttaatttttatataaattgcttttaattcttgacttttcaaaacgattggttgttttaattatttgactttctttttgaatgaaaatgacattatcaaactaacacatgtttcttatacaagatacaaagatgaaagctaatattcactctcaaacatcaccatgcagaaacgactatctctaactcttgatgaacatcatttcggaaacccctctgatatacacattcatacatgcatgcagatacagctaggaaaaaaaggtaagtatgtgaaagacaggtaggtagcttttattttattgggaatattgtcttcttaagaaacacccagctgggcgcggtggctcactcctgtaatcccagcacttcgggaggccgaggtgggcggatcatgaggtcaggagatcaagaccatcctgtccaacatggtgaaatcctgtccaacatggtgaaaccctgtctctactaaaatacaaaaactagctgggcgtggtggtgcggtgattgcagtgagctgagattgtgccactgcactccagcttggcgacagagcgagactccctctcaaaaaaaaaaaaagaaaagaaaaggaaaaaagaaaaagaaacacccattatatatattgggtttccttatctaccaacttcctcatgataatgtctatttttaaaaattttttattccattttgtcttatgtgatttccttaattctgaccgtaaggactctggctgtattttcactcatttttaaatgttatttgctgtttctgatgtgaagtggatctctgtaatcttctctctctctctcttttgcttttgcttattttcttgacttttgccagattattatttcattttttataagctcttctccatacctttgtgtctgttctctaaatttttcttcagaaagagagatcatgtcatctataatttaatgaaagctgtgggaaattatttgtccgagtccttccgttgtttgcgcgggtaattcctcttgaactttgttcttcatctgctttttctttatgttcctcttcttatgttctccagccctgaccctttgctaaggtcctgtgtaatttccaggggattggttctcatctttaaatggagtgggttatttgttgaagaaaagtgtggggagaggagatagaagagtgagttaagatagttcacagcttcaactgaagccagtagtggcaaacggcccctcagcaaatctgttattttacctgcccagtgtgcctgtcttccatttgtcctcagtttcaagagatttataaggctcatagcagggatcctaaagtcacaggttctctgtattataatcttatgaccctcatttaagccccttctccataaccatttcccctccaggtcagagtccggataatagtaataatggtggtgctgctgcttctccatcccctgcccccacaaaaaagactagttgatgagtcagcaccatttattgaacaaccaggctttcaaatgttgattcaaaatgctacccttatagtaaattcacatctatgttttgatttctctctggactctccattctgtgccaattatcagtctaccatgtcagtagtgtactgttttatttactatagcttaataatatgtttcgttatcaggtggagctaactcattatcattcctcttatctagaattttactgcctatacgtacaaatatcttttccagattaacattataatcactttctaagccattggtaggattggtatcacaattaatgtatacatctatttattgataattaccatctttataaaattaagtttattttgtttatagccaaacattagttgtatcttcatttattttagtcttttcactcctcagtagaggtttataggttctaaacactttttctcaaatgcatttctgggcatttctgcttttaccactactgtaaatgtgaacttttttcctatactatatttaacccattttttatataagaaaaatctgtttttatatttcagttttctaattgtcatttaccatgtgttgtttccgttaaattgtttggattttttcatatcaattacaaataattgtaattttacctcctcttcccaatttcacgtcttgtatttatttcttctggctgtttatattggtcaataactgcgcaacagtgttaaataatactggtgttacagtataccctgattttattcctgatgttgatagaaatgattctgaagttttaacattaagcataatgctgacttttagtctgaggacatctaagtgtattaacatggtaattagattaacattttcctaattttaaatcactcttgcatttctggtatgaattttacttggtattgccaaaaatatgctactacgttctacttgctaatattttatttaagattcttgctttcctattcaaaagtgaaattagaccggtgcggttgttcatgcctataatcccagcactttgggaggccaaggtggtggatcgctcaaggccaggtgttcaagaccagcctgggcaacatggtgaaaccccatctttaccaaaaatacaaaaattagccagtctcctaacccggtctcaaaagaaataaataaataaatatataaaaaatttatttaaaaaaatgaaattaatctgtagtagttttcatgtcttgtcaagttttacgatcaatgttcatgtatctgcatgtatatatttactatatatacatatataaatgtatccattaaaatttatatgatatacatcttgattttttcatgtaacatgttttaaagatattcttatgacagcatatgtttttaagcatggatagatcatactttttatttacgtatttttttcttcaacttttattttacgttccagggtacttgtacaggatgtgcaggtttgttacacaggtaaatatgtgccatggtggtttgctgcacagatcaacccatcacctaggtattaagtccagcatccattatctattcttcctgatgctctgcccctcacccccaccgtcccccgacaagccccagtgtgtgttgttccctgcgatgtgtccatgtgttctcatcaacatttgtttaacttgttttgttacaaagactcctgagattttctttcctttttatgcactggactagttcaacttcagaattatttgttcctcagaggtctggaagaggttacatgagaaactatttgtatatgtgtgcatatgcatgtatatataagtactatttcttttacaactttctcaatatcttccatgattattaacatgtctttagtcaattttgataacatttttctagaaataatttcacacaactttaaaaatacattagcatggagttatggaaaatttttaaataataatattttaactttctacatatttgtggttatttccctgttttgtgtatttgtgcttctttttgatgaattaactacaggttaagcatctctaatctgaaaatctgaagtctgaaatgttccaaaatccacaccttttctaacactgacctgacgccatgtcaggaggccaaaagcctgtcgttgcgcgttgttgctgtttttaacagctgatccgggtattctgggaatgctactgtgctgcttagttaccttgaacacattattttttcactgtattaagggtatatcatattttttactgttaagtacttctgtgtgaataaatagaagaaaatgcttattggtagcatataaattcaaagtcaggaaagatggtgatgccaaacaaccacaaattgtccacatggtggctgagacagtgacaccttcgctttctgacggctcagtgtacacaaacttgttttatacacaaaattatttaaaatattgtgtaaaactacttccaggctatgtgtgtaaggtctatatgaaacataaatgaatttcatgtttagacttgggtcacatcccaaagagatctcattatgtatatgcacatattccaaaatctgaaaaagtctgaagtccaaaacacctctggtcccaagcatttcatataagggatacttaacatatagtaatttatctactttattttagccttttcatcaattgggtagttaataaattgttcttaatgaattaaattatatttttattattaatttcttcttactacttttcttgggatgattttgtattttttcttgtttagttggatgcatgaatcaatttaattattgtaattgtttcttgtctaatgtttaatgtgtagctaagctagggagcactggatacacacatgctactctctgtcatatcacagggtcccttgaaatttggtttcggccatgtgagttgctctggcccatttgttgtgagcagaagtgatgtgtgttttgtctgaactgagagggttaagagccagtatgttttctccctcctctttcgtccatttttaccaccgccttataggccatgaattccagatggcatagctactccatcagcctacattcttaatgactgttggaaacaggcatggacactgaacaagaaataacctttaatatgttaagccactgtgatttcagagtttgcctttggtgccagctattagttacttatcttgtctaacaatgtgtttgagactatgactcttcctctgagtagagctttagacatatccaaaagttttgatatgcaattgaaatagtttggggttttgttccctccatatatatacatatatatatatatatatacacacacacataaacagtcccccaaatatatatatatttgtgtatatatacacattgtgtatatatatagtgtatatatacattgtgtatatatagtgtatatacatgtatactatatatgtatatattgtatatatacattgtgcatattgtatatatacattgtgcgtgtattgtatatatacattgtgcatgtattgtatatatacattgtgcgtgtattgtatatatacattgtgtgtgtattgtatatatacattgtgtgtgtattgtatatatacattgtgtatatatatagtgtatatatatgtatgtatatatatagtgtgtgtatatatatattatatatatatatattattccccccccacacctgcttcctgagctggcaaatagggctgggctggggcacaagctgcctgaaaccatctgaagggagtaagtggaatccaagctaatctataggaaagcctcaagccaagaaccagagagatggattgcaaatgccaagaccaaaggggaagaaggagctttgtgaagggtgtgcgtgtgtgtgtgtgtgtgtggtgtgtgtgtttgtgtgtgtgtgtgtgtgtgtgtgttccttttgttcattctcacagctgcaagatacatctgcttaggccagcttttgaaatctcagtctggccagaactccaggccctcccaccctacttaagtcagtctataaatgcaaactgcaactatctgccaggcccctcctaggcctgctgcatttattcctgacttgcttcttctcaagtgccgtgccccattaggttaccaattcttggctccatctcttcttcacaaatctgtttcttctcctttggtcttggtgtttgcaatctgtctctctgttttttggcttgaggctttcctatagactatcttagatactgcttactcccttcagatggtttcaggcagctggttccccaacccagccctacttgccagctcaggaaggggctgcgaggaaaatgccatccttgggtttccctgcagagctccaccctctctcattcctcctctgtctcacgcttcctctgccgaaggtcagatgcacatgctgcactgagtgggtgccctgcggcctaggtggcctcagctttcagcttggcatatgggaattttggagcttgttgggaggccccagggaggatggagacatagtgctgccaccactgccgttttcagagcctcagaacaatctgtatccttgggccttttccataagagggagtgtgggaatacatatgatttataatgtaaacaatatataccgacaggatgtgaatgaataaaagatgagtaaataaaagcacaagaataaataagcatcctgccttggccttgctctgcgcagcaagggatatggtggaagcatcatggcaggacagggcagctagtggctgctgcctcagccttcctcctcactggaagcagccactctgcccaccctctgtaccctaaccttgaagccctcctgacttcagcagattctacattaggagctgacctcttcacactggggcagtttggtgcacagaaaaagcacagaacagatactaactagcattttaacttcacacagatcagtatccctccctcctgctatcctccaggccctggtttcccaatctgtaagtgaagggattagactagatgtcctctaagtccttcaggaatgtcctttcatagtccatcttatcagaagggtcagtgtgatgcaccctatttctgagcctcagttttctcatccataaagtggaggttctgatgggaggtctcaaagggcttgatatggtttggctgtgtccccacccaaatcttaccttgaattgtaataatccccatgtgtcaagggcagggccaggtggagatgattgaatcatgtgggtggttcccccatactgttctcatggtagtgaataaatctcatgagatccaatggttttataaatgggagttccccagcacaatctctccttgcctgctgccatgtgagatgtgacttttgtcctcatttgctttccaccatgattgtgaggcctcccaagccatgctgaactgtgagtcaattaaacctcttttctttataaattacccaggctcaggtatgtccttattagcagcgtgagaacgcactaatacagggctcttccacctctgatgctctgctaggtggctctgacttgctaccagagtttgcggcagaggcatgcgcggacacgcgcgcgcacacacacacacacgcacgcaggcacacacactcctccagacttcagggcagcctggaatgggcttggtttctgggcctgcagcccttaggcagattggcggcagcacttccatgtaaccttccctccagacctccaacgggttggaccctgtgccctctctctcctggtccgcgcatgacagaaggcataggtatcatctcctgtcccaagggcccacatgccccaaagccctcctgctgcagccctcaggaactgtgtggtgaacccctgttctgtacctgcacctctgtgcttggaactgaatgtgccctcaggaagcaactgtctaaggtggagaggtggggaagaggaacccgagagagagaaattggtatccacaggggacgtgagagagggcatagggggccagaggaagcagaaggcaggcaagccaagaggaaggctggggcatcctctggaactagcaggagatggttttttctagggacacgacttctggcttgagcctgaacttagtgcagcctctgggttgctcctccatcctgccagcagatggcagtgtgtgtatgggaaccaaggtgaaaactcctgggatcaccagcagacgattctgcaggctagagaataggagggaaatcactgtccttcttgccaaagagctggatgatcagataaagggtcatgtatcctcctgaagaatcacccactaccctcatgagctgctaaggggaggcttatccaggagtgctggggccatggtgtcccttcttcttccagtagtctggtctaccccaccctgcccagtgcttaggctccacgtgggtctaggtaggggtcgggattggccacaggccctcagggcaccctcccactgagaagcctgcccctgtgtagccagctcctgccagcggcgttgccccagctctcaggctgaagcagcttctgggcagctctcccaagtccactgcagtctgtgtccagggtcctgcggcaaggattgggtcatgtgggctctgagcctgttcccagtggcccctacagctcagcctcactgacttagtcctgttctcaaggcaaaaccccatatgtccactacagtgtcctgaagaggggacccagagcagcaaacagcctgggctccaccatccctggtcttgggctggccccctagcctgaaatgagagcttccacagacaccaactagctctgtcctgcctgggattcaggatgcctggtttggactgaatcaccagcactattgcagcagacaggaccccagacgctatggcgaccccggcctgggcagagatgctgtagcatctgctgccttcagcacagtcaccaggcactgctcctcaggaggcctgcagatgccctttcttcttcagcagcctaatagggcctgggctgtggagtcagacatggcttcttgtctccactccactagttaccatctgcgtggctcagagctaatgatttcttctgtgagccccagtttcctcttctgtaaaatgaaagttttaatggtacctccatcataagatggtgggagtgttggccaagccccagtggatggaagctgctctggttttggtggacactgcctgagaaatactctcagtaggggggaaaggaaaggttagtgactggatttaaggcttgactgagctcagactccttattctagagcaggtctcaggccagctgaggccaaatctctgggactacagctgaggaaaaagaacgctttccacctgcactgccaagatgggaaacagaaggctgatcgtggtgggtgtcccatattgataattttctgggggcctctggggtcactggtatcctgtggtatctgggtttgggctctgtcattggctctgagctgagctctgggctccaggctctgggcttgggttgggttggtccaaagagaatgttgaagattatattatttaagggaatcacagtgagttcagcttgttaagtacagggtttggcacacgatcactgatcaaaacagaatgaatgaatgcacactatttttcactgaccgcagttttcctaatagaccctctctgctggctggggcccttttcaaataggaaggagacaggaattaagggttccaattcttacactttctgctttctgctttggtcagcctctgtgactttgggtcctcatttacaaatgagacagggtaatctctatagggtcttccagctctgggatgactgggtcctaaagggagagggttagcaaggcctgagagcagagagattccttcctgaggtgggagagaggacttcatgggtggtggtgactccccagatatgagtatacactgggtgttggaagaatcttgtccagagagagaggcattgtgggctggatcagcagtgacagtaggtctgggtgtttgtgccatagctgcttcctgatggcacattttcctttgctctgcagccccacaccctgctgaccctggcagtcatttcccctaggtttgtcttaccaagacctggggcacaggtggggactgttgagaagaaagttcatagatgggtagtgatgggatttgcctgcctttggatctgtgaggtcatgggtcttgggagataagcttctggttaacttgggggtcattagtatacaaggaacagagcatcactggggtcaacccaagtaagggagacaaataagccaagaatctgagtctttcagaaacccagacgggaccctaaaagtgcagggtctcaagagtctaggtggaagctagttccagatccctggtggctggaggacttcagtgacaggacaggtcctcatactcctcaccgtggtgctgtgtcattaacccaactaagccatgcccagtgtatctgctcctctgccagatatcaccgttcttctcacaaccctctgtattctctctgtgtttccagttcctttttacttacgatttctcaatttcagcttgccataaccttccacagcccttcagcactcacgcccccatactctactgtaagacctttctagatgcatctttgtttaccttctactcctactactaactgactttctccaattttataatccagatttccaaaagcaagaatatgatttgccatcacctggtcaggtaccaagttcttgtccagtgagctgtgttggggtatagcatagtacagtattgctgcctagagagggcaaaagaagacgctttgatggcatgcaaggaggctgcttgcagttgagcaagttgtgccatgcacaagggtaactgactgagggggaaagtaggagctgtatcctatctgcaccacgtggcaagtcatgcatctttatgtggggctgcatcaacccagaagaaaggagaaaggggtgcctttgtcagaagagaagtggccctgtgatgtgtcagatactatgattagcatataatctttttgttacataggacaatgcatttcttatctcttctccatttcaccctgtgtctggtagcttttgctgcataacaaaccaaccctcccttaaattagtggcttaaagtaataaccatctattattgcttatgagtccaggggctggctgggtggttctgctaatttgagtctggtttcgttgctccaggctaagcttctttacgtgtgtgccttcagctggaggctcagctaggggctggatgatctagggtggcatcgctcacacagctgacagctctgcttctggaagttgactggacgtcacttgggggtacaggggtaacagggctacatgtctgtcatcaattagcaagctagcctggacttggtcacaggacagctcaaggttcaaggaaagcaaatggaagcaggtaaagcctcttttggtgtaggtttagaatttgaagtgtctcttctgccatattctttcagccattcacaaaaaccaccccagattcaagggataggaaaaaagactcttgatgggatatgtttcaagtcacattacagaacggaaagtagaagaataacttacagccatttttgcagtctatcacacaccaccaactctgccatgatgctccatctgccggggaagaggtgaccagagagtggacctaagcatagcccaagggagctcatgagaacagaagttcatgggggtactcctaagccttgtatacatatctaatagtcttagatgtggattcaactaggtgtgggttgggagaaagaaaacatggagcttctttttcactaagagcccctatctttgctcttacaatttatataacttgaaattatcatagttgccaatgccttcctgaaacttacgcccctgagaacactttcttagccatcatgggtgtagggatagggataggagggatatgcagatgaaggaatgaggttgagaaactgggaagtccaggttttgggtgggccagagatatccccatagatctctcagctccccttgcctataggcacaaagttgaccttgttcttacccaaactgctttgcctgtgaagccttcttctctagtatttcttatgaccaaagtctcctatttttgagatactcacacttccttatccctgcttctactgttcttgtccttattgtggcagctcctcaagtcttcctttttctagaactccttcagacttctcctggctttagttcctctctatccttccactgatccattacatctacctctgtcttgtcaacacactcagttccattgacctctgttttcctcactgccattgtcagtgatttcctaatctggcatcaatccaagtaccatctttcctgtccctgcacacagggagctgagttgtcctgggccaattacccaaacacaagaaagagaatcctacaaattatggtctcctttcttccaggtcctccatagttcccacccatctctctgtcagtacccagcatatctgtctcctgctttccacagaagctatttcagaatttatttcctctcctctaacctcctgctgcaccaccagccacttcagtcatgataaaaaaaaaaaccctaaggaatagagaccttcatatggaaactcctttcatgcccttctctatcaataacaactttcaacctcttcctgactgctggctctaactctaaatagtcctcaaactgcagcttccccttcctctcctaggtgagccacttcaaagttatgcccataccaatggtctatttaggtttagtttagaggagggcacaaccacatggctgatacgggggcctgggtgccatgtgggggctcccatctaagacaagacaggggcaaggtaactcctaccccattttaggaaaaatttgaagctcatgcacttgaaacacccacaacaaagtccaaaggatagtggcagaatcagtttgagttttggggcaaaagttgagccacatgagatggtatcacaggaaaaagcagatgaagaaagaacaaagaagaatggatctaggagatttctttcagcaaccttggaacattcagatagtcttccttggcctttgagtgccatatgccaaagggataagggaaacactgacttagtgtgtgggaaatggaggccaccagctcccttcataggtagggtgagtccaggttttccctggattttcccggaggaaatgaggatgtttctgagaagagaggaggtaggtaagaccctccttatctacctctctttgggtagccacactgaacactgtaacggtaatagcagtccatggtgataggagtatacaggagacttagtgaagttggagactgcagattccaggctctttccttgaggaacagagagataggtgaatgagtgcaaaagggggagcagctggttcctggagaatggcaagtgatggcctgtctctctcctggacacctgcactgaactctctttggtatggaagttctgacttccctttttggtgtgacagccagactgagggtgagagggaagaagagccagagactgatgggatgtcttccccatccggggtgtcctgcagcacagttcttggcacacagtggggtctcagttaatatttattgaatgaatgataaatgactctggatactctggccatgtttggaaggtaatttttccatttgttgctttcttccatccagatgatgctgttggcacccaggctttatgaagactatgctgtctgagcagaccccaatggccagatgagttctaccttgttaataccacaccagatcaattatggcagagccagagttctcctccaccccatcccaggaggtggtatgccgttatggaaggaattcgggactaagaattaataaggactgatgttctggttccttcatcttcatggacttgttgaataaatttggaaaggtcacctacccttgagacttcagtgccctccagagatgataatctctgcccctatagagttatggcaagattaaatgagctaacaaattggaagaactttgcaaatcataaaacatggtgcataggcataggactgtaatgataatgatacaaagtgtagcatccaagataagataacgtcttaacgaggcaaaatgtgaaagctctttgagagcagaatacatgggtgattcttctctgtagcctcatagggcttagtaaagcatcacatagatgctgagtaagtcattgaatagaactgaatttcattctttggaggtccttagtagtgacccagatctggaggtttcaggtccaatgaaggtaaaggtctccatcacttgccgttctccaggaaccagctgctcctccttttgcactcattcacctatctctctgttcctcaaggagagagcctggaatctgcagtatccaacttcaccaagtctcctgtatactcctatcaccatagactgctattatcattacagtgtgcagagtggctacccagagggaggcagatgcacagcatcagcatctgccaatcaatcactcccttttggaaactctacttgatgcaaaactgaaggcaacaattaggctaaccacatctatttcttgttattgggagttattcataagggcagccataattattgtgcatttttgtgtcatttcataggtttcaatgtcttagttgtctttgaccaaaaattcatgaatacattaaattatattaaattatattccagcccactggttcataccttgagtgggatcatggtgtgtcctctggagtgcccaccagtgcccacataccttttcctccctccaccgctggccattgaggatgcttaacctcagtcccctgggcactgttacaagatgttaaaagaagagaagaagctgtggatttagttagctatgagagggcaggtttgatctgagcccgagagcagacctgggctcaaagagaaaggactccaagtgctcaggaagtgagggatgtgtcacagagactctaatgctagtggacattttacagcctgtttgcagctggactgggtgggagtgggaatccagattcagaagagctctatctctcccacctgacaacagtggctcatggcatgacggttctgctctccatcctctcccttgttctgctcctccaaatgacctcccatcctgggtcaatctcccctttccccctacactcctccggccatgcctgcccctcacccccaatagatcaatctcccctttccccctacactcctccagccatgcctggcccctgcccccaatatttgtctcagggaatgagcctggtgtgaggggtccagactggaagagaatgtgaggagcctcaggccaggaatgtctgtggctcagcagtgtctagtcagcctgttcctgtacaccattctgatattggagcctcaatcctttattcacctatttatttaataaacaataattgagcatacaaaatgtaccaggttcagtttaatcatgttcactaaaacatgtgaagtgcttatgggaactctttgtaaaaggtaaactatcagggctggatgcctatgacatcagagttcttggtcttcaaaagatggcacctggctccacttgcttgctctgtaatttggaggttaagttatttaatttctctgtgcctcattttcctattttgtaatatggaaagcataataacaatagtaagggtatggtaaggattaaatgaggtaatattaggttgaaccatatgaaattgccaccattcagctatttttcaaccacagaaacaccaatgtcatatggtttaacttgccaaagtacttagtactgtggttggtatagaacaaactgctcagtcagtggtacctttgctttgttttatttagatgctacaagcctaacagttctttcaactcaactgtttgtgtaatgctaacatttagataggaagctctttctagcaccaccaggaacattttgactccagattaacatactcagtggataggttttactcaagactacccatggggacaatcatgttagagcaggcagtgattgacaacagttaaacacgagccaaggaactacctaattgtgtttaggagttggcatttctttagctcttatgcaaagcaatgttatccacattatttaaatataaagctaactattaatgctaactcatgttttctccattttttttttttttttttttttctgagacggagtctcgctctgtcgcccaggctggagtgcagtggcgcgatctcggctcactgcaagctccgcctcccgggttcacgccattctcctgcctcagcctcccgagtagctgggactacaggcgcctgccaccacgcccggctaattttttgtatttttagtagaggcggggtttcactgtgttagccaggatggtctcgatctcctgacctcatgatccgcccgcctctgcctcccaaagtgctgggattacaggcgtgagccaccgcgcccggccttctccattgttttaacagggttttatttataggaaatcataatgaagtgggaattgtctctatacttaataagcgataatgtgcccattaatcacaaataaatatatagatatataaatattatattatatatattatatatttttatatatattatatataatatataatatataatatatataatatatatattatataatatatattatatataatattatatatataatattatatataatatatatatttatatatatataaatatatatacaccagaaacaggaagaagcatgaacatgtcatctctgagtgcagtcctcagtcctagaggtacaggaagggagtagggaggtgggataagagtctgttttccagaaagcttgagtccaggagaagcacagtgtctggaagccagggccctaaacaaagccctccttctcattatatcttcttctgttaaatgacccactcaggcagcactttcactggaatcaacaaagactctggtctgccagaaaccagccaacccaaccctgcgcctagagctcctcccagggtagcactggtctctgctccagtgcctagaggtgaagagctatctggcatctgtcagctttccatgggcaacctgtgagcaaggcaggcttctcagggtttcatggattttctcaaagcccctagggttcctcttgcatttcctccaatcaggacccaattcctagttttcaaggaaatgaagcaaggctgcaagctctgcagtctcctggggccttctgacttggcagagcaaaatgtaccaacacctgctgcagctgcaagccccttcctatttttcctcatctccctcctccagcatattctagtccttagaaagcgtgctatggggctcctgaattccctttggcttttaacaaagaggctgtattttaatttacagagtcaatgtgaggagtggcaaggtgaaagcagaacatgtggtttgccagtcattgctttagagaaggaaagtcccaccccacgtgttgcacaggaggcaatggaagctcagaaaagaggaggggctcccccaaggtcacacagcaagtctcttttccttgctctaataagcttttctttccgcaatattgtattaagtgccaaactgtaggccacccctaaataagaagaactagagagccaatctcaaagtctgcatctcagccatagaaccctctgtgttacgaggccctagggaaatgcaaccccccaagtttgaagtgaggaggcttcctcttgaaaaatcggttaaaacgccctcctttatgcacatgccaactttgacttcaaaaagactttattcccaaggataaacaaccctatgtttgtgtaatataattaagtgaaggcatctttaaatgtcatactagcctgtgcccatttcaaattgttatgcatcaacagaacttaacgagatagccaagccttctccttgctgtgagactgagataagccacagcactgtgggccctttaatagattgccaaaataaagcattttctatgcaaattattcatgcagtgggacagctaattgcttgccaagagcccgcccactgcctctctgcaattagtcgtgaagttgaaggagctccaaactccgcaggcgcactcagggcctcctgctcctatggcttgttttcaggttagcagaaactttctttcctctggtgatagggcctggttgccctggcacagagactgttgagtaaggggagtgagggagtgggcagcaggtagataactaacggtaaagcggggaggccattcctggactgccatggcccagcacctaactcgtgtataatgtgcacttggcagcggttacaccctgagctgcagtttgctcatctataaaactggtttggacactggtctgagggtcccaatcatctggtgttttgagaacaggtgacaaagggagttgggagcaagcttagccctctcaaggaaggagctcaaggaagaacccactttgagctcataggaaaccagagactcaaggtcacaataggaatttggagtcagaaaaatctgcagagtcccaacctaccaccactcccatcctggcaattgttgtcataggcacaggaagtctctatggttgtcaaagtagagtctcagataattgaaccaatgattagagctctccctcactctcacacaaaccaaccggctctctcgagttctctttctgcctctctcctaagtgtgtctctgagtctctcaatgtctctctctccatgtccacgttctgttgttgcctttcactccctcccaccaatagctggctgtggaagcaactccaagcatgggccagcacccagtggcctcctgaaacatgaccagagcagatttgatctaggaaaggaagactagggtatcttgctcttgcaccagcttgtgcagggcaatatccatgatctgggatcacacatgcacccctcagagagttggggtcaggactctagcctggacaagagtacctttggcctccgtttccaggatttggtgagacgggccaaacccatgttgtccaaaggagcacacttgctcagggagggatcaaggagccccatgagagccaaagtgacatgcgtgaacatatgtggttggggaggaagggcgtatttttggtgtctgggcagctttagaagctaactgctcacgtggtaggtgagggcctgggctaacccatgggttcttaggtcaatggtttgcttacttaacagaaggctattttcctcattagagtctcgtgaacacatcaatatggaagttatttaacctagaagagtgatggataatggttgcttgcctttgatattcttcaacagccttttgatacactgagagccccgaggagggcacagatgaaagggccatttggttgggactgcagcatcagctctgctcctccccatgctgattgctggtgactccgacagtccgcaccagtcaatctacttggctgagcttcccctgaggccctggcagttctagaagtgcctggtaatcctcccatgcagatgcgggtgcactgaaaaccccttgttgctagagaagtaaatgacccaggaggaacatcacatggggcccttgctgctgattcacaatggagacgaaggaactgatcacattagctgggcaacttgggatgtggcccaggaggcaggaagagcttcagtagctctagcccttcactctggtctcactcagaatcacatccatctggtccttgcctggaaccccagacctgataacttcatcctaacttgctctggggttcaaggccctgcccagtcatctgccgaggacaacataatcctaagcttagagccatccgttgcttggaccaactttgcctcactaaccccccatggcccctgtggctgaggtcctgtcacctgctgatacccagagttccctgtacctggccctgttccaggaagagcatggctcttgaattcctctcaccaagctccactgtgttggatgaggggcgctgaggctgggtgcattatgcctggtgtttgccccttaccttacggcctccttgttcctattgcttgactggctcctattcaacacctgagagaaggtggggtgcagtcaggatgggggactctccctacccacctcatctaagctaactccaagtccagatcccaccaaagctctcctgcctcagtgaagcggtcctgctcattcatatgcagaggcatgaccaagctggtccccaaaggcttgcggctggaacatgtggggctgggttgggagaaggcagagccacgggattctcagctctacctgagagggcaggccaggaagggtgcagtgataaagagtgcagtgaagtgagagaagacagggcaggacgagaatgtaggggaccgaagaaacactcagaaaacctgaccccatgatttgagccctagtaagacaataaagtcccctccaccttctttttccctaacttccttttctttcttctcctcccttctccttccatttgctaaggggatgtgctgagactcagctttgctatgggtctcacggtatctaggggctagcctgggagcccacctcccatgtggaacgttgtttctatcaaacatgcatctggaaggctcacaactgtaatcccaacactttgggaagccaaggcaagaggatcacttgaggccagggtttgaaataagcctgggtaacatagtgagaccccatctctacaaaaaaattctttttaaattagccagacatagtggcatgcacctgtagtcccagctacttgggaggctaaggggaggatcacttgagcccaggaatttaaggctgcagtgagctatgatcacaccactgcactccagcctaggtgacagagcaagacactgattcagaaaaatagaaaatgcattctaactccctgtggatttctggagcccaagtcccgtatagccagaacttgtctacactgtttgacatgcgcaaccttgttccaccctgggcaggacccccatgggcacgaccatggcagccggtatccctgtctctttgctggccagttctagtgttcccagagtaccttgtgctcagggtgcggctgagggaaaatgaccctacaccgcaggacccaggaatttgtatatttaattctccctctcccaggtgggagcctgtgttaagacacagccaagggtgggaaccctgatctcgataactgcatctcaaacttcagcgtgcccttatcagagtcatctagggcaattaataaaacatagactcctagaccccatttccagagactcagattcaggaggtctgaagtgggcctgagcatttgtgtttctaacaagctcgcagatgctggatgctgcaagtccatggaccacacttagagtaacaagggtctgatgcaacctcccattttcctgagacaaagaccgcactgagagcaaagcagggcaggggataccagcggcccacccaaacgcccaagtctttgagggctcaggttcccactttaggaggacaacaaaacttacgccaaaccgaagcgggccttgttcctgcatgttgggcctctggcctggcccagaagactgggccatcaagagtgttaaccgctgccattggctggtccttcactgacagcagaaacttggccaatggcaatcaatcagggggcccgcgctgccttaaataccagcagagcaaacagcctcagacaaagctgcgccgtgtatcaattaccgagaggctgcgtgctcctctgggcggagggagccggagcgagcggccagggctgctgccccagctgataagggcccgcattgttcggggacagctggcagcccgataagggcctgctcgcccgagataatggcagtgggcaggcgcctcgcggcagtttagaatttcttgggtctccaagaaaggttctattaagcccactgaccccaattgaatattaattagctaattaacggatttattgttccacgccatttctggagaggccattttttttcgagtgccattatttttgtaaatgatttttcgcattgttcataattgaatctttgcagctgccagcatcttctgcatgatttggcaaaaaaaaggaagcagaagcacttagggtttttccccccaccctccctctgaacaaatgttttcagcccctcctgctaatgctggagcgagggggaagtaggggggctgtctctgtttcacgggtttgttttttaagccgaactgcaacgtctgcactcctttttccttccttttgtgggcagctgagggccgaggcactccgtgctgtccccaccagccctttgtctggccgtcttcaaagtactcagacttagcttttctcagcccaaacttcttaaagcattgtgctttctattagggaatacatagagggaacaagacccgagcttgtcccacctcgagctcccggtggagggaggccagccctgaactgccaggggaggagctctagccagctggggagcactcctggtgggctctgcctgggttcctgtccctatctatcccacccttgcctttcctagctggagcccaccctgggtctggtggctctgggggtacagagcccccatcccagagcctctccgctgctctttaataagtctttgctccaaattccgcaccagggttgcttgactccctggcgctggcatctgcccacaataagttgaaccagacggtcccacaggcaaatggctgattgaatcaaacccattcctctgcagagggtctagaagagggagggtatgtgtgctgggatggggctggcgtgggcggcatagcaatatcgtcaggcagcaatggggagccccgttggacctcgtagacccttcttcagcatcattaatgaagccaggggcaggcagaggctccaggaatattagtcagggcccccctgtgggcgggtctaaggaaggctcatgcccaggacctgcacctggccgccgggggctgcagaactttattgggattttttattaagctgcctcttcctgccgtcatccctgtccctatcctgctgtttgtgctcaaaaagaggaattccgagggcgtttgtgagcagggagatgagtcaggaaggagttcttgagtcttcctctgtaggcactggctgggaccacccatttcctttcctctggaatagaatccagcagacagacagactgtcctgggaatctcctccaggtgcaaaagttgtcgaagaaactatatgagataatccgtatgttaattagccagatttagtcactccacaatgtatatattcttcaaaacgtcatgctgtacatggtaaatgcatactttttttcctgtcaattaaagaaaagttgtagaagggaccccaaaagtctaagaactgaaggtggcccttagagttggggaggggagtcattcagcctctgaacacctccagggtgggaagctcactaccatcaaagctttcatatggagaagggtcgtccttacacagagtctgtatgctcttccctataccccacccatacagtctccctctgctcatgacacccattcagctaataatagtaacaaccataataacacctaacgtgaagtgaggatctactacgtgccagacgctgttctaggtactttaatgcattatcccatgtagtcttcctcatgtctctgtgggatttttttttttttttttgagatgtagtctggctgtgtcacccaggctggagtgtagtggcacaatcttagctcacttgcaagcaagctctgcctcccaggttcatgtcattctcctgcctcagcctcatgagtatctgggactacaggggcccggcactatgtccggcttttcttttttctttttttttttttttgtatttttagtagagatggggtttcactgtcttagccaggatggtctcgatctcctgaccttgtgatctgcccacctccacctcccgaagtgctgggattacaggcgtgagccaccgcgctcggctggtaggtaggattctgaggcagagagatgtgaagtaagctatgcaaggtcactgatgaaagtaacagagccagacaccaacccaacgttgctggataccagtgcccccacatgtgacctctctgctccacagtctggaaagccatggctctaagactgctctgctgcggggaagacaagctaagaggctgtaggtgcttctcatctgacagggtctcccttccctttgctgccttggaccttcctcctgaagcccaaagtccataggcgatctggctggaagacagcctgttcctttccatgttctagacactatactctgttaatgcagcctgggttggtgataaagttcttggtgaggggttgcacccctctacagcaccccccttaccctccgaggttcagacttattgttttgaaaaggagtcccccaaatcaccttctccagtcctcagaattttggcagaatttggtctgatcctccccaagcaggttctcctacacctccagaatctgccagggactcatttgatcccagtgagctgacagctggagccctcctctgggagttaccaagagagggaggcctcaagtcagaggccggcgaggctgcacagacctggctcttcccttctgtgaaggtgacccatcaggacaccagcacctcctgctggccgccctgggggctgcaagccaccccttgggtatttgggagacattccttccagtttcttattttgcaaagaggactggggctcagagacaggaagagaactgctcaagttcacccagtcacactaagggggccagaccatgccctgttctcctctgtccccagggaagagccaggtgagtgtctgatcagggatccgggaagccaacagtcatacttggctcagaggactaatggtatccctctcagagcctgattctctggaagagacacctactggcctactggccaccccagtcaggctgcctgaagtcctgcaatccttccatggccaagtcctgggagtcagtattgcttaaaccccatcccctgcctcttggatcttcctaactcaatatactcaagactctcaacaggaatcttttcatcagacaagacaacccaggctccagcaagcaaatttctgtccatctgggaatgccaccactgacagggcttatgggacctgggcaggagtccccagtccatgggtcaccactcacaggctcagcaaccttgggcaagtcacatctttatgaccatcaattccttagccatcaattatctctctctctctctctctagagagagagagagagagagagatttctctgtatataggtctatatagagagagagatcaaatcctgaatcttaaaagaaatcttgttacatgtcatatatatatgaagctctcgctctgttgcccaggctggagtgcagtgatacaatcataactcagtgcagctttaaactcccaggctcaagcgatcctcctgcctcagcctccagagtagctgggactacaggagcacacaaccacacacttggttactttttacgatttttttgcagaggcaaattctcactatgttgcccaggctgatctcgaactcctgagctcaaccaatcctcctgcttcagcctcccaaagtgctgggattacaggtgtgagccactacacccagcctgaaaagatatattatgaactggcaggatagaggttacatttggtaacctgaaagggggcactgagaagaacttgggggatatattataaactggaatacattgatgcatatgaactttattttctttatttcttctaaaaaaaaaaaaacgggatacatgtgcagaacatgcaggtttgtcacacaggcatacatgtgccatgatggtttgctgcacctactgatgggtccgctaatttccctccccttaacccccaacccccaacaggccttagtgtgtattgttcccctctctgtgtccatgtgttctcattgttcaactcccacttatgagtgagaacagacgcatgtgaacttttaagacaaaacctgaatcttaaaaataatcttgtaatatggcagaccacactccaacactctctgatacctctgatcattgggacccttcagagaaaaactgtgagactcacatatgaaatcgctggtgcacaatgtcagggggtcccgatgggataactaataatagtagaattttgggctccaggcagatgggttgggggatattctggggtctaggggagccctgccagatcacagagaggcttctgttttttctggaggcaggaccagctgcaagcgtccagctaccaggggactcatgtcttttctaagaaaagagagtagggtgagtagcttcaggcttggtctagcaaagccccgtggcctttgggttcattcttcattgaacccaactgtcttacacaggatgactcagattttacttcaggaaaaatgacttagctacacagagcttgaggagcagagaaaggtggatggagatggggatggtcagagggagacaggggcaaaaaaggagggggagggagagagagaatgacaaggaggacacagggaaagtcacagaggagagacagagaatattgccagggagagggcttttcaatgggcaaggctggacatcaaagccaccagcatagggcatcagagtccctttcatgtgtcatccaaggcaggggagggaggggaggacagctttgatggttcttgcagtcccaactaggccatgccttgggagccagaacaggctgcactgcacatgctaccttcaggtcctgcttctcagagcctctcctagctggtgcttcagccctagagaaagagggcttccagtttttgcctgcctgccagttggagcactgccgtgaggcctcagctaggctctggtcccagttaccacttcccatactcacagcccctctcctcaagcaatagggtgaggagggaaggagaatacaaggtgggtggggaggaatacagtgctgggtgtggagaggacagccactactaatctgcagcgcaaggccctcccttctggccctcaggtgagacaagtgcatgatctgctaatattctcttgagaggaaaaccagaatattggctattaaactctcaaaggcagggccagggccccatcagaagttgaaggaaaaggtcctgcccctttctctgagtgccaccatacctattttccccaggtctaatatatgctcaactccagtggatggaggcataagcatttctaatgaaggcttcaactaggcacccataaaatccatacaggaagttggaaagaccagggcgtgagtttatacagccaaagtttcctcgtaccgcaacaaggcatacacaactttacctttagagtcctttgtagggtgtattaataaagaagctctgagctgcaagtaacagaaaccccagattcaaggggacttaaacaatgcagtcatctggaggtagggtgggccccaagtgtataccaccagcagtttaatgaagccattgaggacatagatttttccattcctccattccgccttccttggtgccatcttcgtcttaagactggtctcctttatggtcatgatggctagcagtgacaaaaagaaccacctctttccttattcacatatagaaagataggaaacctctcatcctgtcatgggatattagtccttagtctgataagaacaatttggatacctacacaccctagaccattaatagggtccaggtacacttctttgttttggactaatcatctgtggactggagcttcaaagtcccctaaatgtccactacagagggtgtctcaggtagatgctgtcttgttcctgtgagtgaggaaggcgctcatgctttggctctagttcaacctctaaaccagacgtggatgcattgcttcctcctagatttacctaacagaaattcacaaaattcacaaaattcaaagctaattattaccagaggaatacatattcctcctggttacctgattttaatttctctccaataattattacctggaattattatgccaaagtaagtgtttacctcatttctcaacctgtttttattgtagagggaccttccactaacagaaaatgccccatatgagccatttgggatattggcatcattctcaattcctttctcaatgagccccaaataccctggtggtggggggctgaggaggtaaccacagttcacttcatttcatcagaaattatttgcccagtgtgaacaccttttctttggccattttattctctgtgcttgaagatgccttgggagcagagagtggataaaactcaaagcaggcctaggacgcaatgactggatggaagaacttgccttctctatccccaagagggttctagtacttactgaatggagagaaaaacaaaaaagtctggcaaaggctcatgaagagcaagtcatgaaaaactcattcctcatctgtacaatagaagaagctgcaggtgtcctcacccctgctgtctgccctgtccccattcctggtgtctactgccagactggagtgcggtggtgtaatcatggctcactgcagtcttgacctcctgggctcaagtgatcctcctaccttagcctcccaactagctaggtgcacaccatcatgcccggctaatttttaaaattatttttgtagagacagactcctgctatgttgctcaggtttgaactcctggactcaagcaatcctcccaccatagactctgaaagtgttgggattacaggcgtaagccactacttcctgccatgattcactctttatgtcactgcagagtgatttcccaaaaagttcaggccttattgtgcctttgttccacttacaaagttttgacatttcctggttgcctccagggtaaaggtctatctccctggcctggcacgagagccccttccagcaggcttgctgctttcctccaaggcctctgcgttctgggttgcaggtgcattgagtgcttggtcaccctccaactaagccccactgtctcccacttctgtgcctttacctgctgccgggcatactcatccttccacgtttgatagttcaagtgtccttccctctgaaaccttcccttctcccaggcaaagttagtcaccttctcttccttctttctgaaacctctgttcagagctctgacatgacgccaatcacactgagttatgactttttaacaggctggctcctgactcccctcctttctgtgagatttcttgagggcaggggctttggttcatttgtcttttcacctttcttgccttatactacattacacactcgacataccttggatagacagaaatctggatggaaggaagaatggcaagaaggatggatggacggatgcgttgatggatgaattaaatcaacatcacttttttttctgcctaggtcactagactgctctcagggatgcttttcagtgtctggattcttggtaagttccttcataacctcatccacgcttgtgatggaaaactgcatctgacgtgatattactcagctgtttgaagaatcactcccaaaagaacaccaaataatggtagtatgataggaagtactgcatggccagccacagggttttgccccaggccatatcatgctcaatttttagccaagagagtggtcacctccacttgcaatgagcattattaccccttggcagaggtgtgtttcaaaacatcacaccattttgctagactctgccacctgctgaacctttctggtctatcgggcctcaaagtcctccccaataaacagtgctctttaaccctagttctattccctgtgccccaggacacagaccatccaatatctccatcaactttactccctttacccatagaccacttcactacttccaataagccccctcacctcccagcacatctggctgcctgctcctccctgagcccccctagcactgctaggtcttacatttgcttttgtctcagcctgaagtgtcctttctctgtatctccatgcagataaatcctagccccagctccaataagcccgttttgctccctgggccccagcctgagccaccaaaagcattcttccttgatactcctgcttcacagcaggtcactgtgcccttacagaggtagggctttgctaagtgagagccagtaaggttacctatggtacccacaggaaaatacattttccaagtgtccataagattcacaacttagaaaacagcagtggacatgtgtgctatgcccggctcataacgcgagctctctattgcctactacataaaggcttaaactcttctgctcagcttccaattccctgtcccccacttccattctaggcacactccacttcccagtgtcccttcttctgttttgacaagtcaagattacaggcttccctctgtacctgtaaggccgtccctcatatttctagctagtctttctgtaagaagcagctcagtacttgcctcttctcagatattttctgccacgtgggccatctcctcttcagaattctcacaacacaatatccatgcatccactctcaccatgtattgcttctattagtggtctacactaaggtacagagcaggcaccctgtcccaagaggaaggagagctgattcctcttctgtcctctgcatgatctaactacattacaatatattttatgtccttccctgtaaactgggactcttaacctgtgtactcccagggagactgggagacaaaatatagcaatgggagttatagggctttaataagcagaaacatttctataatgggttgttgtctttggccccactgggtgggtaagttcctagagggtagaaacctgtaaccgctaatataaaaacgtagattgcccactaaaagcaaggggcccttgatattctgcctctaaggtctcttcaggcccaagggcattattttgctggacaaaggtctactggtcagtggtggggaaaggtggaagtgtgcattctaacagggaataaagacaaccagaagtataatggggatctggtccctacccagatgggatcaggagcccagaatctgcatctatcttgggactctggaacctgtgccccttcctttatatgaagtctttatcctggcctaaatgtttctctgcaaagatcagaaagcaaagcttgaaggtgtacaagactaggagagtgtctgaaggggagtgaagaatatggtgtcccattcttcaaagcactgctggtgttgagggtcaccagagacaaactcagtgatggaaggcagagtctattcctgcttggcccagggatcacattgggaaggccttggggtccccaacaaaatagatcatgccacttttttgctctatattacccctttgacaaagcttggctgtgagctaaacattggggtccatctactgcacaccaccaatctacagccccctaccaaaggcggggttgggaagaaagcatgcagaaacagtccacaccaaatgtcccatggaatgggactcacagtttccaagaatgtgggagagggatgaacctcaaagattacgttgcacagccccatgctgcatagagagagagcagagctaaatggagtccagagcctaggttagaggccctatgctaaagaaaaaagatgagagcatccaaccccctatgggatttaaaataaaaatatctaaactgcaaaataaagttatgtttttgaaatgaaacaaacctttatatataacatatatatgacaaacatatatatatgctgaaatttttaaagtgctccttttttgatagcctgagtttttaatttggtttttccactttgcttgtcccaggcagggggcagaggggaagaagacaattaaggataatgtcagcatcattttctggagtctgaggcacctgggcggaggccccctttgaagagctgagctgcttctggaggtaatgagtgctggttttccagggaaaggccacgccgtatttgttgggcgtgctttccaccacctcttccactctgtgtatctgctgatgagcccaaggggctccatcttggaaactccaggaccacaaagagctccaatgagtcctgagagcctgacctggttctccttcctgtaggacatgctcacgttttggacttggtgggggaagttttgcagttttgcagcatgacggccctagaaggggtggtgcccaccattcaaacctggttttgtctttccccttctcaacatttctccatccaacccccacaacctgcacgcatcctgcctccggctgctttaggctcagccttccagaacttaccgggatgtcttcctggagggagaagagcctctgatgcttcccttgcctcccttcccagcctggggaggcttctttggggagccactgctggaggtgggggtgggtgggaggacaagagcaggcccctctcaggtgggaaatgttttgtaattagccttaatgaggagggaagggtagtctatttcattgcagggaaatgggatttttaaatcattttaagggctgcctcagctctaaaatggccgtagtggggcctcagaggggctggtaattagctctcttgtctctaatgaaagcagagggacaggatgaggggtcatctaataagcacggggattagcttccagataggccctaaataagaaggcaggtgcaggggagggtgaaggagaggtttgggccagcagagctcccggctgaggggcagcagcccacgggaactcagagaagggggtgcccaccccaaccgtactttgtgcaaagtcaccctcactccttcactgtgagagaggctaggaatggatggtggcctgatgtgcctggaccaggagcaaggggccctaccatcaccttgactgatttcaggaacccatagacctgaaagcccaggtgaagcagggaggggagtctacaggacccagacaaaacaacctttccctcagggggtgcctaatgggcatgtcattggcagcagacaggagccaccacacctcggcctgtgatgcacagctaagagaaacccacctgcctcggcccagctctccctgccttggcccacctctccctgcctcggcccagctctccctgcctcggcacacctctccctgcctcggcccacctctccctgcctcggcccagctctccctgcctcggcacacctctccctgcctcggcacacctctccctgcctcggcccacctctggaccccaggagccaggaaggtccaacagaggccccagaggtgagcctcagctcagagctcctcccccatcagaactaaccagccgggctgaaagaggcaacggccggagaaaaggaacaggagagctggtcctgccagttcctggcgtcctgcggccctttgggcattgcacattcctgcttttacagtgaattgttttttccccagaacactactcgtgctgagtctgcagagaatcctgccttcttaatgcatacgctatacagggcagtcactccaagtgtctggaacaatcccactggaatccccagaagccatggatctagtcaatgtgtcccaagttggtggcattatggggcaggcagactggtggtggaagccaagaacccaaacccagtttcttggcattttaaggagtaatgtttcttattaagtggcaaacaaaggaagagaagcactgagcaggtgtcagggctgagtggagtttcctttcctccacccactgtgtgccccaggaggatccttggctggaacgcaagtcacaggatgtaggacacagagccctgggccaggctgagggccaggaacccagactcccaacccaggctggttccagtgtgcccctggccatcacttcctctccgggccccagtttccccatagtgagcccatcggataagatggtctctaagggtggtgggcaagaaactctcatccctgcccactctctctgagtagacttccctccagcttctccctgccacccggcactgtctttagcctgttattgatctttttatttgtttattgtctgtctccctcactagactgtaaaccacacagagaatgaccttgttcactggtgtttccatcccgtagcctgcttccagcaccgtgcctggcgtatagcgtggtcatgtctgggacggactgacagagtaaggatgcactggggcctgccccactgataaacctccagttcaggcatgggacaggctgcctgcaccgcctctggtcagcacctggaattgctcgtcccacccagcagccagcacaggccaggcccggtgacatggtcatgcaggatgtgcagtgaggaacgttaagtgtccgaggacccttcccctctgtggatcaagccctcgctagggcatgagttgtagagagaaaaaggggtgcagactgggagaggatctgggggtttagtgaggataaaatcttgcctttgccaagagagtctgggcccctcagaggttccagagcccgttggctgcctgtggcacctgggctggggtctgcgcttccatggtccccatgccctctccaggacaccacattccagagaggagctggttcaggggctcctgcctggggctctctttgcagactcacctcctggatctgctctggaagcactcccagatccttccactgcccagagcagcctctaggtggcagtttcacatgggagttacctgcatggactccagtcagaccaggccgaattcaagtccagatgctattgaatattacttaactagaacggttctttgagcctcagtttcttcaactgtaaaatggggatgattcaactgtaaaatggagatagaattgcgtagaggcttaagcgggttgggcatgtttttatgaaagcttgccttgtttgtctgggctggatttcccccgttggtgccagcacgcagcgcccctctcctgagagctctcagatgcccaggaaccgcctgtggtggtgacgcaggactctgctgcggtgagccaggcctcctgccctggaattgagcacaggcctcaaaccagcagacctagcgcaggttgtatgaagtgaaggttcccagcagcagttgcgtgttctggtgttcgccaggagctgctgcagctgtgagcacctcccatgtgatggctcatcgactgctgggagcagcctgaggtgcaggcactatcatcagtcccctctacagatgaggaaagtcctcatctctaagatgaaaactaagtaagctgccctgggctgtgtagctgccaagtggagagctaggatctgaactcacataatctggctcctgggcctgtacacgaaaccatcatgccacgctgccctttccaccacgctgccctcacctcacgccttccctaagttagaaacttcttctgggatgcttttcccattccctccctctctctcctctcctgccctctgcctcatttctttccatctccacctctctgtttccatctttctctccctccaccgcaccacctcctattcactctcatttcttcctctgtccctctgtgtctcagtgctctgtctctgatccctgatcccacccagtacctggcagatgggccgggggctcagggatcagggtggcagctagagaaagggagcctgagtaatcatgaggagccctctggccccttgtcaggagagcccttcagttcccccagtgcagcaggcagacccgttagaacaacaaacgtggcccaggaaccgcctcagttccctagcaccttccagctctggaagacaaaactggacttgccagaacttcaggaaaccccagagctctcccccacccccaccccaacgggcttcactgtgcttccagagcagatccaggaggcaagagtctgcaaagaaagccccaggcaggagctcctgaaccagctcctctctggaatgtggtgtcctggagagggcatggggaccatggaagcgcagaccccagcccaggtgccacaggcagccagtgggctctggaacctctgacgggcccagactttcttggcaaaggcaataagctctgcaaaacccagtgccgggggacagtccgaggacctggctgtttgtcctgggctcagagcacatgagctcagacagctggggtctaggcagcacccactggaagtcttgagtgttgtgcagcttgggcatctgaagagagggagaaactggtgtttgggggaaccctggcacacaagagactttccatcaactcgcatgaaggagaaggacgctgccctagaataaaaaccctggccatgaatggtctctgacagctttaagggaaagagcaattgtctccttgtagagatgagatctcccaggcaggaatgtcatgtggattctgcctgtggcctccacatgtctcatgttgtgggggaaggtttctgggagcaggcccaggaggagacaggattcataggagatttcatgatgggctctgcagcagtgttaagattggaatcaaacttctttccaaacatgggctgtgcagtccagcttcaggccaaggagtgggagcataagcaggtgccatatttcatgggatcaggccccctgttagagtatctcttccccaggccaccaaggaaggcagggagaggggatgacgtcccatgatctggttggaggaaggggagatttgtgcacagctatggttcaatgccggcccacattccccactgcccacatgccccaggctgaggtgcgagctgcggcagcatgtaacagttcatgctcagctctccctccccgcaccagtcatctgtggtgggtgcagcccccaaggagagccaagcccagaccattcatgccctacacttaaccaagtttctcctttgcagtgaccggggaggaattcaggcttctcccgtgtcacccctgggtgttcctgggtgttgtgaattctctccaggtgcataatcaccagaccttggtagccattcctgccccaccctagttgctctgttacagagtgagcttggtctctctctgcttcccccctaccctcttatcagtttcacgcttgctaagatgaggcccctgtggcctcttcttgggggtatctgtgggctgacactggactttctgggtgagggtctcctactcagtatctcatgatgtccgtgatgctgactgtagctcatgtaaccacagcacttcatagtgcagatctggggcccgtggctgacctgggaatcagatcatccccatttcccagatgaggatggtgagagagcaataactgggtccatgatgccagacttggcaaattccgtgccatgttgagctggggaagcccgttgacaaggtctggggtaggcaaggtggggctggggtcgtcttagaaggccagctctgttcttgggggcttgcaaaccccgcctgcctgagtttcactctatctcattgtgagtgaattcattgttgtgcaacctagagtggtgagacaagttaattacataattactgcaaaatcacatgttatttcatggctgcaatatggtaactctgttggaaacaattgtaattgcccagaaactgcattcgagtggctccgttatctcttgataaccatgtaattaacttgtattataactttatctccagcaaactctgaagtaagagttggggcccttgggttgggcacagccatcctagacctaagggtccagggagagtctggcactggggactctgctacaatgcaggaaaatcatttgctttttcaggttgagaaagaaaattcctcattataaactccagccctctgtgtctctcctcacgcaaaccccttcacaatcccatgtgctcacatacagacagctcccagtttcaccgtccccttggacccatggctcacacaaacacccactgcagccagctccactggcctttgcctctcttctcgcacatacagggtgcagctccttcacagaaactggatgcccccaaagttgagaacttctgccccaagatcctcggccctagcaatcccttttcagaaactgggccaatgaccacaaaaccacaacttggagaggtagcctcctgcaagcccccaggagtgcccagccatcctttcactttcaagtagaggagtaggcctggggagggtgaggtgcgaatccagcctagcccagcccagcccagcccattccctgcccaggagcaggcagggcttgaggcaatagtctgactccctctgccctgggctgtgggctgtgggctgtgggctgtgggctgtgggctgtgggctgtggctagggtgaaaatagcccctgggaaggaggagggagtggcctgatagtgaaggagcctgtccatgcaactttttctgtctaggttggggattcaagaagcctctgtttttaatattgcccagcgagaaggtatctttacagttccaggctttgtgcttggcactgtggctgcagccaagaccaagacagcatccctgctgccttgagtaaatctagctcggcgggggaggtggaaaacgccctggtgtctgcctgtctgctgcagttctggctggagctgagtgatggggcttgaccacctccacctctcctgcctgtctctgcctacacacttgtctacttgtgtgtccatccttcctgcctgcagcacatgtctgtctgaccgtatgtccattgacttgtccatctatgactttcttaagtcatcacaaatggccttgtgtcccccagagggaactggcctgtcccaggtctccgcatagcattccgtcctcacaatgatgtgctttgttttcctggctttccccgcaacatggcttctgctttccatccccacagcaagctccccaagggcagggacggtgtctgatctatgattcatcctcacatctgatttgctccaggacacccccggttgcagcatgggattgagacacagagtctattgaggtttgctgactgaataaatggatgcctccagactgcatgggctgagtcgaaaggaaacaggatttttcttgctcactcagaagagcagaaagctgggccccagctgctgggcagagacaacaagtgctgtctgtcaccctaaaagggaagagaggtttcagcatggtgctcccatggcagaggacacaagatttgtggtcctactggggaaaaggtcagagctgggtccccatctgtgcagtcagtctggggtctcaacagaggggatggaacacagggtagggaaggcttcatcttgcccctcttcttagggacctactcagggccagagtgtgtgctctcccagagggaagataccccaggtctcacctctggctggggctggaggctctgagttgtctccttcctcccagcttcttcccctaaagccagccttttgctcccctgcccagcaacagcacatgctggaggcccctaccctgctctgtgccctgcccttgagaggcagaggggaggggccccaggtctgtgtcagtcatgtgaacaacgcagagtaacctcccggaaacattcataagtttaatccacgccagtaataaaatcgcattacatttctcataaaataaatgttcccatttatatacagaagacagactgtacaggcccggcctggccccaggaggggtcacacacagacgggcggtggtggaggaggaagggccatccctcccatcgaggacggagaagttctaatgtggcaggagagcggctggccagcctgcactggtagagtggctggctggccggccaggcaggtgggcaggcgggcagatggacagacgggcctggaggccaggcgccgggcgttactgaacttgggattcaaaggtgccattgagctgcccttcctcatagtccatctgacacaagatcatgttgttcttcaggaagaatttgtctcccacacaaaatctagaaaatccaagcgagagagagaagccatgggaaggtcccagtgggtaaggggggggctgcagacagaagccggcctggcctatgaggtgagctatgtgggaggtggtggggggagtttgttccttgaaccttccagagggaactgccaaaagtccccacagcacacctgggcaattcccccaggccagccccaaccttggccaggccctgtagcctgaggtggtaggacagacagacagttgggccacaggcttccatagtcaggtctcctgtgttggtgagtgtagggttaggggggttggtggagaggtgcaggaacagcctaccccagtcccagagagggagaaagggaaagcacaaacagaaaaagaccaagtggggagacagatggagaaaggcagagatggggccgggtgtggtggctcacacctgtaatcccaacactttgggaggctgaggtgggtggatcacgaagtcaggagtttaagaccagcctggccaaggtggtgaaaccccatctctactaaaaatacaaaaaaatttagctggtgggcatctgtaatcccatctactcgggaggctgaggcagaggattgcttgaacccaggaggcggaagttgcagtgagccgagatcacgccaccacactccaacctgggcgacagagtaagactccatctcaaaaaaaaaaaaaaaaaaaaaaaaaaaaggcagagatgggtaaggaaggagggataaaatggttgttttttccatccgtctatccctctccccaatttaagaggatggctcagtacagggcattcttcctctaaacaaaattgataagttacctagagcatccttctaggaggtaaccccgttccactatctcctctcctaccgaaggaaggcccttcattggtctcctagtcctccccaagtaagggaagattccggtcctttccctaaagatgtccccagggtgggtgaagcctttagtgagaccccaagatcgctggcctagttccagcagatcccagttcaaccaccaggtggcgctgtaagttcactgagccctcctaacagcaggtccggccagagcccccagccagaccagcgttccctgtaggtccctctgaacctcacttcagggagcacttgtatgcgttcctacctgacctgggggctcctgagaagagcgcctgccttctggtgctaggccccagccagggctgaagggctctggctccttaggtccccagggactcccacagggctagggcacagagttggggccaagagaccagaaaataggctgggctggaaccagaatcacaagggctgggtgaggagagagtggccactccctgaggggactttgccctccagatttgggaaccccttctcactggaacatacatgcacacacatgcacatactatacactgggtacgggggtgggaggatacgttatcccatgcacatgcacgtttcaaacacgtatacaggctgggcgcggtggctcacacctgtaatcccagcaatctgggaggctgaggtgggcagataacctgagatcaggagttcaagaccagcctggccaacatggtgaaaccccgtctctactaaaaatataaaaataaaaataaaaataaaaattagccaggcgtggtggcacacgcctgtagtcccagctacttgggaggttgaggcaggagaatcacttgaacccgggaggcagaggttgccgtgagccaagattgtgagatcacaccactgcaccccagcctgggcaacagagtgagactatctcaaaaaataaaatatgtatacacacatgcatactcacctcatcatgcatgcacgttgcacatacacatacacccccagacatttaaaaacacatgtacaaatgcatattaattccatcatgcacatgtgcccacttgtacatttccaaatacacatgcatgcacatgcacactcaactatgcatacacagtaaactcatgcacgccttcattatattcacacagaaatgtgccacacagatgtgcacacccaatattaaagtgcacacatttggctaccgagcttacacacacataaaacacataaagcacatgcacgctcataacctgcacgcaccaccacatacacacacgcaacccgcatttgcgtgcacgcctccgccgtgctcctggcccatcccagcaggcctcaggctggcgtctggggagtgtgttgggtcggccagtccagcactgacctctggttgcagagctggcaggcgaagcagtcgaggtgatacacgttgtcccgggcccgcatcaccatctcgaaggctgggatcagcttgctgcaagcagcacagttccctgtggtgccaaagagcctgccgagggaagggcgcagaggactcagcagcattctgggaagctgggtgggcagggggaaaggagttgcctccatccagggtccttcccatactccaacttgtgggctcagcaggtgggctcaggcaataggataagagcactgagggcagcatctagattctgcccagagatcaggctgccaataaatcagcacatccccttccagggagggtgtgtagggggtcaggagttggctgccactgcccatcccaaggccccctcccaggctcccacaagggtcctcaagccctggagccaccaagagaatcctaggctgggccctgagcaagcctgaatttcaggggcagactgaatcttgggttgtgtgccctcaggcaagtcagtgagtctctctgagcctcatttacctcatctgtaaaacaaagcctgaaacacaccctttatggggtagttgtgaaacctgttgtaaattctcagtcacaactcactaagcaaccacctaggtagtgttcactatgtgtcagccactaatctaagagctttacaaagataaacgcttaatcctcacaacaaacctaggaggtggtactattattattccccattttaaagatttaaaatatgagtcacagagaaacaacttggacagtcacagggccttggtccagaaggcgtgctctaaaccactgcatgacatgcttttcccacctttaacattacagtgtttattatttgatttttaaaaatagagatggggtctcactatattggccaggctgctctcgaactcctggcctcaactgatcctcctgccttggcctcccaaagtgctgggactacaggtgtgagccactgtgccttgccaaaattaaagtgttttattaaatcttttttccatgacaaactcactgtgttacttgcctaagtccctttttttctttctctgaacctcagtttatccttctgtaaaatagggatggatgatcctattcaaagatgctgtaaaacagaactgatgcccaaaggaagcgccaaggacatctggcacaaatgcctctttgaggcaggcacccctcctcttagctgctggctgtaaagctctagggacagggagtttactccctccccatgcaggccagcccttggctggatgtcccaatggtctgagccatcccggctcctccttgcttctttcctgcacacagacagagcaagccccaagtgaggcaaggaggctgagaagagggtggggggcccctttaatccccgatttgtccagctcaaactcaggcgcctgcagatgagcttggctccattattcatcagcttgagctgcctggtggctcagattaaggcagacaaaggctaggccacagcatctgcctgccaagaggggcttttcttgccatcggcccaggaacagttgctgcagagggcgcaggctctggacagccattctccaggcctgagcagctcaaggaagccacgctcgcatcccagcccactggtctagctggtcctacagtcactccttgcctctgccagagcaaaaaaaaaaaaaaaaattaccttccatccctagtagctggcagggccctatatgcttgagggtgctttttcctgataagcccatcctacactgtgggcctctctctccaagtcctgtgaacccatcagatggtctgccacatcgtcctaacctggtagagtcagcccccaggtgatgccctaaacctccagacatggaggccccttctaggtcctcaaggggtgaatccccaggaacattcttttcttttttgagacagggtcttgctctggcacccaagctggagtacagtggcgcaatcacagctcactgcagcctcaaacatctgggctcaagcaatccttccacttcagcctcctgagtagttgggactacaggcatgcagccactacacctggctaattttttttttttttagaaacggggtttcaccatgttgcccagggttggtctcgaactcctgagctggagtgacgtgcctgcctcggcctcccaaagtgctggagttacaggcataagccaccgcgcctagcctgaacattcttccttaacccctgcttctggtctcagcctctcccctccagccctggcaaggagcactaagtcacagcttctgttttactgcatcacttttaaatgcaggtgttaaaaggggcaggcaggtcagtcaaaggatctttggggaattgagggagcttccactgataacctcccccttgcaacatgcccagacctgggcagagggagccccatgaagcccttgccccgacctgttaattaatgcgatgagccctccttccccacaagcccggcaaccatccagcagcctgcgacagagccaaatgcaggtgctgggtctcagccaaggccctgctttgtggcctccttccagccttgctgatgtcataaatggcctcagggagggttaattgggggaggtggccccagggaataggatccaaattgtagggagggtgagttagagctcagaggaatgcaaggcagggaagcatcattctttcacccttcacggggaagtaaactgaggctgggagaagattaggagccaaaggctcacagctagttccaacccaggtcttgaagctccagcatcagtggccctgctcctaggatatggctgcctgccagtttccctgggcaaatggatgcctgctcccaaggaccatctagaaaggaaagttggacactgggagatggaaagagactgcattagggaggagggtcctggggaagtcaaagcttccacacctgttctcaaagcccctctgaggtatcccctcccagattccagatcaggtgggtcagaagcacctggccaaggcaggggggcggagccagactggggccctcggaaagcttaacttaggggccccaggttacaaatgcctgccctggacttgtgctgggtaccgagtccaagggcataacgacctgggccttcccctcaggtgacttctcaggtatctggggcaagcagggcaggggcaggacagtcaagaatgagaggacacacagggtactgggtctagggccgggggcacagtcacgctggggctgaggatggggagctttctgagcaggacaagggcttgggaggccagggtttggcagcccacctcaggtagtcgcgtcggcacaggatgaggttggccttggtgtagagggtggagcccacctcgcccaggcggcagtcacagcaggcacacttgaggcagtcttcgtgccagtacttgtccaatgccttcagcagatagcggtccttgatcttgcggttacagcccgcacagcccttctgcttccctttgggctggacggagagcatcggcacgcctgcagacggacagacagacagcaacgcaggatgggccccgtagctctgggcctcaaggaatatcccccaagaatggggagctcactgcttctctctgctgccccctctaggtttggggctcccaggagccctcgctttctccccaataacctcctcccctggctccgggtcctgccctttgggctacatggcacagcctgtttccctggccctgtgaaggtccctccagaggctgctctgctccaaggcacacacagaccccaggcctggcctccctgagttgttcctccctaccatggcctctatcccctgtgcggtctcatccggagtaagcctgaagctcgtcttgtgaagccaccatcacattggctctttcagcaataagcctaagaaatgtagtctcctcaggcccacgaggtcctctagaacccccagatctttgtgccaactcgtctttctccagctgaagtgctacagcctcttggtctatccatgtagagctgtgatggcatcaagaaggaagtgagacgcccctgggacactcccaggagggagcagaggctctggggctcctggcaggtaagcggaggcagctggcagggcctggctggggctccccttgggaatgcttcaggcggtgtcacacctcacctgccctggcctgggggagggcaggctctgagcctctggatccttcctcattctaccaggattaggatctctcagccatcagtccctcccagggcccataccagcttcccaacatacacacaggcaccaagtacaaagggcccaatgtgatgttcaccacagggcagagcctcccgtcgcggcaggcgagcatgtgcgctcacacacacccctcacacacaggcacgacgtgcaggtgtgggcatgaagtgacagaggcacgggttcctagtcccttctcctggaaccacagggaccgttgaggaggagatggggacatatgtcgtccagtagcctggacatccatgtggacccgtgaggctgggagggaagtgcagaggacctcagaagccctgctctgtgacttgacagggcgggagcctgtggcagttgcctgagaacccttgtgaagacagggagcgtgtgcatgctccgttcctgaccaaggcgcagctggataggggcccacccctccccacctccccggctttccaacactcccctggagtctgtccttctactggccccgtcctctccaaaggacccctgctctctccagggctctggccttcctcccatcccctggtgtccctcccattcccagccctcctcactgcccccagcccagagtctgaatggttgggctgcttcccttccttttgcttctctcctccttgggcgttaggggagaacaagccacaagaggccttggtctcagaatccacagatgtaaggtcagaagagccctcagagttctcccagttaaatgttctcatactacagatggggaaattgaggctcagacagttacaggggcttgagtcagccaccgtcaagctggccccagggctccttctcctctcctgtgctcgctctcagcccagctggctcctcagacttctcctggacaggtgagtctggggagctggcgcccacccacaggctacagtgtgcagggccagtggctccctcctccttctcctccctgcagtcccggcagggcctgtctgttagctggtgagtgtgctgcctaatttccttaatgcagctctaaaggttaattggtctgagagagggatggggcacaggatgactctgtcctcgggcctgcctgtgtctcttctagcagggcccagcctggcacagagctctgaaagagcccaaggagggcagctggggagcagatacccctgagaactgaaggggtcttgtgaggctccttccaagtcctggcctacagggaggtgtggggaaatgggagaggagttaaaatagctggatggggaaatgaggggcctcccagagtgggacctggaccagggtagggctccaagggcatgaccttgtccttaggccctgtgcagggagcatgcagccagcagaggtacgcactcaaacaccgactgggaaaatcttgggccaggcccccgctacagcccctacaaggctcacgttccttttgctcagccaggcttgcagcaggcctggctcccttcccagtggtcctgagcccctcccagggctctatatttgggctattaccagaacatgggtgaatggctggaacctccgtactcaggggagaccctagcccactaaattatagcccaaaatgaagggagacagtgagaggccccagcacgtgaagcagctgtcccactctctcttccatctaccctggctcttggacaggctggtcttccgagctcagaccccagcatgtttgtcctggctcccgcagggttgtaaactccagcactggtcgacaatctcttcactggaggcatctggcacctagaggaccctgtggaagccatgaggggtgaagctgccagccgccgcaggtccccctccccactgcccgtgcccaggctggcctctgcacaggcaggttaccttaagacctggacacccctccctcttctggggtgctgaactgattcctggctctggagaactcttatagaagccacacagcttctgccaaagtgtcccatgtccaccaagacatggaacaccagggtcagcctggctgagaaggccccagagcatctagagacccttgggtctagagacctcccacgagaaaggctggcatcctgggggaagcctgagccagggcagccccatgggaggggcctgggaccagactccaggtctgcagtcctgtggctatggggtccagagcatatccccctggtctctctgggcctaacttccttcatctgcccataagaaaaacggaagcaatcccttgcttctcacaggagagtggaagagctctgggggtcaaacaaacaaaacagtggagccagccttccttcctcatagggcatccatgctgtgtctgctctcaccgggctggtccaggagacttgaaaacactcctggaaaggtggaggggctttcaggaggggctctgtagtctcctgctccccagatggagggataagctccccacagggtccaggccctccctcctgctctgccttccccattcccacctagccccccacccaatctgccagcctgcccccctgcagacacctcttccctccctccttccccagcctggctctgggacctgagcctcgggccatgcactttccattaaggagatagcatccctttgctgaagtccatttgggatccattttagtgttatctaaaaatcaaatctacatggtaatccttttaatgtactcctgactttagaaaaaaatggctttgcgctccttcaggaaaggttttaaagcattacccagtaattactactcacccatgaaaacactgatatttcacaatggatgatgtttgcgccgacacgcacgcctgggcacacactcagatgcatgcgctgggcccagcagaataaaccagtccactcaacccagggtcacccctaagtctcaggatgtggggggaacaacattggaggggaaacaggctgaactccaacccctacctctagcagggggtggaggcagggctgctggtggaaggaggcagccaggctgggagagaagcctcccagtctgactcatctggctgccagacactcaccctccactctttaatctgggggaaagccagacagtccaggtgacggggacgcactgccagaggtcatcccgcccctcccactctctccctccagcccggaggagaaatgccctcatcttcacatggaccccagagcagtccactaggccagacccaagtccccagcaactcctgcccacctgtcccagcccagctgcccctcagctccagcacgtggactttcccaaactgccaagcccacaggctccagtactaccagtgcccctggtttggatggcagcctgggggatgcttaccccagtgagctcctccaaggccactcttccagcccagaacgtctacctcacccagctccaggtcactccaggctcttccccgtggctcccctgctggaagccactgtggccacctcctggcaactccactgggcatctgcagcccctcccacaagccagtgtctcctgcttggcactgctggctctgccccctgcaggatcctggaacacagctcctctccctcccgcaaatggatcttgttagcttgtgtcccggggccttcactctgctactactccaggaagaaacgcctttgtcctgcccatccccactctcccaaaaaggtcagagtcaagagtgagactgaggctaagagttcagaccttgaaatcagggagcctagtttcaagtcggaactgctccaaggagctggggggcctggattaaatccccccacctttctgactggcatgtgtgtactgggagccacagtggtctttccgctcagaatgtggtgaggatagaatgaggttcttctgcacatgaggccatagcacagagtctggtgcccagggcacagtgaacaggaactgatagtattaacagtcaccccaggataccatccctgctcgggcacttgctttctttttcttttaactttttgtctcttgacataatttcaaactttcagaacacttgcaagaatagtagaaaaaattcctgtaagcccttcacccagattccctacatataacattttaccacatttgatttaacctccatctttctacctacttctacctacttacctataattttttccctaaatcatttgagagttggtttcaaacaggaagcctctataccccctaatactttcggtttgcaaatgctttgctgaaaacaaggacattctcttacataaccacagtataataattgaaatcagaaaattatcattgacataacattattatctaatctatagacctcattcagattttaccaatttcttcaaaaatatcttttatggaaaaatcctgggccctgcatcgcattcagttgtcaagtttagtctacttacatctggaagaattcctaaacgtttcttttgtgtttcaagacaatggcatttttgaagagtacaggccagtcatttcatggaatatctctcaatgtgggtttgtctgacacttttgactgtgtgacttcgattaacattttctcagttttctttttttgtgtaatgggtatgaaaacagtactcatttccgagtcaccatgagaaagaacggagttaatttatgtgatgtgctaaggactaagggccacagcaaaacgttcactctgattagtgtcactctcctcaacacatgagacaggatagtgagagacacttattttgaggagcaacgaactgatttgattgttctactgtggttaaagtcaccctggcactggccatagtccagctccacccaaaggccagtctagtggtcagtgcaagtatgtgtagaaggaagccaccctatctgtccaacaggctgttccagtgaccagccacatgggaagcagttgctgtggcaactcagagggtgacagctccaggaccctctggctgctctggaaagagccctggaggcaagtgtagccttggtatttttttttttttttaaagacagggtcttcctctgtctcccatgctggagtgtagtgatgtggtcacagctcactgcagcctcaacctcccggcttaagcgatcctcctacctcagcctcctgcatcggtgggaccacaggcacataccaccaagccaggctaatttttggggggaggaatttttttttttttcagagacaaggtctcaactatgttgcccaggctggtctcgaactcctgggctcaagcaatcctcccacctcaacttcccaaagtgctggggttagtaggagaaagagctggcctgtgaaccctggcagtctatctctagggccaaagtactggactcatgtgctgtgctgcagggctgcatgctgaggggggctgagacccaagcaggagacttcacagagcttagaagacacacggagagcatgcagacactcgccacacagctgcaggacacatgcacagcagcacacagatacttccccacgtccacatgatcacacacgtacactaggtccatgtgaggagggactgtgtctgttttattctccccacaacagttttatttcagtacccagcacagcgctggcatacagtaggtgctcagtaagttgcatgaaaatacatacccatgcatctaagcacacgcatgtgtgtgtatgagcatgcgttttggtgtgcttatataaatatacacttatgcacagatgcacacatatgcacaagcagccgcacgcacgtttagtctcttaaaagactacagtgtcaaaaagtggatcagagcttagaatcaagctctgatttcaacaaaacccgcaagtaagaggcctgaagatggaaggaaatggaagagcatgaaccctctagtgttaccctcatggacccacgtgcaacgtcagacattacccagaagttgatcccacaatccttatgcctacttcagctgctggaggtggggagactcactctctgggtctcgggggtctgggtccctgtcaccttgtaaggtgctttgcctgcctgggcccacacccaggcccgggaactgcagggtaggatcccaaaccaagcctaccagcagcccctcctaggcatcaatcctctttaataaggaaatttgaaagtgtaatctaactctgcagaatctctttaaatctcgttttctcagaagtaacttcatttcgcacggacacatccagccttgtgagaaggcctccatttcacaccagttttatctccacaatttctcgtctcactgcactcctattccagggccttgccatgcagcaggcgaggcctgaactaatagcatttcctactcatttggaatcaaaagccaacgagaacaactgttgaaacgcgcggctacagccacccagagcacgctcattaccgcccctctgcacaccctcttgcaggcagcgtgttcactgtgaggatgagggagagaggcaggggctcctatggcctccagctccccacgagggcagggagaggaaggctgagaggctaggctccgcccatggggtggcagtcagctcagtagagggactggcagctttgactctggtgctgctcacccctcaagggagcttgtgagaagaggtggggtagtgtaggccctgagactgtgggccctgcagacacacagcctcggcttgaattctggctttggtgcttcccagctctgcctcaatttactaacctgctaaatgaggacagcctactttaaaggattgaggattaaattggataatcaacatgaagtacttataacaatgtttggcatagtagcataaagcaattagctgagaaaatttagttgtatcttatgacccaacaattatattcctaggtatatgcccaacagaaatgagagcttatgtccatcaaaacagatgcacaaaaatgttcatagacgttttcttcttagtagccccacactgaaaacaacataaatgtccatcaacagtaaaacgaaataaattatggtatattcgtacaatggaatagtatgtagcaattaaaaagaatgaattactaatatatactacctggatgaatcagacaatataatattgaatgaaagaagctagacacaaaaaggtacatactgtataatttcatttatatgtagctcccaaacaggcaaaaccgatctgatgtcagaataatggttgcttggaggatgggcgcggtggctcacgcctgtaatcccagcactttgggaggctgaggtaggcggatcatgaggtcaagagatcgagcccatcctggctaacacggtgaaaccccgtctctactaaaaatacaaaaaattagccagccgtggtggcgggtgcctgtaatcccagctactcgggaggctgaggcaggagaatggcgtgaacctgggaggcagaggttgcagtgagccaagatcgcgccactgcactccagcctgggcgacagagtgagactccatctcaaaaaaaaaaaaaaaaaaaaaagaatactggttacttggggtgaggtgggggacatattatcaactgagaggaggacaaggagcccagtgtactgaaaatgtcctatgtcttgatctgagtgttgatatgggtgcatacctgtacaaaaattcactgagctgaacatttgagccttgagcatttaactgcatatatgtgatacccaatttaaaaacggagctgagatggagatgccctcatcagagctctgtatgcctttcataaaccccaccatttactcagcagtcactgtgccaggtgctgggctaaccatcttacagtgttatctcaatgaatcttcatattaactctgatgcactaaatgattacccccatttcacagatgagaagacggtggcctgggaagtttcaggtcatgcaaagtcatgcagctaggaggctgcagggcagagattggaatcctggcctgtcagaatccagagttcaagttcccatccagcacacgcccagggcttccctgcacagcctggattctccggtgcagcctggatgccagatggtgctggggtgggggctggggacatacttagatcagggcccgggctaaaaccaagaggaatgactgtccatgcagggcactgtctctgggtggaccacaggactttcccactcatctattggttcttcaaatgctatgactgctgtgggatcttgaaagggcttctgggcagagccagcaagggggcatggaccagaaactaagtaaaaagagggcacagggctgggaagggagcagagggccatgtagaagcagagccaagatgtctgcatcgcagctttgagaaggacaaagaagccttgagatggcacacgtcctcaggaggaggctgggctggggactccagacccagggctataatgatggcaggagcctcaaccaacagccagggccttgtgtgtgaatgaggggatgggtagggcggggagcagagaggtcctggagacaggcccagctcagggtgagacatttggagctgaagaagtcctggagaggggcctggttcagggtgaagtccagcaatgcttgtctgctctaagtgccaagcttctcctgcacgctagagcccaccacaggagggaaggcctaagggaagcactgtccagtctcacccccagcacctgcagccaccatagtcatgttcaaccagatgacagtaaaccatgttaccccttactgagtgcctgctctgtaccaggaacatatgcttgtcatgaccctgagtgcagagaactcaccaacttgcccaagggtaaagccaccagtggccaaagcgaggctgcagatccaggctgctggccaggaggcatccacaccctgcctgctgtgtcccagggccagaggcagcatcacgtcatcttttctccaagcaatggggaaagtgaacttggacccaatctggaccctaccaaaagaagacggctctgaaacactccttgcaggaatataaaagaccccttgtcagggaaaggttgggctgctgatccccagagctccccagaggggccatttcctgtggaggagtacaaagcgggaagcttcatatgctgcatttttgcagtgcgttttggtgaagaataacctatccttaggaatactgcatctaaagcctgaactcaccatgacataaagggactgaggagtttccacacatcccccacagatcttccttgttgagggaagctgactctggtttggggcaacagcaacagcctaaggggactgtcttagtcggttcaggctgccataacagaataccacagactgggtggcatataaacaattgaaatttatttctcacagttctggaggctgggaaatccgagagcaaggcaccaacagattctgtgtctggtgagagttgcttcttggatcattagatggccatcttcttgctgcatcctcacgtggcagaaggggcaagggagttctctgtggtcccttttaagaaggcaccaatcccattcatgagggttctgccctcatgacctaatcacccccaaacggccccatctcctaacactatcacattgggtgttgggatttcaatataagaattttgggaagacacaaacactcagatcatagagagcttgcaggaaggcctggatgtaattctggagcatagtgattctggagcaggtgtagatgcagtctgctctcacagcctcacataattttctgtggttctttagtggggggaatttagaaacatcagaagctgcatgtgctcactggagtttgtcacttggaatgaggcttacgttaattgcatagttatctgtaatgtgttctccttctccaggatgggtattggcattttctttccattctttggttgtctctagaaagtctcagacatagctcaaaaacaacaggtccaaagcaggattcctgatttcttccccaaacctggcccctgtaccctcaccccagacttcctccctcccacactatcatccacccagcactctggccagaaactaagtgtcgtcttcagacttccatccccctcacccctttccctgccaactcttgctcctcatcccacctgcatcttgcatttccacagccatcaccgtctctcgatgcactgccagcatggcatgatgtctggtacccacagccaattcttcacacggcagctggagagatcttccagatgaaccagggcaggtcactgctcaacttgaaacccttccataacatccaatggcctgagaataacacccagactcttcatccagcctgtaacatcttcatgtggtctggtgtctgccttcccctcccacactgtgctccagccatactccaaactccttcctgcctcagggcctttgcacatgctattaccttcccagaacacccttccctgcctctgcctctgcatatacttggctccttctcatcttcaagcttcagcttaaatgtcatctcctcagagaagcctttcttgacctccttatttcattatttaaatgagctccccacacttcagtaatttccttctgagtttttcatcacaatttgtaattgttttacttttctgtgagtttcaaaaaaaaaaaaaacaaaaaaaagtctgattgattgggtactctcataagaacaaaagccccatgaaggctgttcttggggccctacatgccttgtccactattgtgttcccagtgttgtgccccacagcagtcattgtttagccatcagctcaattcatgcatgaagagactgaatggaatctatccagatattactggcaagaatctgctggccagagtgggccaattcagataggcagggcccctagagatggagccttaatcaggcttgttgctgcccctgtgccacaccccctaggtacctgtagctatgtggccctaacaaacaaagcagattcaaccacagcagctcctgggtcatggctgccacaatccaggcttttgagaagccatcccagggctccagctgaggaacaacagctctcatgcaaatataaaccctttatcctttagataaaagagcagcaaaaacgcatcctccagcccctgcctccactgcgtgcctccctttacacataaatacccatctcagccctcagggggtagcgggtatctctgtaattccagcagctctggctgtcacctctggcacagacctagcctccccagctccctgcctgagggtctttttggcttacaaaaatgactactcttccctgtcagcatagtctgtgtctctgggggccagtgggaggaagcgacccctggagtttgctacagaaaagccccaggcccaagcctttctcagtctgtagcttccaccaacccccatcccatcctgggctgctggagccagcccctgtgttccttaacgggatgccgcttgaagctgcacagctgtggggactggtggagagcatctggaagctgtgttcccctgacggcaactcagctgctccctgggcacccgcaaagcccgcgtcacccatctaatgaaacagggctcccaagaggcctgcagtctccacagaggaggaggacatggactctcagacgagtctcaatttcacagcatcagggacgtgagcaccagcgcgctgaaccagaaaacgagagtctggcaggagctgcagacacaccatgagcaccaggggatgggagattagggcccttcaaaatcaattttgaattcaaacttttaaatgtgttctccaggcacaaagaggggaccctcccggcaagctggacctaggcagctgccgggtcctgcttccttcttgaagccgccagagcccatctgctagccacggggctgggtgaggggaggaagggctgggggttaagagggagaatccaggccccacccccaagagcggcagggatggaaacccctttggctggggctgagacagcactgcctctgggatgcctgcctgaggcattgccccggggcttcctattgaggccctgggggttgcttcagcccttctttgcagacctggataagagagagagacgctgaaagcaaggcccacgtgagccagatttcccttcagccccccgcatggctgaggaggttcagggagcatccgtagatgaagctgtttagaatacaagctttggaatcagacagtttgggatctgtatcctaaaccagccatgggctcccaggcagaagatccttgttcagaagtgaatgtctcttccggaaacctggtgggagaaagcctgctgtgagtgtcttgcagtgcagcccctgtgaagtgagagtggtctgaagctcccaagtgcaaagggaaagtgtcatcccgtgtgagagtcagcagggtgggccggctgctgggcaagctggtatggccgcaggctgcattatccagagcacagagtctgcagccagggagctgacagccatgctgtctgtcatctgtcagaccatgtctggagtacaagtaccatctgggccctgcacccaggtgaggtggacaaggaggcacggggtagtgggcctcaccaagccagaacagactgctctagccaaaccctagaaagggccccaggcccacagtaggaaggcctttggaggcatgagcccacagaggatgttcctggcagcttcggctgcagccccccactcctgcctgggtccctgttgagccccatttgtgcctcccagcctatcatcagctcacagtgcatgtgttccccatctctgggtggggaagctggtctatgacaagattctttgagatcactgactccctcagccccagccccagagttttccaaacccctggctagctcccaactttaagccatactcctgacacataaacatgaatgagtgtgaaccaccctgtgggtaagagacaacagaatacagccaccgtggcctcgggcctgcaggggcttcacagggagccctttctggaataaggagcaccgggaaaggaggctggggtcaccagatcacatataggagaggaggcagggactccccagcccctcctagcccccagcttgggagtgggctgctggctttgcaaggaaattacaacatgggcctgggtaaggctcctcttagttacagcataaactgcagcaataaagcgtacctggggaatgtttagagaaagcactaatgatttcttccctagtggttaataaattcacttccagatcaatttgttcacgatagagccctgtgagcggaacccgcatggcgggcacagccgagtgtgtctttttcagtataaatgatttattacgatgattagcagcacataaacaatttaaaatacaacgctaattagtttggggaagaaaggaggggaaaagccaccctgcctctctccccattatgttctacttccctaagtgtgtactttttaattaaatccaaatgtcacaataaacttaaagtgttttattaccactcgggctaactgaggcagtcatgtgagcccccctctcaggcatctgcaggctggcctgggggtaagggctgggggcaccagcagaggctgtccacaaactcccaacatgggagatctcttgagaaccctggaaacccctcatggttttcagcagcaccaggtcagtaaacactgggccttcccaggggactctccaccttctgctcaccttcctggccagcccaagcaaggtctcctccttaaagcctgctctgaccagcccagaagccagccacttctccccgacagttccacagtaccctgcatcctcttcacccctcctcgtgtgccctataaccttctaccaactaccttctgtgtgcctggtatcatgcccggcacttcatgtacagcatcttcccaagtccttgttgtggtgctgtaagttgtaattattgcttccattttgtggatggggaaactgaggctcagagaggtggaacaacttatctaaagtcacacagctcaaaatggacttttgtagcatcctttgccctcctacagcatgctccgcttcagagcctacaactggccatgtctgggccctgccttgcttagagacacatctgaggcaagggttcaggccagggacttggactctggtgagcctgggttcaagttcaggctctgccatcgacccatattgtgaactccggcaagtcatttagcctctctgagcttcagcttcctcatcagcaaaactagagcaataacattcaacttgtagggctgaagaatgaaagtacctaaagcaagcagaagtcctttgctatccttgatatgctaggcaagtagtagctatttacagaagcccttgaggtgagcaaagatccgtactaaccccacttcatagatcagaaaactgaagccagcaggcaaaagatttatccaaagtgccaatgaaccccaggatctcactggggaagtaccaggctaagggcagcctcccttccggaagttcggacaaccaaggatggcttctctcctaaacactcatgtactattcatttgaatttaaaaacaaatatccccaaacacagagttttcatatgactcagtgtgttaatctttcttgtgttgctataaagacatagctgaggctgggtaatttgtaaagaaaagaggtttaactggctcacagttctgtaggttgtacaagcatggttccagcctctgctcctggtgagtcctcaggaagcttccaatcatgacagaagaggaaggggaaaaagcaagtcacatggtgagactgggagcaagggagatgggggaggtgccacactcttttaaacaacaagattttgagtgaactgaacaagaactcactcatcaccaagcggatagtgctaagccattcatgagggagccatccccgtgatccaatcacctcccacctgtccccacctgcaacactgggaatctcatttcaacatgagatttggaggggacaaacatcgaaaccatatcacccagcaactcccctcctaagtatatccccaagaaaaatgaaaatataggtcttaacaaaaatttgtacatgaacgttcctagcagcattactcacaacagccaaaaaacagaaacaacccaaatgtccatcaattgacaaacgaataaataaaacatggtatatacatacaatggaatatgatttggccacaaaaagaaatgaagtactgacatatgctacatcatgaaggaaccttgcaaacattatgccaagaaagaaggcagatacaataaccacatattgcatgattccatttatatgaaatgtccagaataggcaaagctatacagacagaaagtagtttagtggttgccagggagggaggaatggggagtgactgctaatgggctgaaggttctttttgaggtgataaaaatgtttttcaattagataatggtgatgactgcataactctgtgaatataccaaaaaccactaaagtatctattttaaaaaggttaattttgtggtatgcaaatgataaatcaataaagctattataaaacaaaacaaacaaaaacaaataaatattcctttgagaacaggagaaaccagttcataaaatattcagtcctggggtcagcatagcgggggaaataacctgtggcagctagaagctgccaggtggggggacctgggaggccccatggccagcctcacagggggcaggccctggtcacctcatccccctgctgggatgaaagggatgaaagggctccagagcacccccttacctccttccccagacccccacatccagaaatctgactccatccacttttccagccctgctccccaggaaactcaaaccttactggatccatcactctccttggcccatctgcttccacaactgcattctcattttgtcttcccaggtctctctttgttgaaatttctgcatccttcaaggactatgccctacctgcaaactgagcatgcccatggcaggggggtccctctttcaggaccttgagcttgtcctaccttggacaccacgagtacataacagtatgtgcataatgctacatgcataatgaatagcatcatagtaaggactcccccaggcagggttgggtaagggatgctgccctctcccagggcctgtgagccccacctggcacagggatgtgccagcttagatccagtccacgagggtaggaaggaaagcaacgaggctgcctttgaagggggagagcaccatgcccagactagggacagcaccctttgtagctaatctgagaggacaacccaaaaagatgaagcatcctggccagcagggggagctggggccacactggggcaggggcatttgcctgccccagagttgggaatgagcagggatagactgagagtagtcacagcggctcaggcctcatctccgcagaggcgaccagcctccaatcctcccacaatggagagagccctatggaggggacaggacaggtctggtcacttgaaaggactatctgggccttgaagcaagtggacacatgctcgttttctagtcattaggtcagttccctgagtctacatggattcaacatgaaatgctgtcttgggaagctgccccttagggaaactacccttggaacttctctaaatttctcccccaaagttctatgaggcccagggatgagaagacttctcaaggtaaggggtggcaggagtacatgttgcaagtaccttccctttatgtagccactgtgttctcaccaacacctcctcgggtgggcacagtgctgcctggctggcaaaacacatgaaaacattttctgtcatttgagttctgtgcagggggcagggaggatgttctgggtcttaacttacgtgaccagggctcagaaaagttaagtggtttgcccaataacacacagcagtgggtggtagagcaagattgcccgtgatctcacagtcagaggaccacagtccatgcttgttacctcccaagtcaaaagacagctacccctgcagcaagcggtcaggccctcatgccgctgccgtcaatttcaaagaattctaaagatttcacatctgcatgtatctgagctggtgctcttgggggttctctctccttggaagagtgagtccgaagcctttgccatggaagggagggcaggattcctggtagtatggaccacagggagaagagtgtgtgcccttgagacagcatggagtgggctggtgggtctccaggccctgggcagccaggcaggagtggtgcccatgcaccacatagacacctgagtctacagacagaccactatacagacctctcccctgagggacagctcattgcagaggcaagaccttaggcatagttcccagactccacagaggtgctctgcagcctcagacaagttctgctcttctctggactgatcttagttgaatataactgggggtggactggagtagaaataggtaagggtagggagaccgtgagccacgcctctttcccagaatcagcagctttcatgaaagccattcgggagaaagaacactggcccagagtgggagggccaagaaacactttacagacagatcagaggaggtcagaggagtcagggactgatccatgggtggctggataggtctagacttgctgcctcccagtcctactgtcctcctacctgcctcaggcccacagtctttggctccctccctcagagcctagaaagccaggattgtggtccagtcttgacagcagcagagggggaagtgaagggtcagggaagccttcaggccaaagctgggctgggcaagcaagggcctcagggacaaagctgggcaaggacaggcttgcagccaggggctctggtctaccttccctggagctcaactccagctctggccacaagttcaagccctgctacggggagctgagcagctccagccaggatcttgaccaccagtagacctcagatgagctcccattcccaaggccacagcttcagcacagtttctctcctagacctcaactgcctcctctgaccaacccagaccctcacctgcctcaccctgcacagacccagactgcgagctctggacgaaactgaagggaggcagacaggagtgtggggccgtctgaagccagagggatgaggagaggtccatctataaagctgaaaaagaacccctccctccccatcatatgctgctttctctgcctctagttttatcccctcccatttgctctccacagagtaaaccaaatggtcttaataaaatgtaaatttgagcatgagtcttgcttctacctaaagccattcaaaggtgtctcgttgtacacatggacataaagatgggaacaacagacactgatgcgtgataggatctgtcataccccgaacctcagcatcatgcagtatgcccatgtaacatgtaacaaacctgcacatgtgccccaaggatgtggagaaactggaactcctacccacggcctgcaaggctctgcacaatgtagcgctgccaaccctgaccaccctgcagcctcactgatgatgccccaagctccagtcacaatggcctctgcagtcttgaacttggggttccttgtcctctctctgagacaaaggaatccttatgattctctccaatcctctcctgacctccttcacctgtaaactcattcattcattatccgctcaacaaatatttactaagcatctaccagcaggggctagcccttaacatctacattttgataaaaattataccaaaactgaggatttttcatcaagaaagtaactcttaatgagcttcattaagtcaatttaattccttgatcacttttctattcattcatgttaaaccatttcttcacctttccccattttttttttatttttgtggagattattttcatcgggatcaattatttttaaattgttgaaggtgactattggcttacgatcagcttttggctcactgtagatctcacaaattagagtttttgccactgtcaggatttcttttctggcaattatttctaccagaaaatgtttcctgagccaacttctgcagatctaaactttgtcaggaagatttgattcttctgtcaatttttagtcaataacatactttaccaggtgcagtcttagttgtcgccagttttactttgtgttaattatttcaaccaattttaatttcttcctggatcttttttttgagaataatatctcaataatactaatgagatcttatgctcatgtagaaggcatattttagcagtgatctgataaacactccgaggatcaaagaatagcatgaaaacatcctcagggcacaaaggcaggtcaaagcattgaactctgcatttgggtggagtaccagcttggaaccaggtgcctgagggagccctgcccactgcccactgctccctggagccctggcccctgccaagaagatgcctcacagatgggaaacagcttctggctcgggggagagcagctgcctggaagagacagcctctgactgacaggcaaagagctggggtgcagcccgaggccccatgccagtcggatgcagcctctgctgggcacagacatttctactcagaaagtatttcagaaacactcagctgagaaaggaagcagacgcttctcagtgccttagtttccccagccataaaaggatgtaattggggtactctcagccctaggctatgacttccactcactggcctccaggctttgaacctgctccaggggtcccctctacctcctaattgagactctacctggaaacagcaggggacagggccttccacctggattcgagtgtgacaagaccaagtgtggagggctaagggcaacagatgctctcacctgggaaactgtgtgtcccaaccccagaagtccagtgaaagagaaagagacctcactgggagttcctttctgctggcctggccctgccacacccattccccaacagtcatgtctccatatatggcaccacaaggtatgaagccagcagccaccctgggaatgcaaatggggaaaccaagacccagaaaggggaagggaccagcctaaggacacactgtgaggtggtggcagagctgggatgtggatgcagcagttctggctcccagccccgtgctcaccagcctgtttatgggagtgctccagcccacaggagagcctcctccaccctgctcccacgtgaggaactgccgacactacctttacccagcctgcctcaaaaatgccgcctccaccgccccgtaacagccaggaaagaagcggggccctcaatccaacagcagcggggaggctggctcaggaaggaaccaccctcacctcctctgcgggtatcatccctgcggactgagaagagaggccctggggtgagagaccccactggggtggctttgtagggccctcccagccttggaaaactgaccatctgtgagaaaaaaatccagcagcccccggcgctggtccaggggtgtgtgtttgtgtgtgagagagagagagtgcatgtgtctgcctgtgcaggtaggtgtgcgtgtggtgtgtatggggggggtataggggtgtggtatgtgtgtgtggtgtgtgtggaggggtggaggggtgtggagtgcgtgtgtgagtgtgtgtgagagtgcatgtgtctgcctgtgtggtgggtgtgcgtgtgtgtgtgaatgtgtgtgagtgtgtgtgtgtataggtgtgtatgggagtgtgtggtgggtgtgtggtgggtgtgtaatgtgtgtgaatgtatgtgggagtgtgtgtttgtgtgtgggggtgtgcgtgtgtgggggtgtgcgtgtgtgtgtgtgaatgtgtgtgagtgtgtgtgtgagcatgtgtgtgtgtccacacatattcagcaccatccctcccacagctacagccaaggagggcctgtgagtgtctttaccgccacctccccaggctcatggcaggcggggcctgtttctcgcctaaactcttcaacatgccaacttgctggggtatcccagccaagtgtcttttcctctctggacacaacctagtcctctgcaaaatggggctagtatttgtcctcttagcctcccaagggtgttgtgaagatgaaatgaaagactccgagacatctgtgcccttccctggcatgaggtgacccaggagtcctcctgggaatggagctggtgaggcattctctctggaggcagctgctattccagaggctggcctctcatggcaggccaccttctaagatggtccccagtgatcctgcctcctggcactcacacccttgtatcatctgccccacttccttgagtgtgggctggacctagtggcttgctcccaaggaaggaaacacagcaaaggtgatggaatgtcacatctgtgattcatagacagacttccttcttgtaagcagacactgtctttcaatggctttcaggaagcaggcagccacgttggagaggcccatacggcatggccaccatggccagcaaggcgtggaggccctcagtccagcagcccgtgaggaaccgcattctgccagccaccaaatgactgagcttgaaacaaccccacatgaatcttgagatgaacccacagccccaggtgacacaccttgatcacagtctgagagaaatcccggagcagagaaccaagtaaagattactggtccacagcaacgagagaataagtaggtattgtttctagctgctaattttggaatgtgtgttggaatgtgttacgcagctgtagataattaatacactgccacagtggcatatatactctgcagagaagggtcctctcctcaggccattgagagggggccctgcagacagctctctgcctgacaacccgtgttgttgtgaacttcctcctagagcacaggccttgatgtggagtgtttcgaggagaggagcccagaggacagagccctgtctccaactgccctacccaggccccctgccctcagctgggcagacgaggaaagtgggagaagctgcctcacgtcctcaaggagccacagccgtggatcctttccaaagagcaatcctcccaaagctgggaactccaggcctgtctggagcagggcaagctttccaaagcacatccacttcccctgtctcccctgctctcaccagtaccccagggaggacagagaaatggcaccagtcatctacaagactctcagaagctttgcctgttcaagtttcaacagacctaaaaggtaaacgtgatcatacccattttactacttggaattattattagaatttactcatcagaatgacttagcagcagaggcaggatttgaacccgtgtgactcaaagcccacttcctatttgttttacaaataggaaaactgagaatcagagagtttgaacattctgatggcacccgcaggtagccccacacagtccttcctggatactgtcgtcaggattggggtttttaaagatcgaggggagaggacacgcaggatggagcaggactgtaggagcccaggccagcactgctcccacttgtctggcaagagtgggtctccctcctgctctctatcaagtcaccgtgccaaccagcaaagttgaattattaaaactcctttctggggtaccccacgaatttttccccgccgagactcagagaagaggggcagccactcccgccacacaatattaaaatgtcaggagtttaaggcctgcgttggttgagtcataagttatcagcacccagtgagggccgacagaatgcctcccctaaattattaagcagaatgcgtcagactgtaatattttgctaaaccaaagtacagacacagacaaagatgtcatttcaatatttgaaaccagcaagtttaatttaaaataagagcaaaccaataagctcagaacatagcggcgtatgagaggaaaattatactgtgagaggaaaaaaaagtggaaggacttaagaaatttataaaagtaatctccaagtggaaattagaaatcaaggcctagaaacagaataacacaaaagaaatattactgtccactttctaaatcaatataacactgctccacgccggaattaccatggtaactcaagtaaaaagaatcaagcaattcttattatttcaaaataaaatcacagcctgaagcctgggttttattacaaccactgatagatcgctggcttgtatttatctgaaatattgcttttcaatcagctggtttatgaatgtacacaggcctctcaccagcccacttaccaccccattttgaggctaggggccaaccaatgaattgattctcacctggctgcatctgcatatatgctcaggtctaagtcagctcagggaacacagaacatcacatcctttcaagccgtctagtggctttgcaggacagagaggaaaacctgaaagaggcaacggggactgacctgattatggtccctccccaccgaggctggccctgggaggaatggagctgggctcccatggcagccccactcaaactgcccacagcaaccttcctccctccccaagtcatcttctcacaggttcgtcacccttccttgaactctgagtgtctttctctccatccccacgtctgacagctggaaaagggagcagacagagcagagagagtgagcgcactgactctgcagtcagcctgcttgggttcacagcccagccctggcattcttgagctgtgggagctggaaccaattactcaatctctttgtacaataattttctcatctgtaaaatgagggtaatagtagcttcttcctaaggttcttatgggtattaaatgagattatacatggaagatgcttggtggactgattacaaaaatggccccaattctctacccttccccacagccacaccatttgttatatgacttttcacctcctaccttcaagagcagaatctgcttctccaccctttgaacttgggctggccttgtgatttattttggccgatagaatgcagcagaagcgacaagatcccagtgccaaaccttggcctcaagaagccttgtgtaggctgggtgtggtggtgcgcagtggcacaagcttgtaatcccagcactttgggaggctgaggcaggtggatcgcttgaccccaggagttcaagaccagtctgggcaacgtaatgaaatctcatctctacaaaaaatacgaaaattagctaggcatggtgatatggacctatagtctcagcttgggagactgaagagggaggatcacttgagcccaagaggtcaaggctgcaggaagctgtgattgtgccactgcactccagcctgggcaacagagtgagatgtctcaaaaaagagaaggcttttgtgcttccacaccttccggaccggtctctgccataagaacaagtcggacaagccttctggctaatgagggccatgcagtcttgtcacgcccagcatccaactgatcagccatcctccatcctccagatgtgagtgagcccagctgagaccagaaaaactgctcagccaagccctgcttaaatcactgacccacagatttttgagttaaataaatgcttattgtgttaaggctctacattttagggtaactgattacacagcaataactaattgatacatacagatagcacaatgccgcactttttttttttttttttttttttttgagacggagtctcgctctgtcgcccaggctggagtgcagtggcgggatctcggctcactgcaagctccacctcctgggttcacgccattctcctgcctcagcctcctgagtagctgggactacaggcgcccgccaccacgcccggctaattttttgtatttttggtagagacggggtttcaccgtgttagccaggatggtctcaatctcctgacctcgtgatcctcccgcctcggcctcccaaagtgctgggattataggcgtgagccaccgcgcccggccaatgctgcacttttaagtacgggttcagtataatgatagctatagtgttttatgactcctaaagactgagaggccaaagccaaaagatgatactgtaactgtacagagagcaatgtcaattcatacaagcatgaaactttctggtttatcaagtgtgtgcttggacataaagtgccagttaggtgtttcaccctttgtagggatgagaaaactgaggcccagtgcgctgaagtcacacagcagtcagctgggacaaaacccaggttttctgaatcatgctagcggactacacctgtagacaggaggccactcaagaaagcccagttgacctccaggggaagggacaggagggaggagctagtgacctgagcccatgggccttcacactgggcagctgcctctgcgacctggaccaatctgctcactcctctcacaccacctgcttttaatttgcccccagttgtatcagctactgtgaactcctgccttggacagaacacaaaacgaacacactcccaccagtagcgaacaagcttgttgctaggtttggtggatgtgtctctgagcatggcctggaatggcctgggagaagcctcagccaactaaaggagaaagggcatgccaggcaaggaggacataggaacaagggaatagaggcaaatgctgagtcttcatggaacccaaaaccagagcagacatactaaacctgcatagtttagtgtgatggtcaaagcagcagtaggcctcaggcaggatgccagggtagcagaggttgggtcagactggttgtaatgagcaccacaagaaagatagcaggtgagatgagaatggtggtagcagaggagaaaagggtaggtccagagtcccagatgaatgcaatccagtggtgtgctgatgcatgcttaacgaccaagtctttgggaaaatgccctgatttgtagtgtttgccaacatccatggtacaaatactcccattgtggctgacttcaagctaccaatgcagtgtctctgaactcagagttgggaacagatgtacagaatctcttgcaagccaggacaagttgactccactggtgtagtccaatcccaaatatgggcctgctgggaaaactcactctagcagcaccacaaagagctaagcctggaaatgggaggacaccttgcatgtctcagtgtcctccaactccagacaggacaggcaagcaagatgggacacatgccataggaacctctggggcttctccacttccaaaggcccaggacaggtgagtgtccctcagcacctttcaccttacatctgaggatagaactgcatcttctgggctgtcagtaggctggcaaggggcataactgggacacccaagcacgtggtccgtggtcccagtccagctgatgtttgctgtaatcagagttttctaccacctagcctcatcacgcctcagggctagggcagaaggcatggcaaaaagatgctgatgctctaggctccaattccccatggaaccctaggcagcccttttgccctgtttaaacctcaaccttccccctataaatggaggaacttgcaaagagtggtcctagagacctcttcccaaggtgccacctgtcttggtgatctggacgtgggcgagtagtgaggtcagcctgcctcccaggcagcaatgattaaggaccatgataaataaactggcagagtgagggtgcaggcccagtgcttgccagcaaacaaagcactggactggacacagagttatttcagatcatactgtaactgagcatggagcaatgttgctccacacagccatgaggctttctggcttatcaaatgtgtacatggacagtacctcacttaatcctgaatacaatcctgccaattagatatggctgttctcactgtagagacgagaaggtagagaggcaaaggtttggaagcaaagcaacctctacactgggtggacatggaacacaaaatcacagtggacatattggacctacatagcttagtgcaatgatagaggtggcaacaagtcaaacagtgcctggcacactgggacacctctaccttctgccctaacatcttccaatcttctcaatgtccctgatcagggctttctgggaggccctctggaccctggagatggatccaacaacagccttggcctccctgctatatgggggcacagctctggagggagctcctaactccctgggcctgcatctgctctagaccccaacgtggctcaaggcactcacccccagccttccctagctgcaccatcacggctctgtcttctgctcagacagcccagcccgtctagccatggccacttcccaactctggcagcttcgccctgggccatggctgaacctcgtgtttcctttgcccatgaccacagggagtcaactgccagtgctcactggcaatcatccatctgttccaaggttgagagaccaaaatagacctcctcttggtcctgcccacaaatagagcctgctgtgaagttccttaaatggaagcttatggggcagctgcctggtctgactctgagacacagggtgacacagggtgggggtaaggaatcaattactcgggagggatgagaagcgggtcccagctctagggaaacatacattttcatgtgctaaaggcatctttgaggacatgttcagaaacagacagcaagagaaaaaggcagttcccacagccacagaggccaagtgagtggtcatgccagcactgagccccggcatccaaagggtgaagcttttaggcgagcagcggccagtgatctcagcttcccccagtcctaatgctcctgaaaggctctctcctgctccctgtaattgggcatcagtagttaatgcagtattgactgcattacacgctcccgtgcctcccctcgctaatgccaattgcatcaccttgtacagtcactggcttgcttagccaatagccgttaaaagcaatccaaatcatgaatcatatgggaaacttttagcaagacaccgccatccaaggagacaatttacagttgagttaatctgggtacattagcgagacatggattccggacgacagaccaatttatgttgtttccctgtccccccttagtgctgctctgtgtgagcaaatgaatggaagagcagggaacagagagaagcacctgcttcttcacccaaggctcgggtgtgtgtgtggggttggggggcgggttacccatctttacagacactctgcctggctaagtttgggcaggaaggggaagcggctgtatgtgcagctcaggatgtgatgcctcattcccagcagaaaggagggctgccgctggggctggtcatggtagatgcagatggtaaccctcccgctcccctgcttctaggcactgggcaagtgcacaatttggtccccaccctgccagactcacaaggcctttaccaggcctcagcaggcagcagtgtccacttggctccgccttcctgctgatgggctggggtctctggcatggaacagcatcagggcctgcctccctctccagggttgggacggtcatgagcacactctgccaggagaggcccctgggattctctgtggtctagaacatgagtgtctatcctaggaaatcctactggtggcccagcaagggctggttggtacccaagcatagccatgcgccggctctggtggattaactgagtcggctgtggaatttgtgctcctagcagtcattaacaattgaagactccgctgtctggtcctcctcagtccagcttcactctcttgggcatttttacttattaaaaatgccctaggaatcatgtctggtgtttagttccacaacccgcctgctgcttcctgtggtcacccccaccttcctgctgggcctttgcaaaggccgtttatacccagccctgcccttctcctgtgtgcacctgagagcatcccagcatccccagctggatgccccagcctcctctcctgcccagtcccccacagaccaaagctctcactgttcttgggccctctcagactctctgctgtctgctcctactcaaaggcctcttctcgaacagcccaggggctcatttgacttgggtagcattcagagctgtagctctccttgctcccttgggattttaaccctcccaaaaagctcaccacctggtgccagcccaagccgcaggtgccaggggaagaagggctgtttctccgggaaagttggagctcagttccatttcgctgacaggcagacccagcagcatgtagaaagcccggaccctgagttccagtaaagtggagatggctaggccaagagcaagcatccaaatgaaagcaattaatcttaaaacccgaagtttaaccgtttgcaaaacagatctttccgtctctgtggtgacccttcactgctcgacctaatggattactttattaataatgcactgtgcttaaaagcaaaaaaaaattttttttttctgacgattcaatacttcagaaagtctcttaaacccgttgctacggcaaaacgattgatattttattatctttcagaagtgcaacatgaaagccctgcagcccagcagagcgggagctttggtcctcggcagctggcagacccgacttcaaccagaggagccccagcctctccagacaagatgctgtcaggtggagaaaaggcgttgggggtggttaatagcagccctgagtccctgctgcagccagacaaaaggtgccgtatgcagggaacgcaccctttgggggagccggggggtgggggaatgctgccacccagttcagatagccacctgctgagagggcagaagcgttcaagaagaagataggtggttggtttggaggagcagatgagtgcatccagaacctttctccctcccccaattgaagatgccatcttcaaggtttcctggaactatgggaggccagactcctcttaatagggagtggagtgcagatgcatgagcagaaacgtcgcttttgaaagacagctatgggctgggtaggacaagaataggtggctgcttaggacaccagtggatgtgcttgtgctgtaatggaccccagagcccagcagctccatggtagtgggcaccatattgtttaggctggacaggctggggatggaggggcatctggagctctcttccacagatctagcagaaaccagaagaaacatctgcccagggtgcttgaggtacactgcaatttggaggcagggagctggctaaaatgacctccagaaatccattctcactcaaggctcatctgaaaccctttgtattatctcagagccagaggcatcatgtggtgcctgggcagagcaagatcctgggtgcaggtagggggtgtcatcttgttggcatgagaccaatctccctggcctgaggcctctcacgtacagagcccgagtcttctggattcctggcttgggcctggggagccaagtatgccaaataacctctgctaaagatgaaccttgcatgctccccatagtgacagtatctccaggtaccaaggaagtaccctctcccctggcttctccaagcccttcatttttaccaagagggaaggtgaacatggggagttcgtgatgaaaggcaccaaatcaaggtctcttccctccctgtctggcccaaccccagaccccttcttctccttttcattctatatgaagttctccgatggcctacatggggctccagggaaggggtccgtgaatagagaagacatattgaagatgatgtcccaccccagctagcccagaagcactgaggttccccccatcctctctcttcctacacacatactgagagccacaggtcctcctagatgccacccccaggccagatacttcaaattccccctccctgctggatgtctcagaaggcggtagcagcctgggggcatcggcacctggcagcggcaatgcgaacatcctgtgtgaccctgagcaagtcacttagctttgcattttcaccaactggccacatcaataacaacgctgccccagggacagagggctcaggcccagcagagactcctgaacggaagggcagaggatggccactacagtcactttaagaggattcccgctgactcaaagcaaacctaccctttcggtacctcaccaatggcagaacgccggcggcagcgtgggcaccaacagtcacatacaaatgcccctgcaacaccaacacacaggcctcacctacagggcaggaggtcctgggacagccaaggtactgcctctctccttaccctggggactcatcttagggcacccacttggctttccccccaagggggctgggatccccagccttctaggacacttaactgcagggcactccctgccagtaaggctttggggtctatgggaccacctgctagtggcttccagcagccatgggctcctctgttccgacctttcccgtgccctgcagttttctagggcgcactgaggctcgaccacggaaggtccgtgccactctcgcaggccgctcccgcacaagtgctaccggccggcggcgggacactttcttcctctgggccaaactcccgcctccgcgctcagagagacagggagctagcgggccggcacaagaggcggctctctttctcaccgagtcacgctcatgcagatgtcccccggagggtccaacccgccttcccctcgcctgccgggcaccctggcgctcgcgccgtcctcccgcgctcccgcttgccccgagctctggagcccgattctccccgaagccgctgatttgctcggcgctcagcgcctctcgggttacgcggcggctggcgcgagggtgatggctgcggtgagagcagcagcctcagacacgaaatgctcagagcgaacctccgcggcgcggagatcgcaagggagccccagcctccgcgcggccccgcggcgcagcacacggccagtgcacagctcctcggctcgcggccgggacccggggggcgtgcggccccgggcgcgtgcagcccggggctcgacctcctccccccgcaagttccgcccggctgtcccccggtacttccccccgccccagccccggcccccagcgcgccgcccgccccgcaatccccgcacagcccagcaggtgtgcgcccgtgtccccgcgtgtgtgtgcctgcgcgccgcggcagggggcgagggggtgaggggcgtcgagaccccggcccgccacctaccgtcctccttgtccagcaccatcatctcgggcgctccgtgtccagccgcagctaggctcggccgggagaagggcgccgactcggggcgcgctttggaggggcggccggtcttcgggcagctagcgggctctaattacccgcttgtccggctcttaacctagattgcactcagctagaattacattcaggagtgaagcacttcgcagatacaaaagcagtctcacctacttttgtgcctcagaattggaaggaactacgaactgcaatttagagagagagggagagggagagagaagggggaaaagaggatcagagccgtttctttgattctcaccttctaaatggctcaatttgcccagtataatctgtcttaatgtaattgcatttgatagctcataaccctgtctctggcaacgacacagctttcagcctcataaagtgttttcccctcggatttaatctgaatctcaatctaaaattatattcaaagagatgggggaatctcgtggccgtctcccgctgcctttctccctcaatgtatgaggtttgcactcctgctactgcataaatgcacacatttcctgaggcctccaccctcccgggttaatggggagtggagacgcacggctgtccggctccgcagcgccacctggaggcttctaggtcctagctcggtgagcgtctttgctccgatcccagggtcgtggtcttcaatgattgtctggaggacgcatcccatctgtcactcccagaccctcagccttgatttttgtctcttcttcagagcaatatttctctgatcacatccttttccttcctaccagttctgcccggggtttcgtgttgcttcccggattgtttggcaaagttaaccctcttcagggcacaaacgatcctaccgagtcttacagcactactcctgaccccagcagcacccccaaaagcatcctgactccatggagcgggagagcttatctcaacttctctcgaagcaagcacaggcatggccttgaaagcttttctcattctacaaatatttactgagcatgtattatgtgccaagcacagttctaaggcactagggatacagcactgaacaaaacaaagattcctgctgctattatggagttgacgattcttgctctgtaactcataaggcaggaaaagagacagtgcccatctcttctcctggaccctgcttctccccagaatcctggggctgatgttctggctgcctaccctaggaaggccacctacccacctactttttttcttttcattcctttttctttctttctgttttttcttttttaagatggagtcttgctctgttgcccaggctggagtgcagtggtgtgatctcggctcactgcaagctccggctcccaggttccagcgaatcttctgcctcagccttccgagtagctgggattacaggcacacaccaccacgcccagctaatttttgtattttttagtagagacggggttttaccatattggccaggctggtctcgaactcctgacctcgtgatccacccacctcagcctcccacagtgatgggattacaggcgtgagctgctgcgcctggccggaaggccacctacttttaaatcccaagtcttttttctttgcctagacagtacagagttccaaggtgggatagaaataatgatttttcttcagcccaaggagggctccagacagatgtgttggaggcttggtcctggcaatcacttctgaggactagacccagggaaagagaaacgggctgaagggccaccagttgggattctatctcatctctgccaattaccaacagtggaccttagcaagtctctttctctatctgggcctcagtttccttggctgtgaggtgggagacctactcttcctgtatctatggttgctgtgggggtcagatgagctaatgcatgttaatgtgctttgtaaactgtggcactccagacaatgcagggggatggggggagattatctggtttgaaggagacctggaggctaggtcttaccctttaagccctgggaggccccagtgcttgacagggatggggagcagcgggctgcagccatattcctctctgctaggcagggaagtcaggctttgagaaaacagaaaagcgctgcttctaatgagatgcctcatctgcagctcagagggtttcactttccccttcatcttgaatacttaatcctaatagtccttgagtatatttgatgttaaatatatcattttgctcagactcaccagcctcaggactgcgagcttgatctctcccctgccactgccgccagacccatgccctcagggtctgagggaggctttggcaccgctgccaccggcatatttggtgccagcccctcacacccaccagagctgggggctagacagtgtagcaagcacagggcctgacaggctggcaaggggcaacttcttgccgtagaaacctctgtgctactggaggcgttcactccatcggggctgcatgcagccttactactgacctccaggggcagattctcctcactttcaggggctggccctgacccacaaaccaggactgggctagctgtggccactcttccactctcttgtccacgagtttgtctgaataccagctcacctcagcctccaaggtacctaattggcagccacatgactggcatccctttggggagtcagggccctgtgccccaaacccagggactggagcaggcctggggtgctgagcaatgggctgcagaagcaggtagggcatgccagcaggggactggtgctgtgtgtgcccacaggtggctctttctgcacccccagctgtgagcatggtgctcccaaactgatctggagaggaaccttcacagcaagtcttggagggtttgggtggcttgagcttccagccaggaaggggcttgctgggttgacagaggcagatagaaacatcactcaccccatctgatggcctctctccactcactgggcaagcaagtaactcccacccccatactcgccccacccccatgctcaccccacccaagctgcttctaggtccagggacacgcccacagcaccagagtggaatcctcagatcccctggggctgggggaggtagttttcccccaacacattccacaggtgatgagcatgtactctcacttcgacaagccaagagtgctccaaaatgccctcgaaatgcctctgggaatggcagggagaggacaactatcaatccccaaggttagtttaaggagaaagtgggtgctactggctgtcttacaaatatctgggcaggtcccagcaatttgcccctccacctggcaggaaagtcccgaggaagagttcctgcattaggagtgggggtgggagatagtgggacccagggcctgagggcccaggccgactagatattacagaagtctttggtggagactgtcagatgtgcctcagccagagggcctgctcccaacacaatgcagctgcctccaagacggagttacaagctagccacacaggtgatgctcagagaggtattggggtgacgaggaccccttctctgtggccaccacagttgacaggacagagtaaacctacagacttcgcagtgcaatcaggatgcctgctggccatgttcagatgcccttcccttccccctgcttacacaaaagcagccaatgcacaggaatttgcaacccgctggagtgaagaagtgcacagtcggcaaacttttcctcttttggtttctggagagcctggacaggccttcttgcaagcagcagttatagattgttaggccttgtggaggcctaagccaaatctgcaccatagcaaagaaatctcccctacccctgcaccacagccctgagaaggttttgggtgtgcactgaccaactgtccaagtttgccttgtgactcaagggtttcctaggatacaggatgttcagtactaaaattgagatcgtcctgagcaaacaaggacaattgatcactatagtgagtggtggtaggatgggtcaagggactagctgggccagagaggaaggccaggcagccagaccctttccctgcagcccagaagttgcctctcaaccccaaaccttccagcctcctgccccagcacttcgtccttcaggcactaagggattgtcccagcctcggcggatggtctctgggtcagccagagctgtgagttcttccaagagactggcagtggaaagggtaggagttggacccagggatggatggaaattttgtgaggtccaaagcttactgtagtttgggcgtggggctctttaagaaaaggactacaagactactaataccaaattaccaccaaggacctggcagctgaaggaacctgaaggaccctaaacttcattagcttcaaggtaaaaccgcctctagttgaacctgatattttggactagatggcccacccacctaccccagccagcgtggcacctcccaacatgccaggctgggtgaactgatggcagttccctccctagccctgccaggggcggagacaattgtcagccatcccgcagctacggagtgccagaccgcagagacagtgctggtttgacggcaccctcacccctgcacctgcaggatctgtgggcacccccaccaccccgctgggatccgttccgcagtagggtgcggaaggggaacgtgcagacacccagagaggctgggagactggctggcagtgggcactgccgggaagcccgcggtgcgggtcgcagaggcgctccggatgcccgcaaggcggcaagagtccgtgagaaagttcccagccggagcgcgcagggctggcggcctcgttgggaccgggagacttcctaatcccgccgccgccgaagcccgggcgctgagcctggcaccgccgaccccggcaccggcgcacacatcagccgccgcgcttccgggaagccacccatcagccggaggaggcccgcgggtgctgagggctctgccgccgctagcggggtggactccgcagggccagcgccgcagtctccgccccacgtcccgcgtgcccccgggcaccggcaccgggcgccgggcacctaccgtcctcctggtccaacaccatggtcccgacggctccagccggactagcgccgaggatacggaggggcgcgtggctccgactcccgccgccggccgcctgcgctgctcccgccggccccgcgcgggcgccgagtccggagagccgcgaccgccgacgggggcagacggaccggagtccggagcgcagccccgcgggcagggagcgcaggaggagggactggggggaaggcgcgggggcgagacggccaggccgggatcgcgggagcctcgcgagcagcagctgcccgggccgggccgcagccggagcctgagccgcgcgcgcgtccttcctccgcgccggccgtactcgcctcagcagagtgaaggctgcatttcccagggcccctcagattcccctgttaattaaatcaattcattatgctcagatctgattagcggcccttcccccccctttgaatcaattattcaatacacaaacataattgcttgggccagaggtgcccgccattagcttatttaactccaaggacactaattacccgcagggcacgggaacttttctcattaattctgacaaaacacaaaagcacagccagagtgtgtgcgtgtgaggggctgtgtgtgtgtgtgtgtgtgtgtgtgtgtgtccgcatgccagagtgagggctgtgtggggtggtgagccactgtgtgagctcaagacaagggtgggggtgggacgcgtgcgattgcgggtgggtgtgtgcgggtaggagtgtgggctccgtgcctgtgattctgaatgagtgcgccaggctgggcgtgactctgggtctggggacagtgggcctggactgggacccggcacaggaatgtgtatgagatcgcgagagtgcttctgtgtgtgactttgtgaatgtgactccgtggctaccgtggcaggcgccccatcccctttcttttttcattattgcccagccattccccgcggcatgctcagccccacgggggaaagtgcagatcacagaggagaaatccgagaggatcaggaggcggtggtgactctggacccaggctgggccacagtgctctccatccggtcacctgttcaggcatcaactgggctttgctctcccccagttataaaccccaggttcccaccaccaccacccactttgccctctcactgcccctctcaataccgcccctactctcaacttttatcccaaaaccctccccaccccacccttgtgcccgggaacccccaactccacccaccctagacctagttcttcacctcctgtctcaaggctgtaccgagggtgtgcctgtggttgatcaacttctccacattttacctcccaggaaatctattgagagaaccagtgagagagcccacagaggcaggacacagagggtaattgattcccccaaattaggtttctgctttctaaagaccggcattgtccctattctcaatgtgcacagaggtattgaagatttcctttttgtttcctcgggcaatgaatgagcttaatccatttggctttataaatcaggaaactaatattcgctccctccatagcagctttttaaaaaatttaattggtaagggaggtgcagttagtcacctttatactgtccccaagcccccacttatcaaaacacattctgattgaggggtagagagaagggagggagctcatcctgattcctcccactctcttctatcctcccaaacagacccacatagtatctgggaaagtttgtgaaatgactgcatgaattatattcaatttggtgaagaaaggaggactgtgcagagagattcttcagaatgatctcccaaatcagctgctctcaattccccaggagtgactgcctagatgggtgttggctattccatgtgctaaggcgtcttgtcaaagagcaagtagggcctgaaattctgcatccttccaccctccaagccatgtagctggcacggactgcacccacccagagagggcaccttttgctacttcgcacaaaagcaccatacagactagcggggccctgcaattgggcatctctgcttggccagagttcacactcagagaagccagcctgaggcataagcacccagactccctgttcccaccatcacttgcagcaagggcctgtgtgagcacttaaaagaccagcctcctggttttcatagagagaaagagaaatttcagagagtgtaaacatcatggagtgatcagggataatgaagcagatgccccgccctatctctgcatttatatgggtccccaactcctggtgaaagacactgaactcagtccacagctgggtgaatttccctatcagaaaacagattgtctgagtaagttaaaaataaaatacagccaaatgctgtttacaagaaatactcccaaaacaaggtgacaaagagactgaaaatagagcaatgggcaaaggtataccaagaaaatgcaagcagagagggagtagaaacagcaatattaatgtcaaacaaagccaacttcaaagctaaagttgaagggacagatctatcatgaggactgagatcttcagcaggggcctgctggcagagagacaatgaggttcctgagaggagatcctcatgggtggactagactgagaagcaagaccaggagtttagaggaagaacagttccaagtatggtgcaaggtggggcctaactcacccctgaccatcactctgagaagaagagggcagtggtgcaaatgagaaactgggtcactagaagccctgcagcctggctatgggagccccctctgaaacagctggtcattagaagctgaggtgtcaccttgctgggccaagaggaaaagagcagctgggattagcaacttggtggcattaacagcagctcgggcaagatggcaagagcatcaggcagcagctctaattatacagacggcgtctcttctcataatccatcaacccccatctcccaaccctgggactgctagagagaaaatgtctatccagaactcaaaatctagtggtgtccagagggcacttgggtcacatgagtaagcattcctaggtctcacaactatttggagaggaagatcctggagaggagaattggaacatcagaatttggggctaattactgtaaaattgtgggatctggtatttggcatttttatgcctttatgttccaacctgtcttagctgcatgactggcatgaagggaaaggctgtgtgagaaagaatggaccagaacaataataggggagctgtccctggtgcaaccgccagcttttcccaatggcggtggaggtcagtatatcagtatgttacactaaacatgaagagagtgaatttccctatcaaaaaacagattgtctgagtaagttaaaaataaaatacagccaaatgctgtttacaagaaatactcccaaaacaaggtgacaaagagactgaaaataaagcaatgggcaaagatacaccaagaaaatgcaagcagagagggagtagaaacagcaatattaatgtcaaacaaagccaacttcaaagctaaaagcataaactgcttgaaaattaagaaacatcccattaaattagtactggatcaaaataagatcaaaacagaaattaccaatctagtaatgaaaatagaaaacacagcatatcatacagaacttacggaacacagctgtactcagaggaagaaatatagcctcatatgcttgaaatattttttaaaaagactggaagaaaatgaactagatattcaatctaagaaattagaaaagaataaactgaaccaaaaaagtggaagaaaattaatgaagtcagaaaacaatgaaatagaaaataaacaagtaatagaaaaggtaattaaaagggaaaattagaaccaacacttggttatttgaaaagactaacaaaatggaaaaaaaacttccacgaaaacctagttaagaaaataaagcacaaatatatgatattagatataagaaaagagatatatcacaggtacagagaaggttaaaaaattataacaataatatgagtaagcctatgaaaataaatgtgaaaacctggaagaaatggatgacttcgagcaaagtagaaaattatcaaaactgagcatagaagatgttgaaatcccaaataggccaataaacagaatacatttaaaaagatattaaaactatgccattaaaatatcacaaggcaccatatgctccaacaattctacttctggaaataaaccaaaagtattgaaagcaggttctttaagagatatttttacatccatgtccatagcagcattattcacaataatcaaaaggtggaagcaacccaagtgttccccaatgggtgaatagataaacaaaatgtggtagatacatacagaggaatattattcagcctttcaaaggaaggaatttctgacacatgctacaacatggatgaaccttgaggatgctataccaagtgaaataagccagtcacaaaaagacaaatattgcttgacttcatttatatgatgtacctagagtagtcaaattcatagggacaaaaagtagaatggtggttggcaggggttcaggggaggggagaatggggaatttaatgggtatagcattttcagatttgcaagataaagagttctggagattggttacccaacaacgtgaatgtgcttaacactgctaaactgtgcacttaacaatggtaaggatggtgaattttatgttatgtgtattttatcacaattaaaataaaaccccacaaggcacagattacattaaaatgagttttgtataacctgaaaaacagatgattttaatgttatttaaactattccagacaaaagaaaaatttggaaagcttcctagtttgttttatgagccagcattttcttaatcccaaaccttataaagattgaattttaaaagaaaaaaaattcacagaacagcttgaataagagtgcaaaagctgaaataagatattagctatcttgacatgaaaaaaaagtatcaaaagaataaaacaccatgacaaaggagggtttattttaacaccacaaacatgattcagcataaggaactctatcagtatgagtcactacatcaacaaataaaggaacaaaatatgagtatagtaatatatgtccaaaatcatttgataaaatttagcatatattactaacaaaatattaagcaaaatagaaatagaagaaaactacttcaatttgttaagactgtttaccaaaacccaaaagaaaataaataaatgtgacattctgaaactatttccataaattggaactaagacagaatatccattatcattattattcaacattttttgagactttaactcaataagacaagaaaatgaactgcttaaaataaacagctgttttttgaaaggacaaaaatatgtttatttacaaattatgcgattatataaccaaaaatccaacaaaatttagtgtgaaagttactagaattattagataattgagaaggtagttaaatacaagataaatagatagaaagctgtagtttttttctaaatgcaatgatgtgttagaaatggcaatgaaatagaacatttgcaatagtgacaaagcaaatatttaggaataatttaaaaacaacaatcatcacaaagataagggtcttctttaaaggaactcatgaaagcatattgaaggacatataacaagatctggatatatagaaagacaaccatatttctaaaaaagaagatattatcataaaagtaaatcctttcaaaattaatatatcaatttagtgcaatttctattagaatcccaaattaaaaatttttagaactgaaaaaaatttaacttgaagtgcaattaaaaagtaaatatatgtggctagttaacaaaacatgtgaaaagaaagactaattggatacaacttgcattactagataataaagcatactacaaaactaccataatcaaatagtgtggtgtaagtcaggaagggagaaatagatcacaggaacaaagagacaataaacagtttcaagtacagaaaggaatttaatatatgataaatgttgcattttaattcatcagagaaaaattaataagtggtagtgccatctgaatagacatttctgcacaggagatatacaaataaaccaatagaatctgaaaagatgctcagcatcattggtcattgggaaaatgcacatcaaaaccacagtgagataccaattcacacccactaggaagctggaatgaaaaactttagataacgaatgttggcaagaacgtgaagaaattggaaccctcaaacactgatggcggaaatgtaaaatggtgcaaccactttggaaaacagcctggcagctcctcaaaaagttaaacagagtcacccataaccagaaattctgctcctaggtgtacacccaagagagctgaaaacataggtccacacaataatttgtatactgatatttatatcagcattattcattacagccaaatggtgggaaaaaaaccaaatgttcgtgaactgacaaatggatattattcagccataaaaaggaataaagtactgatacatgccataggatggatgaaccttgaaaacataatgctaagtgaaagaagccattcacaaaagactgtattgtatgaattcatttatattgaatgtcagaatgggcaagtctgtagagacagaaagtagatgagtcggtgctaggggctggggatagtagggctgtgatagctaaggtgtgcagagtttctttttgaggttataaaaatgttctaaaattgtggagatttgcaaatctgtgaatatattaaaatgcattgaattgtacactttaaatggtgaattgtatggtatgtgaattacatctcagtaaaggtgtttcaataaacggtgctgccataactggttattcatctggaagaaacaaataggatccttacctcccctaaacataaaaattgtgttccaagtggcttaatattttaaaataagaataaaacattgaaaatattggaagacattttattagaaaaatttaatagatttggataacaacatgaataaatttgttgcggctaacaaaggaaaagataaatatactaaatctgattttcagaacttctatggcaaaagatagcataaacaaaagaaaaatacaaatgatttcttaggaaaatatttgcaaaatatgctgtatatacaaagaatttctataaattgtaaataaaagacaaaagcctaaaagaaacatggaaaaagagaatgaacaggccattcagagaggaaatatctaaatggtcaataaaatgattaccctcattattcattgggaaaatgcaaactaaagcaaaataagttttcattatttaaattcattagattggcaagcaatttttaaaaagtgaaatgtccagatctgctaaaattttgagaaaatatgtactctcctttgctactgagcaagtaatctggcacgatctattacttttggggcaggtaatctggcactatttattaaacaagtacatgccttttgacttataaatcctctttctgggactccatcctataaggggaaatcacctatatataaggatcctaatttcggcattgtttgtggtggcagaaaactggaaaccatacgaatatcagtgccaatcaatgattgaattaattgtcctacaactctgctgtagaatattatgcaactgttaaaaatgagttagagcaactgacttgcaaaggacatctgtgatgttctgtttagtgggaaaagtagattgcagagtatcaagtaatattatcccattcaaaagaaagcctctttctgttaagatgcacatgaaggaaagatgtgaaagcctgcacttgttcaggctgtcaacactggtgaccttagcgagtaggaatggaaggtaagagtgaaggaaaaagtatacactgagccaggcatggtggctcacacttgtaatcccggtgactcgagaggcttaggagggaggatcgcttaagcccaggaattagaggctgtagtaagccaagatcccatgatcataccactgcaccccagcctgggcaacagagtgagaccttgactcaaacaaaaaagtatacacctatcttttcattatttataatgtatgagtaatttatacttttttcaatttagaaattaaatgggagttgtttttgacacaccctccaatcagtcactgctattgccctagtccaagtcgccatgatctcttgcatactgccgcaagagctccttactggcccccacccaaagtccaccctgggcctcaatgatacagcctctattactccatgcgcagccaggagatatttttaaaatgcaaatcagatctcgtcaaccaaccctcaaagcttcctgttgctctccacagcaagcccccatcctctctctgcatgtccacttggctctgtatgagcaggctctcctgaagtgtctcccatcactgacacccacccttgctcctatgatgtagcattttacccttgtcattgtctgaaccaccacttgtctccaggcctgcaggagcaccatttttttctgcctgaaatgttcttgcccccttttatttggaccacctcgtgttcatcccttggatccaggattaaatgtcagggtggcctctcccctcaagactaggttaggcctccctgttatagtctgacatggggccctctgtgcttttcctccatagctcttatcacaatgatctagttaattacatagttatttgtataattatttgtgtgacagcgataaaagaaaaactattaagctataagtgtttgcatcttcttctccagcctcctaccttgggagaaaaacgggtcagagaagaaggtctcaggggtccaatccaactcagatattctgaacttactcttactccatacacctgccaccctagcccctgttgggagaatttgcctggctcaaatatttccctccgttctttcatttatgtagccaactagcttgctctgagacttgattatggcaaaaacgtctgaggtgctgatgagctttcaggcttccccagccagctgttgtagggacctctccccacctccaaatggcttcatttctgcacctcccacctttcagagacccttaccaagggggctcctgggtgcccacagtcccctctgaggctacgaataccccagcaaccaaaccccacacagcttgacttgcaatgtcagactctcaatctgaaccctgattttatgtgactaggggtcgtctcctccctctcccaccctcctaatcacctgtccactgatgactggagacctggagtgatcctgggctgggtctaaggggccagctgtgccacgtgctctggaggctggtgctggtccgtgagcttcatggacgccaaccgactgggccatggggctgagcactgtgactcactcccagaaaacagactgtttcccaaccggctcaccagagtgaacacacccacatgcaggtggtccccttggagctacaaccgcatgtcccaacagcacatgcatctcagaaacagtccttctccatgctgcaggcaggggcccaggtatgtgggactgatgggagggcactcctagtccccttcctggtctctctccctcaatctctggtggggtcttcctgccccacccctgccccatgatggaaaaagccaaaggggttccttctcacccagcatccaacctgtctgagaggccctgccaactccaaaatgatacaagtttggaggagaaaacaaaaacaaaaacagaacaaaaaaaccctggaagcacatattcctccatagctgctgctacctaggacttgcctgggcttctccaagcccctgtgctcaaacaccccttgcggtgagtcagaaatatttgagtcctatcaggactggaggtcacagctaccacctggggcttgtactagattgagccttctaaagcctgggggaccacacctggggacaggatgctaattcaaaccctcagagcctgcaggtagaagtggagctgcagacttgctggtgacactaggcctagatcgtgattctgactccacttcttgcagatctcacactgtgtaacttccccttcctgagtgtggcagactactggtggcatatccaacatgtcttcccttcctcctgggcacatggcactggagactgtatttccagcttccattgcaatggctatagataagttactagttctcatttgtaggcagaagagagatataagctattttcacctcttgcttacaaggggagagacccaagttagaccaatgggtttccccagtaggagttttgacatcggaacccagagagctgggttggtttcttctctttggtggctgaagctataagatgtaaaagtcaagactcatgttgtctgccatgtagataaatttgttctggggaaagacaaagactataccggcatgaagaaacaagttgcttatccacagcttcctatcttccccactttccatagatggaatatagatattagagcacccggatttgattaatcaataccctaaggtatgcagagaaataagacagaaggaagctgggtctctaagtggccttgtggagtagccctaccaacctagactttttatctcctgttatgacagataaatgataaagttccatcttctttaggccattgtaacttaggacctctttgttatagtagcttaacccttttcctaatgaatacattgatcctctgattccccaccaataaatagtctgaatgtgttctccaagttccaagtttccaattctagactctgctttgccaggctccttgtttccaaagagcttcccaggatggaaacctggagccaaggttgagccttgatgtgctccctgctttctccttgtttcaagaagttccctgatgctcacgaaaggcctgatcctgggagagatggaaggaaggacatgaagaagcatccgaagttctttctttttggctggaccagggagctaagggcaggtggattaggataggctactgcctatgtctaaggctgcttcatgttcagggcctccagttgagcccagatgggtatttatcctgaccttacgtttcagctcagctgctccaactgtagggaatctggcaaggctcacccttcactctctctttctgctattgtagaccagactctctgaaactaaagatgtggtccaggcctatggacacaaaaaaaggtctgggggctgctttttccaagctctacctcataggaccacagatgggtccctggctcaacaggttaggacctcctactttatgccttccttgcctgagggtcctagcaacttggctctgcaactcttagaataatgtgataacacccaaacctgtgccccatgggacggcctccgagtccagtctagcccagcctgaccataagcatttccctagaggtgatcttaacaggagcttgggagctggaagctactggcctagaaccaattggtctaggataagcctagacctgctaaggccagcagaaccatcacaaggagtgcaggtggggatgaaacttctgcttgctagtctggactgaaagcctcccattctccttcatgttcctcttgttaacaaccaacactgtctcatgtatcctaaggccaggtctcatgctgggtgccaaggttcatggtcactgtcttagttcattttgtgctgctataacagaatacctgaaactgggtaattaataaagaacaggggtttatttcctacacttctgggggctgggaagtccaaggttgagggcctgcatttggagagggccttcttgctatgtcatcccatggcagaaggtagaagggcaagagaacacagtgaaggagagagagaaaaaaaaagaggctgaactcatcttttataagaacaccgctccctccataacaaacttactcccaagataacagcattaatccattcataaaggcagagccctcgtgactaatcccctcttaaaggtctcatctctcagtacggtttcattggggattacatttctaacacgtgaacttttggggacacattcaaaccatagcagtcactctaatagacaaatatggaattgtctgttgagaatccctcctcccccaccttctaagtacttccccctacccaattactctattccgatgttcctgtgaaagatatccagctcttacacaatcttacccccatggccttttggaccctgaagtgggcaactgatctaagttggcccagtgggttttcccactaggagttttgaacttgggaccaagggagttgggtttgtttctctctggtggctaaagttataagatgtaaaagtcaggccgggcgcggtggctcacgcctgtaatcccagcactttgggaggccaaggcgggcggatcacgaggtcaggagattgagaccatcctggctaacacagtgaaaccccatctctatcaaacatacaaaaaattagccgggcgtggtggcaagcgcctgtagtcccagctactcgggagactgaggcaggagaatggcgtgaacccgggaggcagaggttgcagtgagccgagatcgcgccactgcactccagcctgagtgacagagccaaactccatctcaaaaaaagaaaaaaaaaaaaaagatgtgaaagtcaagactcgagactcgtattctctgccatgtagataaatttcttctaagccagcatgaagagacaagtagagatgggtgacagacatagtccaatagtgttttgttgcctaattctatttttttctgaagaccagcccctttcttgcccttctcttggctcggatgttctgagtaagttgggtttctatcacttgcaaccaaaagaaacccaactaacatataattggttgtggaaggcataaagggctccagccttaggcagacacatgggaactgcaggcattccaccaagggaaagcatttggctagggaccactgagggcctttataggagcgggcactggaagtcctggagactatgcacctggccctgctcagccttctgtattctggtacagcatgctaacaaagcccaacatttcaaggccttccaaacatggctcccttcctttctctatattgccccttccagaattgcacagctttagccatgtcagtctctgacttccccctgccatcctgtcctccatggcttggcttcatctgtcttcctctaggtaaacttctatagtgattcgagtcctcagtggtctccgccatttccacacttccttcttggaggaaggacccattttaggagccagcccttatgatctcagtacttttcaaattaaatatatatatatatgtgtatatatgcatatatatatatacacacacacatatatatacatatatatcaaataaaaagtgtttcccaaggaataagttaactcaagtctggcacacagagagtgtgggtaaatagatggatgaatggatggatgggctgaaggatagtggaaagttaaacatttgggaaattgataggtagaagtggaaatccactggaaagtggattggtattagcagacacagatgggctattcaataggtaaataggaagaatggataggtgggtggctggatagatagacaaacgaacagatagatggatagatacatggtgggtgggtagatgggttggtggatgggaaattttaaagaaggatagatgggcagatgggtaggtgggtagataaatatttgagaagaaggtggctggctggatgaacagatggttgcagaggtattagattgagaaataaatggatgaatggacggatggatgggtgattagaaccatacaattgtaccctgaattatgaaatgccttcacattttgtgccctgcctgtctctccgtcttattctcactcagctctcacatgtttctccactccctgggccatcagcatctgccctctcctgctgctagatctggcatcccacctggccccatgctccctccccttcagccaaaagtgagtgcagcaggccctcagaactccatgctaggaagtattatgtgtgttagagcatgcatgggtggaggaaaagaaagtgtggccggacaaccagtaatgtcccttctattatggctattctgggtgctgtgactaagccatatgccatggtggaagggacagtgcccccaggtgcctgtccccacactcaaggacactgccaagtctaagcttcatggtctaggcccagaaatggctcttatttcagcaccctacactccctgaccttccttgtcacctaataaaactggcaatggccactgagtgcacaagagcacctcccctctctcctcccctcttctgcctgcggaatccttcagtcacgaatcactccctgccccgtcacaccgccaccaccagctctgctcccctgtccctccgctcggtggcctgcggagtcggcacagggctccctccctcctttctccttccgctgccacagaaaagtttaaagcgctcagacaattaatatgagagttgccagaaatagacccactgcataacaattatacagaaaaaaaacctctccccttccccacatttaatccaactttaatcctagtcattaggaattaggcatgccgagccgtccggctgtgcttctaaattacaatcaaacagttaccaattacacaaattattgacggtagattctcttttcaactgcaaattaaggctattaagaaaggctcctttttaatgcaaaagtgactaattaaccaacggctgggaaatctgcagcccagatatcaaaaaagtgctccgtgcacattgcggaaacacaagggaaccaattagtttaattatcaaaacagctaattaaaattgcacagttcctaattagttctttgcttttgcctctaattgacagcatggagataaatgggctggcagcggggagaggagaaggggagcacaggaaggcaggaaacttcggcggaatatttatgctgactttatctccgtctgggtgccagcccttgaaagtggaaaattaatgaccttaattcccaaactggtttgcctggagctgtgcacacggcccgtcccctccccccagtggccgggcagtcccagccccggccccagccccagcccacgccggtcgccctcgatctggagtggagaggggctagggggtgggaagaggcgggagggagggcgggggaggaggcgaggggcggaggcggccctccggacgtgacagctcccacttagcctgaagagacatgaaagaggcaacagatgccacttcaggagcagagcatcctgggagcccagccggcgtgcttgtgttccagcgttcaaacccaaggggggaagaaaacggtctggctccgtctctagcaccctcccccacagcccccggggcccggccccttccgagtcctgctgcccggcatgtccagacctctggcatcaccaggccccaggcctgcgttcagcttcccaagcccagggcccgcacaggtctgcagggcagcattaggaagaccccagcgggaggaggctggtcttccatcctgggaacagggcagctgcttctgaggggcagatgtgggcgctgggcatttgggatctgaccacaggcctaattaaggcagtgtttcctgaagccacagccacccacagccaagtcgattgtactgctttccccttagggtggctcctgcaaggttcagttctcaaagctcttgaatggaggctggggccagtgagcgtctctggtttctcagggcctagaagagatcccaagcactgctgtcgctggaacccagtagctggagagcagacctctttccctccctccccttcggaaggagcccagtgcataattcagggaatgcataatgcatggattccagtgtggaacaacttttaggtgatttgtaattagatttctgctatagagtctgcttcataattagaaaaagattacgtagagcttcctagattctagagaaggaaggaggcagggtgtgtatgtatgtatgtgtgtgtgtgtgtgtgtgtgtgtgtgtgtgtgtgtgtgtagtatacaatacatagtacccttcctggttatccctcagcatccctcccatggtcccacaggctcccacatacccgctctgtgctggtctttccagctactggctgttcttggagcctaggaagttagttcttctgccccttgcaagcctttgcacaggctgttcccactgcccagagtgccctccttctcctcctgcctgccccagcctggctaagtcttacttgcccttcaaggctgcactgtgttatacctttccacgttctctgtcttctttctgtcctcagcctgaccacttggtcttgcaattatctgtctacctctacatgtctccctctcccatcttctcccccaagattgtgggcaacttggaaataggaactgcgtcttcatttctgggtccccagtgcctggcttaatgccaggcacatggcagacacttagtgagttttcattcacttaatcatttctcaagcacccagcaccagcaacttcagagagacaatatagaggagtagttaagagtgtggccacctgggttcaaatcccagctctcccacttattagtggtgtgacctgtgtgcccttggacatattacttaacctttctgggcttcatcttccccatttgtagaatggggatcattgtggtatctgtctcttggggttgtcttgagaattaaatgaactaacatgcatatgcaaagtgtttagagaggcacctgatgtcaacatctccatagatattccccttggccacgccctgtgctgggcactgggaatctcaagacgaagacccagtgactatacctggggaactcccagtgtgtgggtgagggactatagggccagagccctgtcagctcaggggaatgggtgggggtctgccctcaacccttgagagtcccatcagcagccatcatggattgggccttgaagccagatagcctgggttcaaagccctgctcatctctgcggccttgggcatgtcattcactcctctaagtcctagtctcctcctctgtgaaacaggaacaattagagtgtaagaggtatatgagttcctggtctctggaaacattctccattgaaatgccagcatttattacaataggtctccaacttgaggttgccaaagggtatgaactgggctagggggtgagctgcttgcttcctggtgtgttaggtgaggtgaaatccaggaagaatctactaaagggccatgtgagggcttgtgggcatcctgctcagaccccaagttgatgggtgcaggaatgtctgaggtgcagggaatgcatgtctgtccccatctatccctcccgcctggtaggaatgtccctgcttgggagaacgaggctagacattcatccttctgagctgttggaggccactagccccacccagaagcagcaccctcaggcctaagggcagagcaggagcaggagaggaccgcagagggaacaagggcagaggttcatggaaggagaactggtcaaggccttgggaaaatccaacttagtagagagcatggactcaatcagatttgggtttgcatcctgaaggggcctcttattctgtgtgccttaggagagccgacaccatggccctgccattcttgggttggttggaggctggaagggacaatgtccaaggaagtgctttgccagcctcacctgcatcaggctggaaggaggctcctctctccaaaggggaacgtcacctcaggaccttcagagtttctcttgtatctcttgagcctgtctgacacaaaagcaaaccgtatcagtcctgccttcaaaatatatgcagaatccagttgcttctcactgtggatgccctaagctaagattccatcatcctttgcttggattgttgcattagtttcctgcctaccttctcgcatcttctagaccatttcacctagcagccagagtaatctttttttaattttttgtttattatttatttatttatttttgagacagtcttgttctatcacccaggctggagtgcagtggcgcgatctcggctcactgcaacctctgcctcccaggttcaagcgattcgcatgcctcagccttccaagtagctggggttaccggcgcccaccaccgcacctggctaatttttgtatttttagtagagatggggtctcaccatgttggacaggctggtctcgaactcctaacctcaagtgatccacctgcctcggccttccaaagtgctgggattacaggcatgagccaccacaccctgcccagagtaatcttttaaaaacaggtctcatcaggtcattccttaatggcttcctgagtctcacagagtggaaccagaagtcctctccagggctttatatgatcttccccattcctcctccctcctccacctgccccctggccttgtctccctcctaatctcctactagctaactttgttctcacagacaaggcctcctggctctcccccaaatatgccaagtatcctcgtagctcagggccaccaggctttctgttcccactgcctgctctccacactctgttcctggacccatcacttcatccaggtctgtgtccacatgtcccttatccaccagccctccccgtggtgactgtcctctcctttgctatgtaattacagtacttatctttactcaaatatttcagagtagttacagtcatagtattagagtgtgtctctgttcactacatggaagctctatgggaagaactatgtctgttttctccctcttgcatttccagcccctaggacagtgcttggcatgtagtagatactcagtgaacccctgttggctacactgagtttggacaccagggttcagtgaggcgagctccctaggccgtccgagcaggataagggaggaaggactcaagccggccttgtttgtgctgggtcttgcacacagaactgaaactctgttcatacgaaatctggggagtggcaacaggccactttccagatgtctcatggccaggcccaggaggctcctggcctggaggtgcattcattcagatacagtctccacctgttgtgagagaaggagcatgttcagggctcttggctctttctctgggatgtgggggcaggtgccaactggaaccctagagaaactagatctgttcaggaggctggtgacagggggaagaagggagtctgttacctcaatgaaacacagggactctggttttggctttggtcctggcttggccactaactcaccctgtgacttaggcaagggtttgtcctactcctgggcctcagtttgcccatctctgaaatgggcagttggatacaagaagctcaaagagtagctttgattgtgatctgccttacaaaagaggaaactgagctccagagaagtttggcaactagcctaaagttatgcaacatctgtaataaatgtcctgggtatggatttatccctggcttatttgctacttcccactagaatggaagctcctgaggggaggggctttggctccaggcccttgactcccaccttttcgtcccctggcacacccatgttcaagtcccaacttagctgatcttttctcaaatctagacttgtttctccaattaggcattgagcccctctgggcaggaactacagaagttttctccttctcccagttcttcagaatgagacagctagcaggtgctggatgaaggcttggtgaataagagagggagtcaggttgcccaaggccacaaaaggagatggcagcaaagtcaggatccccatcaggtcttacttgtttccctggagcttccagatgccaggattgggctctttcattcattcattgactcatccaaaaaatattcaccaagtgcctactatatgctagttgctgctggagtgctaggaatactgcagcgtccaaccacgcaagggccctgccctcaggagcttccattccagtgggaagcagcaaatatgccagggacagatccatacacaagacaattggagattactgtgacaagacctgtgaaggaaacaaaacaaccaggcagacagtgatgctgatttagatcaggttggtcagggaagtcctctctgaacagccgagatctacaggacaagaaagaaaaccataccaggcagagggaagagcaaggaaaaagaccctgaggcagggaggatcttggggtgtgtgtggaaaggaaagaaggctggaaggtggtgggctatgtggggagctggggacgtaggcaggggctagatcatggcccagcgaagagtgtgcattttattggacgtgagatgggaagtcattgggcaatttgagcagaggattaaaatatgtgattgacatttctaccgaccactctgaccctggaacttcttgctgttgccagctgagtagtcacgggggtctgtggtcccggctctgggggaaggaagcctctgctcccaggaagacagaggttgtgggtggctggcagagtctggggcatctcaccagagcactgtgcctcagattctggtccaaaggtgcccagcctgcgtgccaaccccatgcccagcatcctactaacccccgcacatcccaggggtattccagaaaaccgcgcctgcaagatgtctaggcccccactccttgattatattaatgccaaaatgtattaaagaagcgtggtaaaaatgccattctaattgtttcgtatacacgccactgggagggaactgattggacacagctcacaggcagtatgttaatacgctattttcatatgatgatagctttgcataatcttcccttctcccagctttgcagggacctgttgttaaccaagccccaggagagagggggaaaggcaatttgacttcaagtccactccccaccacattaattagtcatgtggctggggaaaggtgtgctcactcagtacaaagtagactttataatttatacaccagctgtttccgtccattctcctctctgcctgcctctaatgaaatcgtgttaccagagaactgactggcgtgaattgagcctttaatcccattgaccctggcctggctggaagggcccaggggaggggggctggggcttttcagcaaggggctgcctcccctccaccccaggctgcaagccctcacaatggagcagcttggcaaaggcagggggtgctgggagctgggggcctgcctggctgagcagccctcttggggatccctggagactgggatggctcacatttattgcctcatcttctgagatccagcaaagcacaacattctcatctaggttgttcctttacttagagaacagggcaggccagactgtacaaccaatgagctaatgcttgcttttctggccatgggggctgctgggaaaacagaggcatgattccatggagggaaatgctgccctagcacccagcagcacacctacattcttctgatccacagcagagcccagggccccttcctggagaggaaggacagggcagagatggggacaggccccagtcctgcttgcggtctatggctccagaaagacagtgctgagaatcaaggtcagagaatgcttctctttccctaacctcccaccccactcaaaagaaaaacaagcaggaccaggaggcatccagagccactcagccactcaagcaaatgctgcaaagcagggtgcatttggtgagcaggaataaacacagcaattagcaccatggcagcctcttaaacaacctcttaaacaaacacatgggaccaagtcaggggtgggggaggttcatgcatctgttggaagggccagaggctacagagaagatttgatctgagggaagctgaaaataaggatggtgaggctaagttgctgggactgggcccgatctgagggtggtgacagagataggatcaggtgcttgagctagggctggaatgctgctagagtagtaggtagcgcaagggtggtacagggacgttgatgggatggggtaaggtagggacaggctggcttcctggctgccatctttaatttactgggaatcccaatatcctcatgtgaatgtgaggtctccgcctaggaaggcacagagaggtgagatgcggcatccccagccacgcttccagtgggcgtcctctacccaggcccagatacactccagaacctcctgcccattgctgggcctctgctctcacctctcccccatctggaatggcagctctctcttctgctaaatcccaggtcctttaagactcagaccttgtgtcacctcccctagccaggctttcttgattccccaagttcatctgtgctgagctcatcatagcccactcctcgatagcaaggatcatctctgcgtcccttgcaccaagcacagggcaggacaactgaccttaagtgggtctcctcccttggccagtcttcagtttactgatctgtaaaatgggtttgctgatctatcagagtcactctggttgcctgagatccccagctggattctgtcaggcctaaaaccacactctctcccctcagacaaggaagggaacatttcaaagacacttgactgtgttgtgggcatccaagctaatttattagctctgaaatagccaaagtacttcttttgcttaatggcattaaaaagtaacccacacacctgtgaccagtcctctttttaatgaaagtgtggggaacatcaggggaacctatccagggagggaaaatgaagttgtcatttttcaatgtaattaaacttggttttcaaaaatctcctgatctgaaatgtgaattacgctaattacttctggtggctgcaacattgatttcagtgttaaagttaatggacttaatggactctgcttttcccttagatgtggcttgggcctcttgccgaaggtcctgtttgcccactgcgaggggcctcctctggaccctctaaattccctatcaccagcttctgttgcccaaggcactcatgggttggttgccccaagtcaggccttgtctctgggcatgaggcctcaggagaacaattgctctttcttcctttcagtgaatgtgggtcagacaccagcctcacagagtttggtcccaggaggggacatagagaaggaaaaggcaggtggcccctgtttccggagggcaggtggcctggaggaggcctgataggaacctgtggaagacctcaggcaggcagggctgaggtttggagcctgaggctttctctgcagtgaaagcatccagtaatggctggtgggggtgtgggagggtaggagcaaagagatggtggaggaggccagggagacctgctcccagaggagggctgcaggagctggccaggaaggcagaaacaggtgtgggcaaggcagggaggtgagcccacagggtcaagaggagggctgggcatggccaggctgcagagttctctctgggcagcagtggggatggtaggggccttggagggcagggcaagcaatatggatgtggtcttgagtcttggccagaatgagatgaagccccggtgtgactgtacaacctggaagctggaggccctccctctctcagggaagactgcttccgagggccctggggcaggccggggtcgtgggtgccgcctctgctggctgacctggccccttttctgagtgcctagagttcctccaccaacatgtcttcttaactgggaatcggtgtcctttcctgaaggcgtcatagaggaagactttggtgtcttctgaccaaagggtcacaaagtatgggaccctagcagtcctgagcgcacacctgcctcctttacagatgggacctgggtggtgccagatgttagcccctaggggaagagggcaggctccctccaggatgcagccaccaaggacacggtgaccaggcagagccgatcacacgtggggaagaaccggccagagagccctttggcaggaacctcaggaactgaggcaggaatgccaacgaatccctgccccaatgggggttttggccgccgagacacatccccacattgctgccaagagacctgggtcctggggggctgaccctggagattgggggtggggtgagggttgggcagcctggaatggagggaagggcccaagagaaggaggcagggcctccaggggtggaacacagatgtcttgaagagcgctgtgggaggcgaggtgcggtggctcatgcctgtaatcccagcactttgggagaccaagacgggtggatcatttgagatcaggatttcaagaccagcctggccaacatgttaaacaccccatctctactaaaaatacaaaaggtagccaggcgtggtggagggtgcctgtaatcccagctactcgagaggctgaggtgggagaatcacttgaacccgggaggcagaggtagcagtgagccaagatcgcgccactgcacttcagcctgagcgacagagtgagaccttgtctcaaaaaaagagagagagagagagagaacagcaagagatgaagctggccagggtcagagtgagagaggccttgactcccgaacagaggagtgtggacttgaacctgtagagggtcctccgggcaggggaaggaaggacctgcctgagaagaacaccctgagggcagaagggagagtgatgatgagaaggcagctgctggaacccgtgttcctcgcaaggagggcctgatctcatttctccacctctccctcaacctcccccatctgactgttaaccatattcacctcacacatttctctcaaatcctcccagttctccccacccctgcctcttaccccgacccctcagtccagtcaccttcatctctctcctgggttactgcaaaagccactctcccggcctcagggccgccctctgtatcccctcctcccaacgccagcctcaatgagctttggaccaggaggtctgacctgtctctccttttttaaaaacagtagtgactaacactcatgtagtgcttgccacaagccaggcacttgcggcaagtgtatgactcttgtaggtgaatgcactattttgaacctagccacaatcctatgaagttgacactcttatcaatccctgggttacatttgaaaaacagatcctgagaacttaagtaatagtccaaggttacacagccagtaggtggccaagcgggggtttgaatccagaccccttccacttccatccttgacctctttccccctgctctcaacagtgatgtcagaaagagcctgatcatgtttgagtcctcacaatcacctgcaaggccctgtgtaacctggttcctttcacttctctaccctcctctcccactacttcccgctcctctctccatagcagcttcatggctgtcccttgaacatgccaaacctcagggcctttgtacttccaattccttctgcctgggattctcttctgtatgtccgcttgccttgctcctctgcctctttcaaatcttggctcaaatattgacttcccaagaaggtctctatttaaaatgtaaaattgaaactcctgccctgaactccctatttcccttccctgcttaatttttcacatggcacttatcaccttctgacatatcatacaatttgtttattgtggtacttgttatctttctcttcccgtggaagagaatggaaactttaggaggacaaggatttttgtctgttttgttcattcaaagattccttctgctcagaacagtgcctgagacatggtagtcacaataaatatcttttgaatgaatgaaagtatcttcacacttctctacctttgcccaggttgttctgcctccttggaatgcctttccccactggcacatgtgacactccaacacactctctccgtgacctgtccaatggcactctgccgagaagctttcccctaggatggtcccagctcagtgacctggtcctatgctaccagccacacacacgctctctccccatgcactgtgatccctgcatttgactcatcaccagtcgagatggggatgttctgactgggggcaggtaggtgctccattcaatgctttctctcagaaggcacactcccttgttgctctggagacaggaatgaaccaaatctcatgtagcagaggtacccagggaagagaggacatcagctccctttccctgcacctgtggttccagactcaccttcacagttctctgggacttcgctcccttggcttctgcttccactcccaggactgtcaactcttcacttcaagtcctgatcttcaaaccgtgatgcacccgtctcaaacctgttcccacctccatcagtctagctccaatttagctctgggcccagagtccaagttcaccgtgtttagttgtggaggttgtatgctgcacaattcaaagaggtggcattgatgttgtgctctgtgtaaatggcattccctggtgcctgtatgatgcaaaatcagcacaacactcagacctgctgggccccatccacagtgtttccttgggcaatgtctccgttgagacagcagcaaggtttagacaccagccctgttccactggtgtcagaatttacctgccctgctgcatacaacctcactgaattgtcttgaaaaaaaaaaaaaggaagattctaggaagaaggatcatctgtttctgagtccttctgcccccttctgtgggagacgctaagcccgcaggagagcatggggaagcagccgggagcagcctcccctctggactaggacttgaaccatagctaacgagtttctgggccctatacacttgatggagaggcaagaagacccagtgtgcagggtactttggggatcatccctcgaccagcaagatatttttgatgtagtatgatcactcctcatcatgtgggtaggaacatagtgccccctggccacccctcaccaccccacttcccaaaaccagcactaattgtactggctcagccccatctagttatctcgccgccatcactcgagatagcccatcaatttccccatcttcctctttggacacaacacagactcagggcataataaccattataatcactttcatttttccatttatgagtatcaaccacatacaagcaacttactaattcatgtatgagatgaagactgtcactatctccattttaaaaatgtacaaattgagactcgtgaggtgatgtgacttagcccaattcacagcagcaagtggcagagttagaatttgaactcagctcgtctggcaccacatcctacagtcttggccactctatttctgtctccaaagcctctggatgctgaacagctggttgaatacacaactaaactacccaacatgcaagtgctgcaaggtggggatgttgccctgtgccccaagttacagcccaggcaaagcgtgacctgcagtagggtggattgggtgagggttattcctatgcatatttgagggtctaaggaagagaacatggaagcctgggcctctcttctccccagaagcaaatgcctgagtgaatttctcattgagctgaagtcaggccaaatctgcttccacacaggtgttaggttattctccctgttggctggaaattcgattgcggttgatttaaaatcccgacacctgtgtccatcacccgagcctctaccatgattactgtccctataaagttcctaatccctgtacttacacagcgtccttaccctctgacaggccagatctatgtgagcagggagatttggttattatgtagaagagttataagaaatatgactgcaaaagccaagtcagttgaaattggactataattaaatgcttagaaaattctatgcttggctcattttaaaatcaagtgcttctttgtagcaatttcctttctttaattacaatttcctgtctagtttgacatttacaatgcaatcttgggggacatgtttgtgatttattattcctgctcctatcaggatatcactgtgcagaaatgagtttataaaataagagctcaaattattatggcctttgaccaataaagcaggctcataatttcaggcctgagagaagattaccatttttgacaacccaaggcagaaatactggagagggggagggcacagtttgggaaattcactccatgttcaaaaacaccgcattgtctcctgagggaaggccagctttggaagcagaacatattaataacccctcaaatttatacgaggctttgcagctttgaagaactttcactgtcatcgattacctcatctttggaggtagacaggtaggtgccttcatccccctcttacagatgatgaaactgaagcccagagaagttaagtgactcgctgaaggtcacaaagcctgaaaacagcggtctttgaaacaacactcaggtccaatccagtgagtcctttccccacaatttaatagctgtccctcaaggcttgagaagtgtcctgagacatgaaagatgccttcagtgcatctctgggcagggagcccctctgcttcccacagcaggagctctgaccaacccccagagcagcacgtgtcccgtgactcacatatgtgcagccaacagaggccacgggggctgctggccccagctcatgaaagaggtgccataatttccttttatctgtttcctttcctcttgaggctttatctagaaatttgggagtattgtgtactcttggcccgcaacatgctcttttacccctgggctgcaaagtgagactccaagcccagcacaggagggtctacctctgtgtgcacatgtggatgtacaatcgctcagctgcgtgtgtgcctggatatccacaaatgtttggaggtgctgtgttggcacctgtgcacatattcagggcatacgtgtggtaagtataggtagatatgtgggtgctggtatagaagtgtgcattatcacccccatccattcttcctaatctaaagaagagaaggccaaagtggacaacacaccaagtaactttggtaggccaggcacggtggctcatgcctgtaatcccagcactttgggaggccgaggggggcaaatcacttgaggccaggagttcgagaccagcctggccaacatggtgaaaccctgtctctacaaaaaatacaaaaattagctgggtgtggtggcaggcatctgtaatcccagctactcagaaggctgaggcaggagaatcacttgaacccaggaggcagaggttgcagtcagccaagatcgcaccgctatacaaaagcctgggcaacagagtgagactccatctcaaaaaaagagaaaaaaagtaactttggtgcactaaatgcgccagaatcatgaaagactgtttcagtagcctgggaagaccttgaagggaataaggggagaaggaaattgggtctcctgggggttgtctgtggacccttcatccttttatttcctagaatgtgctgtggtaaaggtgccaatccacctggtccccagctgagggtggacggtgacttctgttgaggtggagctcacccactggcccttcgctgaggccacaaagtctctgggggtgtgagcctccccagtcccaccttccagatgccagttggctatgccctctggtcaggaagggggtgatgcccttgtgatgatcacaaggggatcacaggagctagggcaggtctggggagtccaggtgtgggtacagtgaattggcggcacctctgggacatccaaggggaggtgtccagggagaggttgtgtgtgtagatctgggagctgggagaaggtctatgctgggctgtggtttctggccctctgccctgcccccttaacacctgttctgtgattttcagctttaatgtccctccccaggtatgatggtggctgtgcagccaggatcagaacagatcagggcactggagccaaggccaccacggaagcagtgggtgttacagcgccgggaccaaggtggccccagcagctggttgaaggcgcgcttgtggagctgctggctgagtttccttcatgaacaaggcttctgggcccagaacaggggtttctggggtgccctctcctgctcctcctcttggggaggagtggaaattgggcttcctctttgtctcacttgaaaggagccattatgggaggtaaatctccattgctggcttttggcctcagattaagtctgtccagagactcgtttgttgcctgtgaaaatctctttattacttcaaaacaattttaaggcagagtgcattaagatttctgaagaatgagaaagaagcatatccccacaccgggatgctggttatgaagttcaaatggatggggcaaggcaatcctcttacagatgggggagaggctcaggcccacccatcagagtctagaggaagtgcctaactgaaaagcaaagcagctctcctaaaggccaccgcctgggctggccttgccagggcagctaggcactcacttccttcccctgcacatatgcacccacattcatgaatgcatgcacacgcacaaatgcactgccccttcctgtcgacagctacttccttgaatcatcatattggccagggaggcagcctgggtggctatttgatcccaattgttcaaaggagaaaatcaaagctcagacagggaaagcaactcttccaaggtcgaccaggaccagaactgacatcttcgccttccaagatcaggactttctctctagaactccccggaccaataagcagtcctgaggctcctccttggttcctgactccatgaacaaggccaacctgggcccaggtgggcctgagactgtgaggcctccgaccccaccccgctcaaagagacaaaggagtagagcccatgtgaatgctgccaccctaactccatcccatccttctcctgcaagggccctctcaagtcccaggaccaagcagggagaaaggcaggaggagatgaacccatagagatccatccatccatgcatccatccttccatccacccagcagggtcagctatgtgggttgcggcagagagtaaggaaaccacagttctgccctcaagttgctcgtggacctgagaagatatagtcattgcaaaccagtgtgttaagtgttgtgacaggaaaagcacaggaaaccaagggagcacagagtcacttatccagctaggggtgaaggcctcctgagccttagcaagtgtgaaggagccagccacatgagaagacgggagggcgcttgaatggagaaaggagattggacgatgtgtggccaggtgctttcaatatgtttggttgaggaggtcaagggggagggaggctggggcccaaggactgcctctgttgggtgccctcagagtttaggaaaccttggtgtggcctcatccaaagcccactaaccttgattccactgcatatccaatgtaattccaccattgcacattcatcaatgtacttaaaatataactatctctgggaggaatactccaaagacatgtgttgcactttacactaaatgctttggggatatcatctcccttagaggtaatgaagtaggtacaaattgctctgtattactttggattcaggcaatgacatgttttcttatttgtctaacacagattaaatctggcactggccaagctcaccaagatggcaggagattcaataccagtcatttgtagggggctctctctctctcctccttttaattttacagaaacttaggggttacacatcccacaaaactaaagaggacttcattcctagatatagctgcgtttgctcctgatctaggccatttaaaggcaggtggctctcctgggacctgctcccatgggattggagcctggttctcagccttccactgctcctccactggagctagaagcactatctctaggctgtcctggggcttgaagacagatcctgtggaatagaccacttgagggacctcccgtctgaagctcataatttggtctagaggcctggggatcccctttggccatccaaggtcttgggttgtggacaagcctggcaccatgcaccctccttgttggcccaccaaggagggcctggtagcctgccgtctcattgctctcctgccaaaggcctgaccagcctcttgatcccccgcaagctgacctagctctgtgacaattcagaaattgtgcattcagtgggaagattaggcctgattaagaaatttgcactaatgaactgtgcttaattggatttggggaaggacacaaaatgggctgcttgacattccagggtcctcagcaaagtcctggggcctccctgtatcctccccacaaagctagccatacccccagcccctctgcccccagtgccccagccttcggcctctcagcctagtaacagagaagttatctgcctaatcagactaattagcactggggacacaaagtcataatctacaaagaatgcaaatgccagttttacaaaatgaaaacgccatatgtgcagtaattagcaaaccacgggcacattttataaatcatatttattagtttgtaaacaaatcaagctctaaatgaagtgaaagatgccattaactgagatagcagcagtggtagtgctgagcaggcctggaaatgggagactgggggtacagggtagaaggtggccccagagccctgcctgggagcccaccaatctcctgtaacctccccccgaccaagaaccctggtgtgggtggcaggggtctgtgtcttggctctccaggatctatggcccacttgctctgccaccagagctcctgcccacctgctcagcatcccatgactctgggctggttattcaaaccagggcttaaacaagtgcttgttcctatgtgaagacaagatggcacctgagctctgagctcagctccaggcccctcttgcctttgttttggaacccctggcctctttgtctacttacatatctctgaggcttgaggaaaagaaaatatctcaattgaaggacctttatttactgaccatgcctactgctctgcttctcagcctctgttgtccttggagaaaagctaggggaagggggcatttccaggttgattctctcctgtggtgcactcatgtattcgcctatcaatctggctgagctccggctgtgcactcagccctcctcaggcactcaaagtgttgacatgcaaatataaaggtaagtcttagctttccaggagctccagactaggagaagggctctgggcattgactgtggcctccatgagtgtgttctgctcagcacatgatcctatctcctatctttggtgaactattcctcctttcctttggaaacacctttctgccccatgtggccatgatgaggttatcagcccaggtgccctggcacctcctccacaacaaggtaagcactcagcccaagatgaattagtctttccactgcacaccctggacccggtgacacaaattaggcccatcactttcctgatccacattttctgaatagagataagggaattgtcaactttaggatggtatagttggttcacactttgatcatctggtctgatctatacaagaaacaatgacagtaaattatataaagagaacaccaaagttcatagccatgttcaaaaataagattaatatctccatgaaccagaaatggaatagaaatttaaaatgataaatggaaccaaggccataattttgctgggctctgggtctagcatcaaacaatgaggtcgacagtccaatcccaataggttagaggggacaggggtgctcctaaagggtgggaggagtaaagatgcaactttgtggtcaggaacgaaggctagctgcctgctgactctgtgactgtgactataagcatgacaccccacactacatccaagggaaaggaatggtaagctactatataagacctggttcgggatgggaacaggtgaaaacagagaggggagagagaagaagaaaggagaaggaaaagacaaaggaggaagaaggaaaaagaaagggagaaaatcctcacttaaaatgagcctacaaaatcaatattccaagtatatataaagggatttattgcaaagaaaaaaatcaacaatccaaacagaaattcactctagataaaattaatatgactgaagagtctgacagtgacattgggcatgtttaattggtcaaagagataaaggtaaaagactcattaaaagaaaacaagaaagttacaaaataaaaacaggcataaatatcaagtgttatgaaaaagaatcaattgaaaatctgggagaggaaagttacaattattgaaattaaacgttcaatagaggaaataaattccagactgggcacacttaaagagagaaacagaattgaattgaaaactactattggagaaattcaccaaaattgcatcacaaagagacagagttatacacacatacatacacacacacacacacacacacacacacacacgcatgcaactgaaaaacatggaagctagattgaagagcgccaacaagcatctaataaaagtttcataagaagcaaatgaaagaaatagtagagaagcaatatataaagagataattgtcaagaattattgaaaattgaatcaagatgtaagttttcatattcaaaattatactctgtagtgggtgagacaacttcaaatagatccacatctagaaacattatagtgcaacttcagaacttcaagaatttaaaaaggccatttaaaaagctaccagaaggaagagacaggtcacagaaaaaaaaaaaaaaaaagaccaataacagggttgtcttcaccaacagtagatgccagaagaaaacgaaataatatcttcaaggtgctgaggaaaaataacaatcaatctagaattttataccctgctaatctgttatccaaaagtgcaagcaaaataaaagcccttatagacatgaaaagactaagtgaatacacccccattgaccttcattaacataaagatgtccctgtagtaaaaagtagacacaaaggaaaagcaaatggattgcaagaaaccatggaggaccacaggaaatgataaaaaaacaagttggtaaattcaattaaatcttgactataaaaataatacctatattttatatgcttaaaagaagataactttttttttttttaaaagaaactaacttctttagtgtaaactaaacctctaaacaaagataatgaaatggatggggatgtccaatatagcaccacatgaaaacaagaaaaggaaatctccaggatcagaaaaacagtgtatttattactcagatggcaatcaagaaggatgctgtaggatcccatgctgctggtggtggtggtaagagaattcaaacacagatatatggcatagcggctgctggcttggtatttaacacccaagcagggactggagatttagcctcttgcccatgaaagacacagagctggaactaagtcttttgtatgtggctggaagcactgaaggctgtcatctattttctttaaaaaaaaaaaaaaaaatggaaatagaaaaactaaacccacaagctcaggaggcaacaggaaagtgtattgtatgtctgcagcaatgaatggggaaaaagtccatgagaggccaggtgtggtggctcacacctgtaatcccagcactttgggaggctgaggtgggtggatcacctgaggtcgagagttcaagaccagcctgaccaatatggagaaaccctatctccaccaaaaaaaaccccaaaatagccaggtgtggtggtgcttgcctgtaatcccaactactcaagaggctgaggcaggagaatcacttgaacctgggaggcggaggtttcagtgaactgagattgcgccattgcactccagcctgggcaacaagagcgaaactccatctcaaaaataaataaatagatagtccatgagaaatggaaaccttgggaatgggacagaagcaggtataaaattcgaatgtatactacctgtgtgaaagggtccacaagctgagagaataagaattggtcggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaagaattggtctagggaacccagcaacagcaatcatgaaactgctcagaaggaatattttgacaactatagcacgtgggactctaataaaagcacaacccctgctaaaaacaagctcaataaaaatttacaaatgacacaaggaaataagacaccacaaggaagaatcagcagaaataagatggttcaaatatttctgacactagtttcaaaagaagagaaaagaaagaatgggagaaggcatattagaagagaaaatgcctaagaattttccgtaactgaagaaagagttgagtcttcaaattgattaaatcccttaaatcatgagagggataaagaaaacaaattcatactacacacattatgagaaaacttcaaaacatcaaataaaagacaaaagcaactaggggcagcagaatgccaaaaaagcaaaacagttgggctggcagcagacttctcagcaacaaaattgattccagaagacagtggaataacatccatgaagtaccaaaagaaaataacaggtaatttataatttatttgaagaaaaggcaagataaacatgagaaaaatccagagagtttactattcaaagttctctgtaaattaaaagataaggggtgtaccttactaagaaggaaattgaaaccaaaaggaatgatgaacaaataaattagaaaacacatttcattaatctaaataagcattgactacaaaaaagacattttttgaaagagttaaaagcagtgtaaagcagaaatatttaatttattaatttattaatttattttgaatttattattatttttttgagatggagtctcactctgttgcccaggctggagtgcaatggtgcagtctcagttcactgcaacctctggctcccatattcaagcaattctgttgtctcagccttccaagtaactgggattagaggtgcatgccaccatgcccagctaatttttgtatttttagtagagacgggtttcaccatattggtcaggctggtcttgaactcctgacctcacgtgatccacccaccttggcctcccaaagtgctggaattacaggagtgagccacctcacccagcctagaatattttataatgatagcaagaagatgggaaggaggattggagttaaaacatttaaagatctttgtattataggaggcgaataaagatattgattaaatttagacttttaaaaaggttgtaacacccaaagctgtagagagaagaaaaaaggtaataaaaaaacccaataaatccaattgaatgtaggaaaggggaagaaacagaaaaatacatggtaaaaattttaaaaggtggtattaaaaactccaattttatcagtaatcacaataaatttaaatgacttagacccatttgttcggagatattcccagataagatttttaaaatccagttataagttgtttataactgacctaatagttaaaacataattatacaaaaagcttaaaagtagaaggatagggaaagatcataaatactaataatcaaaggaaatgagatatagtgacattaatagcaaccagaagagatgtcatggttttaaaaaacttgagatttaaagagggtgactgttcactgacaagaagaacaattgaatagaaatctatagtgaagctgaacctgattgctcataatactataacctccttaaagatgacaggattatcagggaaaattgacagaggatattaagcaaaatacatagcaaaattgacagacttgtgggagaaactgacaaacctacatttgtaatgagaaattttaacactccttttccagaaattgatgaaacagataaaattattaacatttgtttgatgtccatatataaaatcttgtttccaataattaaagagtacacttcgttttcaagtggaacatttaaaaacttgccaggcgcggtggctcatgcctgtaatcccagcactttgggaggctgaggtgggcggatcacctgaggtcgggagtttgagaccagcctgggcaacatggagaagcctggtctctattaaaaatacaaaattagttgagaatggtggtgcatgcctctaatcccagctactccggaggctgaggcaggagaatcgcttgaacccaggaggtggaggttgcagtgagccgagatggcgccactgcactccagcctgggcaacaagagcaagactctgtctaaaaaaaaaaaaaaaaattagatggccatggtggcaggggcctgtaatcctagttacttgggaggctgaggcaggagaatctctcgaacacgggagacagaggttgcaatgagccaagatcgtgccactgtactccagtctgggcgacagagtgagactccatctcaaaataaatagataaataaataaataaaaactgactatataataggacacaaaggaagcgttaacagataataaaaatttgatatattagtgacagattctatgacttcagtgcaataaagttataaaacaatttaaaaaattgggtccaaagcacctcacttattttctttattgtagtgaactatataatatgtataaaagaatatgttaatacacagaatttaaagaaatataccgtaaacatctatgtaactgtcacccagattaaaaaacagtacattttggccgggcgcagtggctcacgcctgtaatcccagcactttgggaggctgagatgggtgggtcacgaggtcaggagatcgagactatcctggctaacacagtgaaaccccgtctatactaaaaatacaaaaaaaaaaaaaaattagccaggtgtggtggcgggtgcctgtagtcccagctactcgggaggctgaggcaggagaatggcgtgaacccaggaggtggagcttgcagtgagccgagatcatgccaccgcacctccagcctgggtgacagagcgaggcactgtctcaacaacaacaacaacaaaactcagtacatttccaggatctcagaaaccttatgtatacccctttccagctgtattctcttcctgttccctaggaagaggtatccaccactctgactcttagggcagaggtccccaacccctaggccatggtccagtaccagtctgtggtctgttaggaaccaggccgcacggcaggaggtgagcggtgggccagtgagcattactgccagtgagctctgcctcctgtcagatcagcgcggcattagagtctcacgggatctcgaaccctattgtggactgtgcatgtgagggatctaggttgcaaacttctatgagaatctaatcatccctcgccctatctttagggtactcatttttgtgctttgttcttactgttttaccacttgtgtatgtgttcctaaacagtgttgatgagttttgactgtttttcatctttatgttaatggaatcgtattttctatcctctgcctggtgtctggtcatgtgctgggtacagagaatatagagttgaattagacaggagtcctcccatcaaaatgatcatatttggttgcagaaatggtaattgccacagtaggaattaagctgtggagtaggggtatcacatcacaatcatgttgttgaaaaagagacttcttaaaggagttgagagttgaaatgaattttaaaatgatttgacttattttccaataagacaagggagatgagaattgccatcagtgtgaacatcaactgtagatcaattcagccttgtcttagtcaagatttcaaactagcttagaccaaaaaaaaaaaaagttaaaaaagatttacataagtgaacagtccatgtgatatgacttcaggcaagactggatccagaagcttaattaattgccagctttaatctcttttttttttaattttagaaaatagagatgggggtctcagcatgttgcccaggctggtcttgaactcctgggctcaagcgatcctcctgccttggccacccaaagtgctgggattacaggtgtgagccactgtgcctggcctctatctctttctatatctatcagatagactttctctacacagtgaatcagatggtcctcaaaaacctcagactcacttcctgttggcttaccattacaagtaagtggtgctctcttttgtaagttcaagccaaaattcccagagaagattctaacaggtcctgtttgggccatgtccacattcctacattaatcattgtccctagaagaataaggtgttcttgttgttctagatcacagactagatcacctgcccatcttatccaaaccacatagaactggctcctcacatgagagaaggattctgttcccagaagtgagaaaaaatcctaagaaggcaaaggcaactggagtccacctgcagtatgagaggtcacttagcatttgagaaaccacaggctctttggtgtgactggggagtgggctgaagggggacatgatcagaaaagaagtaggctggggaggtgacagagatgcagaatgcgtggacaaccaagttttattttatgctgaacataacagaggctttacagtgattggagagattgaagcagagggtgacaaattcaaatgctcattttaggaggctccctctggggcctgcaggagagagggctggagtgctaagactgttacaataatcctggtgaggaggctgaaatgagatagcaggaagggaagccttgtggggcagggatcagggcatgatcaggtaggaaactaagaaagaagtcgacaccatagatgggggtaatgaaggacgggatgatgaagggagaagagtcaagcgacagtcacgtttcacatctgagtttcaggtgaggatgtgcatcaccaagacgaggagcctgagtctgatgggcctattctgtggtggctgtggctttgctctctccccagcttctagcctcgtgttagaaacgcttgaggttcttggtaaacccttatgggtagactaaccgggaattgaattgaaatgcagattctaagtgtggcttatgcttcaagctgcaggtctccttgaggacccattgccaaggcctcgacagccccattgaagagggctgggactgagcctgtgtgtgtgtgtctgtctatgtgtctgttcctatctctttgtttgaatgggatgatttttcgcatacaccccctgacctccctatccttgacagccaggttcccaagcccaggcatcctactggccaggaccagataggctgttcctcccaatacctactctggcatgggggtgtatcccaagacattctcctcctctagttcctcccttcccacccccgccaaaccttccagaggaaatcctggaaagactagagtgacagaatgcatatccctactctcgctagagactaggcttcagagggacctggccatagacaggtgctgcaccctgctgtgtgtcaggtgctctgcaatgccttctctccactcacactcacaacactctacgaggctaatagtagcactacccccaattgacaggtgaggacctgaagcccagagaggcaaactgcattgcctgaagcccctaattggtaattatgggatctaagtgcaagtctaatcagaaggttgtgggcttcagcctccctgggactgttgtcaggaggcaggcagctggaagtggtagggtcccaggctctttagagaagaagctgggctccagaaggggtagaccagaagcccagctttcctggacccacaccagcccctccctgttgggtctgggtttctgggggcccacgcagctgatggtgataggccagagagggttggtggagatggggggaagggctggaggtgtgggtggctgggggtgggttaatgctgctgccttatgaaggacatttttcaactgagccggtaactggaggccctgtgagtgtgttctgtctcagcaactccacaatcagaggatatgaactggctgtgagaaagacatcaggggctggctattcccaaactcttagaaggcacagagctagatttaataaaaggagaaaatggaacattctcattagcaccagattttccatttaatttggacttttacaaaataagtagcctaattactgccatgatttgagcttctcaataggtttttcctctaagaagctgcagacgccacacaagccccattctccagggctcgcccttgtgccacagaccctcaccgcccctgcttctctggaagcagaaaggcttctgaggcctgagcggggaggcagggcaaggcacgggaggagcgcaggtgtgctggctcagctgacctctcagggccctccctgcccctcctgggcccccagctctcagcagccagtggggaagatgctattccggagcctgcacgcctcagcactggcctagcctgtgtctgagccctggcccgagtcttgcctgagtctcagcacagggcctaggaggttgctgaactaaggtgaggtgccagtaccttcaccccagggctctgttcttggcctatagaaatgactgtagccctgcagtgtcagcacacaaaccatttacaccgacctcccagcactagagaggctgaagagcaggactgacgcagccccagcctggggctccagctcccttctggaccctcaagggcacttgctgtccccattaggatgaaacctgggtgcctcaggctggagtgacctccttcatctcttttcatacctcccccatatcccccacatccccctccctattctccacctcggcctttggctttttcctcttccttctgcgcttgaagagaatccgggattaaagaaacggagcaagaaattgccaagaactagcctcgcagacaatcagatagagggatggagggcaggggcccttcccccaagaggagcctgggccgtccagcctgatggggcctgggagacacggggtgtgctggcgggcaggggccatgtcccgggtgtgcacagtgctggaaacatcctcctcagccatgacctaaacccaagtcctcttttgtcccagagaatcagtcccagcaaaggtctcactgctgggcccttgtcctaggtacactcttctaccccatccgtcccctgccaaggaaagcaaacccctctctggcccctctccaaaccaagccctgctggcccaacacccccaagggctccaggccctgccgcagcctcagtcccctagtttttcccccacttctccaaggaagaaagaggtaaccccaagccccttatggaagagtagttggagggatgtgaggaggcaccaagagagatgttattactaggattttggtaaaataaggtgagatgttttcctggggagctgtgaggtccctctgacctggaggaggctcttattatatcggcaatttcttgagccagccccttcgcaggggtcaaggaggacacagaggagagtcaggtgcagtctctgttctcatggagggctcaggttagtgggaaagaagtaggtgatgttctccccatttgtagatgaagaccagagcctcagagatgttgggtgacatgcccaaagtcatccagctgggaagtaggagagctgggattcattcgtacttcagggcagggcctatgtctatttgcttttcatcaccgtaatgtccaatatacatacagcagagcgtgcgagtcgatggcttgttatgtatgtgctcacccatggaatcaccacccagatcaaggtctcggtcacttcaagcattccagaaggctcctttatgccccctccaagtcagtacacccccacagagttcctctctattctgcaaatcctggcacgttttttgtggggtgaggggtgacatttcttggcccaggtgactccctgctgatgctgtaactcagctgtcctgcaaagatggcatggcccagcacccagctggcacacaacaagaaaccctggcactctggagggtgaagagaggtgctgtggataatgccgggaccacaagggttaacaggggctgtcccagcctcaccttctcaacccggccctggtgagccaaagtttttggtgggaggtggcaggggcagtgtgctcatctgtggtagcacagacctggtcctccagcctcttctagtgacctcccagtctcaggactcacccaggagagtggtggtaagggagctaatgctctctggggtctagaacaggcttcctttgcccctggtttcaggctgtgctttccttaagagaggacttcagaggcagctagaggagcctccatgtctgccatccatagacaatggagacttaggaagcagcaccccatacccctgtccagccaactgccccaagaggccttcccaagcctatgggccccagacccctagcaccacagccaagaccctcacctgctccaccccaccccgccccatctgcatccacgggccagtgggggaccattcagtgagatcctccctgtcctacggccttggccgtgaccccagcttggcctctttgtctctcagccaggccagccagttcagcgttaaagctgctggagcatccaaggagacataaagaaagtttagagacttttaatttgccagcacggctctccgctggccagcaggttgagcgtttgtggagaagggcagccgcaataaaggcttattgttcctctctgaaccactgctcgtgactcctttcttaagtgagacaaagggaacccaaggcccacaggtgtccccaggcccagaaagcggggcccacaattagctaaagtcccccagggtcaggctctgggggtgggggcccaactcagcccctgtctaggctgtactcacaggagagcacaagcctgggacattgtcggcagggaaatactctccagtggggaccccagggcaccaggagacaggactcccacagggagggggccagagccccctgcagaagcaccacacggaagagcagctgcaggggagccgcggggatgggcctcgtggtcagggtcctccctgggtgcagtgggggtgtcccgggaaaggcttccaacagccagagaggcatctctggagggagagagttccccaccacagggagcatgtgagctgggagggcacccagagggaaggtggggctccagctgagcaggtcacttccagtgcccaaaaggccagacttaggaagcccaatcagaccctcttggctgggcagagaaaaggcagagcacaggaatgtggtgacccccacagagacaccctgccactgaggcagccactgggagccaggtagccacacccctggggagaggtggcaccatgtcccatagcatgccttgctgggaccacccagaatcacatcccataggcagcactgctcagagtctcggaaaggaggctgcacagtttgtctgtcccatccttcactcacccaccatgaggctcaagacctgagaaatacatcgtggcagatggtgatgatgggaacatcctttctcattccccactgtgccctccagagaccctctactttgctgcccaggacactaatggctttggaaacattatgtggtttgtgagttcctgaaatagtcgcatttcaggccatgaggctgctggcagggagtagggccatcatgtacagctgtgtaggttgtgcactacacaagggggcaaatgaagaatggaatccagactttgttctcaccagtccctgggcacacatggtctaacatacacagaggcattgtatgtatattactgtgtaatatagatgtaaatatattacatacaatgctgctgtatttgatacactgtaatacacagaggaactgtgtgtgtgtgtgtgtgtgtgtttgtgtgtgtgtgtgtgtgtatgtgtgtgtgtgtgtgtgtgtgtgtgtgtactgtaatacagaggcaccgaaaggactagtggaggcccggaagagagggggacatttttagctaagaggcagccacctctcccatgaagactggccttgccacagtttggctctagcttctctagggcactctgaccaagggtcacatttctgaagcttttgtgacagacccagttctggttggcttcctgcccctccatccctcgcatgtggggccttccctggggttggcagcaagagcaggtgtctgagattgtgatgtctgcacacaaggctacagccccagttgcacctggagctgctacttcagccctccaacctcctggagcctctctgccttaggtaattggattggggaaagggagtattatttactagtcgtatggatctattcctctcagcgcccccccaccaccaccttcccttttctctgccttgccaaagaacaaagattggggatgaaataaatttgataataaccaataaggacccccagagaaaataaaacagcttttattaaacttcttccaagaccttttgtgctgagcctctgcaggctgtctcggagacttgcaaggcttggctcctttcccagccatctagaggagccccaggtgtggccctcacggccatccctgcaaacaccagcaataactcggggcctcgtccttcccatcactgttctgagtcaactcctatttgaaaggcagttagggccacagaatcgcctttcagctgtgtgttgcccggctctgaggttttgctagagtggccttcctcagccaggccacggctccgggtggccagtgctgacgggtccacagctccagaagccaccgagtagaggctcggggcctgctgccatccatccctggagtcatctctccaggttgagtacggcacgatttaatgctcccatccctccattcctgctctgcatgacaaattgttttaataaacataaaccgggtaataataaagtcataataagcccgcgactcaccttatatcactgcagttaaatcctcccataagccggcactggttacaatgacaattacggccgggccaatccgcaggcaggcctgcgtgcggacagatttaatatcgtttgtaaatatgattagtgggctgtcatgttattgcaggctgctatttacatttctctccggggttatacactccgccaaatcaacattaagtagtgggtctctctttcctccttaaatcatacattccttctgcctgcgccaatcccgcttaatgaagaaagggaacctgacggcaggcgctgggcagaacggagcctggcctcggcatttttctgaagacagatgggcacggggagccccaagaaagctctgcccagaaactccagtgggtacacgggccctgtctgctgcagccccctccctcccacccgctgccccgtccctctccctgcctgctcgcttatgaaaaatgttcaaataatgaatggttgttgtttacagaagcaatttcatgctacatttccattattgcccggatttgtttagcttcccaccctaccccattgcctacgatgaacttttaaggaaatattgctggcgcttcccgctctgccgttctgcttctaagagaagccgcttgcatttgagacatattgtgacacttcataactgtgtgcaaataagcatccctaaactgctggtgtcaattaatcattgttgcaaaggctgatctgctttaggtgcaccagaatccactccctggggagccagggtgggtgagaaacagcagaaaatctggtgtggagggtgcaggggacaggggagagcagaaccacgattctgctttccagatcagctaaaccactggagacaacacggctgtgttcctctcgtcttcaaaataggttcgtgtgggcccataggccagagtgtacagaatggctggggtgaggagccacttgaaagaactgaataaaaaatgaataccatatgcctcccatgcttcctaaagagagcactctagacaggatttaatcttcttgtgatagccaaggtcgccgctgtgtttggagatataatatattgatgcactttgaggctatcatggctgcagaatgccccagcaccgcgtttcctgagctctgtggttggatgcgtgctgtgtctctgtcccttctcttaatgtcaggctatagttggggtgtctgtccacagcaccctcacttcctcatgctattcctaatctttagggagctggagaccaggaaatcaactttggagcacgaagactagaaaaccaaaccttacaaatgttttgagaaagaagatgaaatagactctgagagcatgggaactgtccgcaaagtaagatcagagccttttgcttcctgcctgattctcagttgagttggagctaggagagggaccagatagaggctatgagaagctatatccttaggcagaactgtgtttgttcattcactcaacaaacactttgtacgttaggcacctactatatactaggcactgttgtaaccacccaaggggttcaccttgcctactacctagccagagccgattcatcaagacagggaaattgcaatagagaaagagtaattcacgcagagccggctgagtgggagaccagacttttattattactcaaatcagtctccccaagcattatgggatcagagtttttaaggacaacttggtgggtggggggaagccaaagagccgggagtgctgattggttatgcaggagatgaaatcacgggaagttgaagttgtcctcttgcactgactcagttcctggatgggggccacaagtttatccatctggatggtgccagctgatccatcaagtgcaggtctgcaaaatatctcaagcactgatcttagaagccatttagggagggtcagaatcttgtagcttccagtttcatgactcctaaaccataatttctaatcttgtggctaatttgttagtcctacaaaggcagtctagtcccaggcaagaaggaggtttattttgggaaagagctgttatcatctttgttttaaacaataaactgtaaactaagttccttccaaagttagattggcttacgcccaggaaggaacaaggacagctaaaaggttagaaccaagatggagtcggttaggtcacatctcttttgctgcctcagtcataattttgcaaaggcgttttcactgtggatcaagttccctgttctcatggagtttacactttaatgaaagacggcgcaaggctgctgtgtatggtcacacagttgcacactgcacaactctgagacagcagtgcaccctgcatgaagaatgtaatgcgaacagcattccttgaagctgtgcaatgtcacagctctgcaagatagttaactaagaagtcagagaattttggagcgggataactgctatgaagaaaatagtaaggggtacaaaacagaaattgattggagacatggggtctccttccttctttgaggaggtggtgtttgagctgtaataaacatatatccccctcttagtggacgcacgcaaatccttacagaccctatgtgcatgcacacctgtgtaccctttcttcttcattaatgactcctgaatgaaatggtttctcctcataatggcctacagttgccaaattttgtataatgcatatttattattttaataaaaagaaataaaggtataggtttttttttatgtaaagggagatctagaaacttctggggatgattttcatccaaagggttaagtgataaactgttggtgcttcaatggccacacattacactatctggaaaatgtgggtcacttgaaaacctcattcccagagggtcaagcatgtgtgtaaggagaggtagggatgggtgtgtctacgggtgacatgacaggcatgtgggcgaccccaagatccaaggtagagaaacagaccacaggttcaaggaccacgtgttcactgggcatatcagccagcgcagagattagggttggggccgtggccagagaactgtctcagtcccaacaatgcagaggaagcgtgaaatgtgatgaaagagtgtcgctgggcactgaaagtggaaattggtattgattttccagagcctgatgctcaggggagcgcatcaggtgcagccttacaggcgtggtccattcgccctggagggcccacagggtctgtggcgccccctgcctgccttgtgtgtccactccacagggccagctctcccaacctagcctccacaagttctgcaaagcaccttgccctctgtgccacaggccctgctcagagagtggaagggaggtgatggtgggagaggagagtcctgggtgggcacagctcttggctctgagacatgtaaacagaagtcagatcactgccccaactctggattcctgcccttcatcacgagttgccaccaggcaccaagctgagcccccagcatttaagcctgtccctgcacgaatccagagccatgtgggagaagagcaagctccagctaggagctgggagcagtgaatggaggtgaaaactccaatgagtagccctggatgcaagaccagtgcagccccacgaaacctcacacccgcaggcaggggctaccatccagggaggtgatataatgcaactggtaagagaggggggtcttcagagtcagccaggcctgggctgtcatcctcactctttcattgcccagctatgtggacctaggcagattagttaactttctagagcctcagcagtcccatctataaaatggagatattcgttgtattgtgaggattccatcagataaagcaggcaaaacacgtagccctggcttggctctagtatgtacccatgactgttagctaaaacaatagcaacagaaaccaaggacatagggcagagctgaggcccacctctgttcccaccccctcgactttcccttcgtgaacgggactgccatcacctcaattgcctgaggcagaaacgctgggatggtcctggactcctctctctcccccaacaatgaactagtcatctggtcttgcctgttccactttctgaagatccttccattcccattgcctcctctcctgccaggcaccatgatttctctcctaggtcactgcagtagctctagactggcctccccaaatccactcctccctctccattgcatttgacacccacgtctaaagcagctctggattcctcacattctgagttaatgtcttcagtagcaccacccccctcccaactttattctgtccttgcctgtcctcctgtctgtctcccccagtggaatgtgagctccttgggcagagcccttggattttcaccactgcacccccagttcctagcacagtgcttggaacaaaacaggctcataaaatgataaatcctcaaaggcatgaaggagtggcctgttgggagtgtggtgagatgggaagtagggtggctggggcagagctacagaggtggtggaaggcacaggaagaagaaatagtgggcaggagccactttgtgaagagactggaatggcatggtaaagatccttcactttcttctgcaggcagtgggaatacattgaaggttccacgcggttcaaagacatgatgtgctttctgtcttagaaaggttgctctgggttggggaaatgtggaggagagatagaacagacaggaaatgcttccagctagtcttctggatgagccaagggtggctgggccagggtgacgaaggcagtggaaaaggggaaccagatccaacaggctctttaaggaagcgaaatgaacaggacctcatgactgttgagcttgagtgaagagaaaaagagagaggtggagggcctagcatgatgccaagcttgtggagaatttccagacaaacctgtgcgatgggattgccatttggcaggatgctgaatatgggaggaagggcagtttggaccaaggacagtgagttggggtgggaggaaagtgatgggttgcattttgaacatggatctcccaagtgaaaatgtctggaatctgtttgctacgagggtgtggagcccaggggatagctcagggctggggacagagatgcgggggcttcagtgcacagctgaaccgtgtgaggagccgtgggatgggctagattgggagggccatgtctgatgcaaggaaggggtctgcgttagagccccggggaacatcaacatttcagatgccaatggcggaagaggagagtggggagcagccagtgaggcagggaggagaggagaagttggtggggcagcagggggggcggggcgggagtcaggcaacacaagcaggaaagaactcacagaagccagggcagccatgtagcccgcagagacctgacaggaacggaaggggttcctatgtgtgggaggcagtcggggaaacaaagatgaaaaaagtgggttttggtaatgattggggagacttgagtatatatagttacctattgatttaatttatatcctactttctttccaaaattagtgaaggcagctgaagaaaatgtgatcatgtttagagctgaggagagaacagagacgcggggccaggctcacttctttcacggtcgccggaagggcagcccacctcaaaggcctgcgtggaaaatggccctgagcacgtgctgtgtacgaggcggggccataatcaaagtggggacaaaatcagagttggatgaggtcaaggtgggagtcaagatgtgtgaagtcagggtggggtcactgggagtggggaggcgaggatggggtcagacaaaggcagagtggggtgagattagagggtccaggtatcgagggagtgagatcagggtgcatgacgtccccaagggaacagggtgaggttagattcaagtgccaaacaggtaagtgtggttgggggagccagggtgggtgggaccctagcaggagtgggtaggaacagtcactctgagtggtgactgtgacgacagctgccctgtcccttctccagcccctgtgtgtacatgtatacacagctgggtggtgtgtgtgtgtcatgtccttttgagactgcatgcatgtgctcccttgtggatgtgacacagggtgcatattttgtatagtgtgcatgtgcatgcactttttctccaaaatcggagaatgaatctagtattataatcagaaattagataaacactcctcaaagccatgaccaaacatcccattatctctggttcctaagtgttattatgttttctaataatttatcaaggccaaagaacttgggaagtgatatggagagagatgacctttggtccttggtggctttggaaggacatattctcagtcagtgggaatgcgacagggggcaggtggtaaagaactgatccttcaggtctagaatattctctgcagcttcccaccctgctgctctcatgccctggcagtgaaccttactgagcccaaactacccttccgcctgtatcagcatctgcatgaatgaactgtctccccatcccctaatccaaaggtccccaacccccaggctgcggaccggtactggtcaacggcttgttaggaaccgggttgcacagcaggaggtgagtgacaggcaagcaagcatgaccacctgagctccacctccgtcagatcagcagcagcttagagtctcataggagcgtgaatcctattgtgaaatgggcatgcgagggatctcgtttgagcacttcttatgagaatctaatgcctgatgatctgaggtgaaacagtttcatacccaaaccatccaccctacaccactccctacccgatctgtggaaaaacggtcttccatgaaaccagtccctggtggcaaaatgttggggactgctgccttaacccatcctacgacaggagccaaaggtccttcagtgaaaacttcagtggcccccattgcctccagagtcaggtgcaaaatccttacctgggcattccagaccctgcctgctctggcatctgcccatcttttcttctgttgcctccctggcctctgcggccttgtcccaatcaccctactcctcaatgcccaccccaccccaataaggcccctatttcatgcctgcaaggctttgcaaccagacactggttcaatgtgttggctctaaatactagtagatatgggacttggaggtggccctagtagatattcattcattcattcattctttaattcaacagatatttattacttgcctccaggctctgaagatatgaagatgactagaactcagacaatgaccgctggggctggttatccctcaagagagagtcagactaatagagagtgtcagccaggctgacaccgaatacaatagaagctccacaaatctatattgaataaataggtggacaaatgtagtaggtgttataataggttcatgcataaggcgcaatgagacaaaagaaaaggaaccatcttcacctcttcctggaggtcaggaaagactccaccaggctagtggcaaagtagacaaactcttggggtcgactaggagcattccaggtgccagtggggaaggacattcagcagatgacagcacaggcaaaggaggagaggcagaaaggagcggcatagggcaatgagatctcttggcatggctgggcacaggggtggggtgggagggggcagatgagactggggaggaaaccagctctcatcacagagggcagtgagtgaggacttcattctgtaagtgagggggactcgtctagctggtcaggggaacgacgattcagggggcctggaaaaggggaggcatttgagtgcaggtctgtgggacttggttgttgaacagagagctgtgccctggatgtggcggcccattcctagaagggccccgtgcttagagtttcatgccctgcagttgccagcttgaaattcttatcatcttatctttgaatgtgtgttttgtggcgaagcctgatgggacatggaggctgtgcccgggcttggagcacagtcctacttcccactacctccctggaagggaggacttctcagtggcttaattcctcccacctagtgccccagcctcctcagcctccttgtcctagggctgtgcctgccaccgccctccacaccaggcagggtccgtcagagtggcaaggaaaggctcccattccacggtcaccttccaccctggcagtgttccgtgcaaagaagcagggaagaccaggtgtgtgcccacagcttctagggtggggcaaggtggcagccatccaccctggtctgagaaactaaggtgtgttccacagtcagctccatgggggcctctccctcatcccagaatcaggtactgagcaagctctgacatggaggtcgtaatccctgggggtcacataccagctgtgggttgtggtgacgggcctctgaaaaggggaggctgacttcccaaatctgggcctggggccacattttcattttgcaccagtctcagaaaattatgtaatggttcctgactggatcagtgttctctaatgcagggtgcatgtgccccgaagactttagcaatcacatgcacaataagcaagacagtttggagatcacccgtatggatgcccgtgacaaataccaccacccaatcagcaacatcacacagatggaggtgcccccatctagaatggggtcaaggattaacttttgaccaatggctaaaggaaaaaacatcttgaaataagatcagagacagctatgtatgtcccagtcttaaccacatggagtccctgccggcagagacaggttcccatcccaaatatcctcatgcctgggtactaggtggcaaagggcctttttatctgtgcaggatgacagatgaggcacgtggggtgcaaaacaaggcaggccctttcgtggctgtcccaccgtttgttctggcttctcctttgccgtggccatgatggagtaaacaagagaaagctctatcattgctatttattgcagatttcaggggtggatggatctctgtgggctctgtttttatggatttgcccattgaaaaagactaattgtgtcctacctgtggcttaggttgctgttaggaccttcagtgaggtgactccaggaattaagagttggaggtttggctatgccacttacccctgtgggacattgggcaagttatttaacctctgaacttctgactccttgtctacaaaagggggacagtaatagcaccaacttcatggtaccatcgtgaggattaaattaaataaatctccaaatttgtagtgcagagctattggataatgataataataaaagcaactaacactttttattgtgcttactttgtgctaggtactattctcagtgctttccttccatatcagtgtgtttagttcccatcactataagacaggtcctactcttatgtccattttacagatggagaagttgaggctctgagccaagaagaacttgccccaaatcatatagctggtaaacggaagaagcaggctacccaggtagtctggcttcaagatcttcgttcataatcattgtactattctgccttgtttgttaaaataagtgctcagtaagatgacagttgtttttttttctttttttcttttcgtttttttttttttttttttttttgaaacagagtctcacccgggctacagtgcagtggcacaatctttgctcaccacagtctcaaactcctgggctcaagcagtcttcctacctcagcctcctgagtagctaggattacaggtgcacaccatcatgcccagctaatttgtgtattctttttgtagagacagaggtctcactttgtgcttaagctggtctcaaactcttgggttcaagcaatcctcctgcttcggcctcccagagttctgggattacaggagtgagccaccatgcctggcttatttttctatttttaaaaattatttttctttcacacacatgcccacactcctgtactcatcatcacatacatatatctatttgtgagcctctcagctgagaacttgccttccgaggcaatggaagttcaggggcccgggatcatgttagaaaggtcacttcttgggaacatgggcctggtaaggacatagaatagccagagccaggctgctgcagccagaggatgcccacgcccctcccaccaggccaacaaagggcatgcacagaagccagaaaacagaggggggggcctggctctcagctaagcccattgcaagcagcaagtggtccctggtgtcacatgagggcaggccaggcagcccggctttaccagtgggaactgggtttcctaattccagaaggttggccaagaacaacccacgcccttccttactctgtggtatgattcaggggcaaaagacctgcatgcaggctcctgggagaggggaagagaaggcagttgtgaactattccctgggatcccagctgagtggtcctctggccccgcttccaacctccagtgatagggagcctacatcctcctggggtggctgtgataatgtcattcatcagcccagcaacaccatccacctgactgtagctcctcccttcagagtctaagcaggccccttgaagcctcccagggcttgtggaatccttatgcaacccggcactcaacgaccctcctccctgacaaccaggtttggcctgctccaggccaacaccccgccttgctttcccatctgctcagaccacctcaaccaggtccctcctacagcaatcggacctgggacggggtcctgaagacagcagtttgttggagtcaataagagacaattggaaaatattcaggaattttttgagtcagttattaaactattagttgtttaaaatctgccactgtgggggcatttacatcaaggaaattggcaaacactgtaaaccaggaccttttccccacctggagaactgatttagtagcatgccactgccccattcccatagcccaagtgtttggaaaggtctaggggattttgtgtgggtgtgtgcgtgtgtgtgtgtgtgtgtgcatgtgtatgtgcctgtgtgtgtttgcttttgtgggtgtccctgtatggatctgtttacgtacatacatgagcatgcacgaagtgcatgtgcatttgtgtgtccctgtttgtgttctgacagagtggattctctatggcaagaatttcccatcataggggaattgtcccctagaggtctagcaaggagctcagcacagagagcctgccctgtgatggcacaggctttcttcagccatccatgggggtcttggtccccaccgtaattgtatagtaaaaggctggggcttctgcggaaagaaatccagtcgcggctccagagtcacagcacctggtccagtagccacttgctacctctgttcaccagctgtgttctgatgcatttggttgttatctgatgtttaaatcctcacgggaaacaaagtttggtccttttggaaagtcttaaatagaaagcagtttaaaaccagcaacaacaactactggaggttagtgaagggataacctgtagttttccaagtcaaatggtgttcatagtgaatccagaacagatcagtgaggaggcagaaatggagggcctgtttctatgtggctctgttcactacgacaggtggggacaggccaggactcagctgagccaggcacttgtggaacgaagtgggaactttttctctcagtcaaaaaagttaccaggtacacctgggggcgtctgcaaatgggagggacaatgagtaagtcagagtgccgtgtcccccatgctggccacacacagcaggtgctcagtaaatgttttcagtaatattgttttatttgggaacttttttcctagagaaagaaaaaataaaacctgaggtgtctgcataccttgggtcccctggaccctggtcggatcccaagatgtaaagacaaggacccaggcccctcttccccttcccatcttcccgaaggcctgagaaggactttgttgctttggtcccaaaggaaagaagccagggaaggcttctacttgcagaaaggatgactagaagggtacggatctcaggctaaggcccattcactctctaatcctaactggccactctttttgggaactctcagagaagttggttgtaaactttctgagaaagagagtggggccatagctgaccaccagctggaccagccctcctggccttagcagctgtcctcagcggcacttggatgggcttggctctgcctccaatcccttgccaacccaggacacgacagcacattcggctcactggagccactgataaaggaggctacttgggaggaaccaatccagggaccacaaactagaggcttggcttcctagtgctgggcagctgctctctggcagaattctaggggttcccccaacccctgagatgactcagaatgtggggaaagggaaggggagtggcaaataaagacacttaccccaagctgttatctgctttgcataatgggcttatacaaaagatttgttttgaaaaagggtttggccactttttaaaacctgcaagtcattagtctaggagtggcaatcctcactgcattgtgtaagctggttaataacccataggggattccacatgtgtgtgagggggtaggggttgtatgcattttgtgaaagagtctcaggcggttctcatatgccctgtttgagaaccagtagcctagtggttcagagaaggctgagctggacaggtaccaaggacaggacaaacatgccctttctgtctgcccacactatcttcctgtgactgatctgtgggctcagaggcctgcctgcatgtcttgggtttacatgaggtgctgtcctggtggcccgggcgaggctttcctaggattacaggtgcagcatgtccaggctgggaaggggtggttggaaccgtcccctgtccctcaggcatgccactcagaggctaaaggagaagaagagagctctctgcaaccccaagaggacagggagtcctctcagcatggctggggccacagagatgcctctgaaagacagggaagtggggtccctggagagggtgacgccactcctcgtatttctcatctccccttccatccacattctcagtgctttgtgatttggaactgacaagaaggggatccctgagacaaagggaggatgaggggctgccctggaggaggctgtgtccaaggttggtgccaggcccttcctagagcctatcggcctcacctgcccctcaccacccgcagtcccttttccccatatcttcttcctaggctgggcctaggtgtgccccccaccccctccccatcctctctgctcactcctggcctggcacaagtcttccttccctgttctgcccctgttcctgtgtggctctgcccacctgcccagggtgagcctgtgccagaagcccaggtcctctagggggcggcagagagagcacaggctgagcagccgatgattcatttgtgtccctgaattgggacaatccaatggcctctccgggcctccgtttttacacttgcttgtgggggaggtgactcaccggcctctccctgtcagaggcactgctgcagctgagccgctgcagagaacctaagcgggaggtgggaaggactgtaggagggtgagcagtggcaaagcctggccaggcaagtgtgctggggacagccactgttcagcacccccaccccaggacggcagaccagcggctacagccaggccaggacggcatgctggtgtccggtggcctgggtcctagccctgggcacttggtcactgagaaccaggcagcactctgtgccaggaggagcccagcaccccgggggcctcgagtgcccactcgagaactgcctctcttccctccacccctgcctgcattttctcagctctgtctgactttagggctaatagatttgggatttctctttgtaaagaaatacaaccccagcgcacaggggccgggaggtccccagcccatccaggttcccagaatcttacatcctctttgcctctcccctggggagggttggagtttgggtccaggggaggtagctggccctgccctggagcgctaggaagtcaaggaggctggagggcctggcctctgccatgctacaccaggaggcccagaggggtttatttggattttttttaattatcatttttcactttttttctcctcatgaaaaaattttaatacacacagtaaattaagcctggaaaaagggaggggggcacatttcatctttaatctatttacttctgaatatttaacatacaattctggcaccaatcaccaaatttaactggaaaattactcactaatctgtttgcttatttggaataattgggtcggctgccagcgcgaggatttcccccccccccagtttaatatctcagttagtagtccaatttcagcttggcggcataattactctgacagagctgtagccacggggcctgtgagtggggctgcttttaaaccgtaaattatgaaggattagcatttatgaattttaaatcagggctggggtaggagacactaaagctgcttaacgctggggaacagcagcctccactcagtagcagaagccgtaacccttccgctcccaggacgggccataggacgtgggaacccgagacgcaggaagtggtgacctgtgggacacggagccctaggagttcggatcacgagggacatggggagtgggggatgggagagagcactgaagcactgatgaagcccctgggggctagaagcctggggtgatgtggacgtggagcaggtgctttggcttctctcctggtctgtgggctacagtttccctctgggaagcagcagggtcgttgcccggagcaagcttcgagtggcaacccagaagtgaggaggtcaatccccgcagccccctgcctcctgcctccaccctcccacctcccacaggttgggtctctacttctcttaagaatccccatctgcagctgctaaagtttgcattctttctttctttttttttttttctttcttaagaatccccatctggccgtgagccagactgacccagtgccctccagctccgagtgtgacttcctggcgtgccctgctctgccgagctggagaagggccaccatcggtgctctctcgggtatgtgatctaagttctcaccttccttcccactcttcctccgtccctcctccccacccgcccctctctggcaccatggcatcatggaccctgtaaaaccagatagagccgacttgaaatctggctgtgctccttattagcggggtgaccttgggcaagttacttaacctttctcagtctccatcatagttcagttcaatgaagacagtaattcctaccctgcagggctactgggagacttccgtgaaataccgtgggcgaagtgccaggcacagtgcttggcacacggcaggtgtttactgggtcagccccatgctctttggagtcttccccaaacctgagtcaatgccctgtgtccactgccctctctctgtcctccattcccccatctctcacagagcatgggacacttcagcgtatggcctcaagacccaacaggttctccaggactggcccctatcaggagaatccctctgtctaggaatctgcacctcagcctgaccttattgggagtgggagctggtaccaaggttggatgctgggcactagtagccactagatataggtctaggacatctgctggaccaccagaacgctctggagccaggctggctgggtttgaactcttactctgccattcactatctgggtgaccttaaccaagttattcagcctctccatgcctcaattttctaatctgcaaaatgggaataataacaagagtatctcatcatggttctggtaggaggattcatgagttcatcagtgtacagcattcagaaccacatttgacacacaggaagtactagctgtgcttgttgtcattacttgctatccttctgagggggtgactgtcctctgtgggacctgcctgttctgaggttgcagattgatttccctgggcttgagatatctccagattgcctacaaaaacaggagaaaaggaggcaggacctgagtgggtgggacaggaccacctagaacatgctgaggaccattctggaccacatcactctgtgtttgggatcaagcagtccctactaaagccagacctctctctgtcccatctgctggccatggggccttcccatgatgcagctctggccaggggccttctgaggtacctggtggggcagatccccagggtccaggccagcttgggggggggggcagcagaggctggagggcacagggagagagcacagggatgcctcagcccagagagacctctctgtgggccagccctccttaccagactgagggctttgccactgctcaccctcctacagtccttcccaccacccgcttaggttctctgcaggggctcagctgcagtggtgcctctgacagggagaggccggtgagtcacctcccccataagcaagtgtacaaatggaggcccggagaggccattggattgttccaattcagggacacaaatgaatcattaccagactgaccaaaatctccatcctccagatctgagctagaacagggcagtggtggctggaaaaggaagggtgggggccagtctagggaccccagcatggaggctgagcaagttgggccagtcccggacccaggtgcctggcatttgggcctgtggacttgccctcttggcctcacccttcctactcccccttgctagccacccagccccagccacactgtcctagactatcatgtacacactgtgacaagctgccacttccttaatgcgagtcctctggcaattcacttccccattctggaccccactgtgcacatctgaaagaagcgcaggaggggcctgcctgcctatgggtctccaactcaagtgagcggcctgctgtctcagcagagtggacacagcatggcacctgctctctgcagagggtatcccacaggcccaggctgggtgaagtttgacttcatgggacatactggatggatgtggctgcccagtatcatctccatgaccttaggcttcatgtcaggccaagccccagcttcagcaaccctgccatgggaaccctgctggcaacgagagtcctggggaaatgttgcagcctacttgccacatctgggactctgtgggccctcacatggtattaatgctctttttaaaaatggcctgcatgataattttgcttcagcaaagaaattcttaagtatccctccttttacctctatcgtaccccacccacaccatcggcccaggtcatctggcccttaggggccatgatttggtggggtgcgggcggcggggaatgcagggagggcaaagggagaaggaagcacctgcagtggctgccgtatgtgtgcatgtccaggcccagaaaagcgcgttcccaggggcctcacaagatttctggcgctgctggtctccgaccacgctaggatgcttgatggatgggaagtgcctggtttgtcgagtccttgctgggctttgtgataactcattatatttctttctttacaaattgccccattagcactcctgaattgaactgaatcataaagccaggagcatctcagcctgggctgagtctgggcgatgaattacctgtggagcaaaggcctgcgttttggggaggaggctgggggcagctggctggtgtgggccctaaattctgcaagggaaatgggtttgttttctttaagctcaagagaataaaagagttctaaccaagtcctgctggatttaaatagcaagatctgcctcgctgctcattggctttcaagctgggggctctgatccctatttgaggggttaaactctaaccccattaagccatttatggaaagctgaccaccagggagggaggcagcccctcttcctgcagcctccctaaaccccacagattccgaaattggttgtcactctcagtcagaggattctaaacaagtaggcgctaatcccctctgttaaggagatacttattttgtctgaaaaacttcaaagagcccatgacagacactcagaatcaaaattagcattccaatgaggatttaaaaaataataattcttacagttctgcagaagagaggaggagaggtgaagtgactggcccggaggctgggggaaggaggagggggcgagctcctttcatctgcccaccccaggagctctggggatctgccctgctggctgagatgtggagctccctctccataaaggggcaaaggctggcctgcagcctgccccgccagggtgggcaggaagtggccactgccccaaaaggattgtgcagatgaggaattcaaggcttagagagggccgtggtaccctgcccatcagtgactaagctgcagttgaaaccaggtctctgcacctggggtgggcctgcatggcaggatgggttgccggtcagtctgcctgaaggcggcagtggtgttctctactggcagtgcttataggagatggagacactggcatgtatcccaggacaggtgagtggcagagtgtggagccagctgcctgaccaacacccctgccatgttacagcagcatgagggaactgccagagggctgggcttctgacacttccctcctgatgagtcaccactcacccccatgcctgacctgtccctttgctggatgatttcaccccagccccacgccaccccttaactcatccttcccaccctaggaggcctctctagccctccctcaccggtgtcatcttggcattttcctctcttgagggaccccactgttccagatgcccccggcttccaaggctgggaggagccactcatctccagacacgctcctccctcccagttgctctggcaccttcctttctgaagctgcttaggtacctgcagggctcccagggcccccttggctcctgggccagctccccaacttgctctgttggctcccgcttgggctgccaggaagccaggcggcagtgcccatcagtaggcacaaagctccctcctgcatcccatggccaggctgccccaaaccgtttctggtgtcagcacggcagggaggacctcataccttagagactgactgccaggacaggggccatggaagttccctgtaccctctgtcttccctgtagccccttacccccaatacacactgcttttctgcaacacctccaagctctatccatccctctcatctacccagaccccaccaacccctctccccacctccaaggctgatccagaaccaggttccatctatgcagtcacacactccttcaatgtgtaggtgtgctctgtgcctggccctgggttgggcaccccagcacataccctgctcttggtctgcttccagccaagtgggagacacaagcaggagtgctgggccatcgcagtacacaggctgtagatctctgacagagggaacagagaaatccatgctgtggcagatcctgaggaggtgccaggaagtggggtctcagagcttcaggaggaagccatcaggtgcgcggaggaatgaagggcctttggggtggagaccgcagcctgcaaatcgcagagaggccagaagtgcctcgggctgagggggacccagaccctcagctcaggcaactctgggcccctcctgatcgctagcggggtccccaggccctttatggagtccaggcggtcctggctacctgttctgttaacaggatcggacagcacatgaacttcagagaggggaagaaggaaactcccgagggctcccacctctactcaccactgacgctcccagccaccaatgagagggaccccttgaaggcattacctcatgcaggacaatggccattggctcctggtactagtgaaggctgacgacctccaaaaggtcctgctttgggcattaacccttcttgaggcaagtctggtctctcctgacagccagtgtcctccctgtgaagatggatctattcaaagcaccttcatgtccactctctcataacatagacgcctcaaactttcatgctctgagactgcgtaggccagcattgtcctatagaaatacaatgtgagccacacaggtcactttaaagtttccaggagtcacatttaaaaaggattaattttaataatacattttctttaacccaatattattactgggtttataaaacccaaaacattatcatttcaacatgtaatcaacataaacattatgaatgagatattttacattcttctatggtgatgagtcacagaaatctagcgtgtattttacactcacagcacagctcaattcctacgagccaagtttcaggtgctgctccacggctacacgcggctattgtactctacagcacagagaccagcatgctgggtctacagaggagaatgctgggagggaggagagtggacttgctcatggccaaatgcaaaccaggctctgggatgaagtcccccgactctagctcccggccttcctgctgtcctgctggagcctgaggtggccccagggcactgagatggaagagccctgggctggtgcttgaggctggcatcccgagctggtcctgctgctcacctgccctcgtatgaccttggggccccactggacacaggggccccacctggcccgggcctcttgccctgccagctgaggaaggagggccaatggagacaacgacagcacctgttccgtgccaggcaccaggctgtgggctgggggttagagttcccaccccggaggagcctgcagtgggtgggacaatggcagcacaactaataaagccttgagtgaggaatcagaggacaccgtgggggcagtgaggacagggtatttgccattcacggggagatggaaaagctgatacttgagctgggtctctggagagggacagaaaatctgcccaggggcctttttctgactcacccagcttcctaaaactccaggagcctagtttttcctgtcaggtgaacagccgaggtaaggaaagtgcacgcaggcagcacaaagtgggtggcccagccctgccaaatggtgctatgaccctctctgcagagcctcaggagaacaagacctagcccttcccctttttctgcaggcactccagacttctttggcagaaattccaggtgtaagcggataaattggatctgtgcttgggcaggatggcagcctgagttctgcctgccacaacctgaggtgggagccagtctgcctcctgggctaaggctgggcggtggctgtggggcccgcgggctgcaaggccagtgctctgcaggcagggccaggctgcctcttgcccacacctggccactaagccccgaggccggtaatgaggatctcctgcaccaccgtggctcagaggaggcctcctggcagcctggccttgttctcattgtcctgctccagcccaaatgcaccaggcccaggcctcaatcgtgatcaatgggccgaggatgtgctgacgaggcactttcatcttttctcaaggctggtgtttgaacttctctgagcaagcggccttcccaaacgggcttgtcttctaagaaggcggccaatctcctttcccttgcttcctaagcaggctgatcctgagagttattgaggcacaagaaaggagatgttcaaaggcaaatctaaattaccgtcctcttcagactggggaaaagtcttattaagtcgcctgcgtgtgattcccggcctatttctgtctgcagacctttcttcctttgtgccacataaatggacacatcttattgattttctttcaacctggatcacctccatggctgtgaatgtgggcagacaaatcccactccttccttccctgtggggctgaggaaggatgctggtggcagccaacagggccggcctagggggcttctgcgccctcctcaccacccacttcccactgaactcagcaaccctgcctgagagccagcactttctgtggaggagccaggaggccactgcaggcctacagggaggctttgggaccgcggagccacggagccacgaggcagcctgcagcgtgggccaggcagagggagcttgacgacggcggggggcggggggggggccctgccctcagcctgctctctcacttcctgtgcctcccaccgtttctcgtctaccgctcccccgcccccagtcctcactttgttcaccccactccagccctgacccttggctgagtatgccacatacatttccatttcagggacttcgcatttgtcttcccacacatagaaagctcttcccccagacatccccaaggctcatgccctcaccttccagtctccacccaaatgcagcttctcagggaaactttcttgagccaccccatttaaaattgcaacccatcccccgtattccgtgctgcccccaccgccacacactttatctttctgcacctcactcatcgtaattgacatactgtttcttttccttgcttgtgttggttgtctgtctcccttcactaaaatctccatgtcagcaggggcttctgccccttttgttcactatagtggcaccagtacttagaatagtgctcagtatacaggggtgattaacaaataaattgtccagtgtgtgaccacaggccatacacagggcctggccaaggccagcataccggcttctgtgatccaggcaccagcctccagagggcgccacacaggatgcccagccccgatcctccagggaggatcatctctgctccagatcactgcaggctcccagaaaaaggatccagacattccccgggccggaggtttggcctgggcactgactgccctagctttggcctcagaacagatggcttctatgtccaggacgatgtctctgatcctatcagttatcaggaacaggccccttgtgagggtgtttcaccccaccagacccagccggccaggacggtgccacatcaatgctctgggccttcagctgcctcccacaagccactcccagagggtggaaccacctctggggaccccagggctgccacgcacctcccttactataccctaggccaggtggtgggtataataattattgtagaaaccaccctggttggccaaaggatacctgactccccagttactccctgggtggctttttccatctcctcacctcagtttccccatctgcaacgtggaaaaggtgacccagagaaccagaagaccccttcttctgtcagtctgacagtcaatggccttctcatgtgtccctctctctctcaatgggccaaatcatctttgagggccaggacaatctctgatttttgtcctcatacagcccagggcctggctccaagtaagttcttagtgggtgtttgttgaatgactgaccgactgactgactgactgaatgaatgaacctgcaagtgtgcaggcccataaagaaatggaccttaggccccggcatcactttgctggtcacagctgaaaatccccatgcatcggcttgctagagagaagcagacagacagatggaagcaagcaaggcccaggaattctttgggggaaagtggctcatttccaaagggaaggctataggctgtgggaagacaaaaaaaattcctcaaaattaaaccaaaggaggggtttggggagcgatggggctccgagggatttattaatgcacgcctccgagtgattcttcctcctgcaatccaggcacggggttagcaccgacttccaaattatatttaattggacaattattcaaactgaaaaacctgcacaggaaacgaaggcggtccttaataaacaccttgtctcctcagccccaaacaggcaagtcgtttactgacccaagaggcacaattttgtctttggtaaatttattttgaagtaattgccgactccgggagtaaccatttttcaaagggaaacttggctctagccagcagaataataaattgttcctgacccgtgtgaagcctaatcccattagaaagatgtgtgcttagagggtgcagggcggcgcacagaggccagggatggccctgcgctcggcggcagaggcgcccggctggtgaccaggggaagcctcctgggctgacccgtgcacagccacagggaccagcccagacgttctctacagcgggggctgcaagagctagggcaagggtgggtgggaggttgtcacctggccgtggtcgccacatcggggagaggactaaagcttccgcagccacctccggctccgcctggggcaggacacagcctccaagcccaacctcttcccgggtctcctttcccatctcctccctgaccacgcctcaccacgcccctccaccaggtgagtcctcacctcctctctctccagctctgcctggccctgacccgacccgcctaccttctccctgcccctggtgagcttgtgcagaacccgagggcacagcgtcttttgcgcagaaggcgcaccgcgcgaccagcaccttgttgagcagctgagggccttggggaacctgctttaatgaataggagtgcgttcataaacagcatatccatatgcaaatgagtacctccaacagcctggaaacaggctggtctctgattgcttctatttgagcaaacacaatttataaactctggggtcttttttcaggaaaggaatgaaggggcttcccttgatttacaaattccaacttgaaaggcaaggttcttccttctatgtctagtacaactcaatgcccccaaatccaggcttggccttaggtgatctctaaggtccttgggagaccttgccctaaggtccccaaggcagggacctttggttttgttcaccgatgtgtccaagttcctacaacagtgcctgccatgaaatgatattcaataaatattgttcacataagtgaactcctggagaacccctcctccattgcatcacacagcctttcttcagaccttgagcaagacactagaggtggactcttgaactgtgattatcctcttccctttttttccagctggggaagctctgagaaactaagtaacttgtcccaggtacaatgcaggccagaggtaggagcaggaccagaagctggtctccagcttccagggctccaatgtctctagtccctgctgccttccagcaccagcctgatccccatctgagtgatgacacatgcagcagggcccagcaagtgagcccacagagagcactggagagcactggagctctatgcacccctgttctacagccaaggaaacaggctcgcagagctgggtcttgccccaggtcaaactttgaggggcctagcttttgttttgttttgttttggtttgtttttttgagacagagtctcactctgcagcccaggctggagtgtagtggtgtgatgttggctcactgcaacctccgcctcctgggttcaagcaattctcctgcctcagtctccccaatagctgggactacaggcacatgccaccacaccaactaatttctgtatttttagtagagacggggtttcatcatgttggccaggctggtctcgaactcatgacctcaggtgatctgcctgcccgggcctccaaagtgctgggattacaggcgtgagccactgcacccagccacgaggggcctgtttccctgctcttaggcatcaacatgcagcctaggagttagggcaaagtacccctgcctttggtcctcttcggggtggcagtgcttgggccccttgtatctaacaaggctgctttatcagaggacagcgaccccacaaagcagggaggctgcctccgttgggttctaattcctgggccttctactgccctcaccccatcccagcagcttccggacaacctaagggagccagcaccacaccactctcattgactccctgaaaccctcttctttgctcccgcccctgggcttccagatcatcttccccactcagtggcttccttcaggatttcaatgactgtggcttctttgcttaataggaaaggaagcgtgttggcaatatgccctcaaagttttactcctacctagaaacaagcctagggcagcagctggaaaaacggggcatttagcctgccccagagaataccagagccaaggagtccatgtcctgggaggactttgtggggaagcagtttagaagctggaggttaggagagcatgtcatgaagtcagacccaaatgtaacccctccccttcctttaatgaactgagtgactttcaaaagacacaccacctctcagagattgtttccttgcctggaaaatggaatgataaatagagtgtaaattgctaaattgttgtgatcatgagagtttacatttcttgagtgcttgttatcaaaccaaacttgggcccacctgccaggcacagcaaagccaaacactgacatcaggatttgcagcgtgagaaagtgaggcatttattgcaggatgccaagcaaggagaatggggcagctcatgcttaagacctgatggctcacagaaaagggcttttaaaggtggggaggcaggtatatgactttacaagcaaagtcatcagtcagtccacggaggcgattcatcggtttgacctaaaaaggctggacaccttgcaggtggggaggaaggggaggtggattcaaagatattctcatttgtgattggctaagcagctaaaactctgggggtcagcagaaaagaatgttgagctctggcctgtgggcgtgacttcctccaggaccttcaggaagaactttagaacaaagaatggtgctcagagttcagccctcaattcctccttatgtgaggtctatgtgccagcagttggcctttctcatttagtcggagtctgggtttctgaaaaacaactcagagacatatggtaagatgtcatctttagtttctagaggaaccatcattttgtgactctgtcttccttggtgattgttttaagctactgttagcttcttgcttagcaggttgttcattgacttctcaatgctagctaggtccccttgaaggaactcaagatttttctttattttcatgcctcggggctggtgccccacacttgctacgtatcaaccactattctaaacactttacatccactcattcatttaatctgcatgacatgcttatgaggtaggtattatttccttgtttaactgatgaggaacataagacacagagaggctcagtgacttgcccaaggtcacacagctagtaagcatccttcttctaatggatagaataggcctggcatactgtaattgataaatatcattacggttattattaagacctggctttccttgtgccagaccaaagagcaaaaggagcatggccactgcaggatcaaaggagcaataaaggtgtgtgtcagggaaagtgcgatgagccagggaggcaggggcataagctggctctgatgcttttggtgggggcactgaggctcatccccaggcaggcatttgcatccactgatttacataagacttaagaagtccgctgggagaaggacttgaacttaaaccacatacgatcgtttcctatagggctccagggccctgacacagatggaagtactctcctcatggcccagagggcaaatccagccgggacagagccccagtgggagcgtgggtcatggccaatgagcatgagggggcagcgcctgtctggccactctggcagcagtgtgtgctgtgccctggggcaggaagccatcacagactgagtcacaacacatacaccttgaaacctgtcacccaactgtgggtgctctaactggaaaggagcaccgctcgctttgtgagggagggccaaagatggtggggaagggtctcccttgccatatgactggcagtggggacagcagcaaattcctggcacgatgagttctgaggtgactgtggcggtggccgtggcagtgaaagcctggcagggctgtggctcagtcagctgtccctgtgagcaccagaccacataaagtactgctggaaatcccccgcacactcgggcagaaagaacagggaaagggtggggactgggtgcccgcaaggcactctcaccatggcagctgcagagatgcattcgcgcctcactcctgggctcctgccctcatcaaggctggggcgagtctcatagctggcctctccctctccccttccccagcaccccctctccaatctccactcctctccactgccccagactgattgttccagaacacagttctcaccatgccttgaccctctggtggctccttagccctcgagggcagtgccccagcccctcatcctggcctcagctctcacccctcacccgctgccagcctccctagtctccttcacctcacatagctcccattccccccaagggaatctaatcaccagcttagctttgactgcccttccactcctccacaggaactcatgtgagtccttcagagccccagtccacggctccttcttccagcagtccgctctggtcctttttcttgctctgtcgagctcccaggaaataatataaaaataatagggctggacgcagtgactctcgcctagaataccaacactctgggaggccaaggtgagagaatcgagtgaggtcaggagttcaagaccagcctgggcgacacagggagaaccccatctctaaaacaaacaaaacacacacacacacacacacacacacacacaccccagttagctgggcatggtgcacacctgtagttctagctactcaggaggctgagccaggaggatcactttagcccaggagtttgaggctgcagtgagctatgattacaccactgcactccaacctgggtgacagagcgtgagcctgtctccaataaaataaaaataaaaataacagcaaacacttctatagcacatactaggtgccaatattagtccaagagctttaccattaactcctttcatccttacaattgtatgaggtagttactatatcatccttgttttacagtttagaggactgagcacagagaggttaagtaatgtgctgaaggtcacacagctagcaaggagtggagctgatattcaaacgcagacagcctggttccaaggttattttctcctgcgatgggtataaaatgaccattattttatatccataggtttaggtgtcagttagaagctatatttccttctagggtgtggaaagtacttgggcctaggtctacattactgcacacccctttgcctgagatgggctcaaatcccacggttggctgatgaccctggaggtggggaggctccgctcctggagcccagggctgtgcttcctcgctcagcatcctgtgcggtgcagaccctgccaggcaccatctccagcctccttgcctccctcccagtccctggtcttctcagggcacttcccatgtgcctctagagctgcctctcccctgcctggcaaagaccccaaggttggacctgacagtttccaaatcagctcaacgtccccagcagaaaggctggtccagtgacttaccccaggacagttcttccccttccaaatctctccacttccccactcgcaccttccctctatgcttggccccagagaagaatgaagttggatccccaaggctctaagcatctccagagcttcacctgagaggccccgcagagtccgagttaaaatctactgtcctgctggagttcacagtccaactattgacaaccccagacttctaatcttaacatcacttagaaagtcctggctaatattagtcgtaaaaccactgtgtctatattagcactattaaaggccaggctctcttaggcaaacagaagaaaatgtaactagagcctggcacagggaagatgccattaaaccctcgtctcccttccttccttccacgaatacgtattaagcacttgctgtgggccaaggcctaggcaggatgccggggaaaatgctgaaagcacacggatcttcacggagctaacggtgtaatgaaggagacaggcaggaagacccattcatagcatgcggtttgggtgtgccagcaagccagggagtaggggaacgtggctcctccctgggagtggttgagcaaggctctttacctgtgtgggggacaggcagagagagtcagggagagccttgagggccaggctgaggagtttgaactccatcaagatgctgaagggttccccacaggggagtagcatggtgagccatgggcttcagtgggatcattctgaccgaagaggacaggggtgagggtggaggcagagaccaaggagggcaatgaaaatcaacgagagaaagatggtagagaccgctcttaagaaagcagcagcgtggatggggagaaatgttgcttcaagccagatttaggaggaaacaattacagcttccacgtaccgagtggcaaccgtgcactaggtggttggtctttttgctttatgtgcgtcatctctagtccctacagaaatccttcaagggaggttctatcagccacatcctggcagaaaacagatggcaccctcaaactgagtgccatgagaagagttttatcaatggacaattctcgcaggtgtgaccaggcttgagaagaactatcaagagtggtgtcgtgccctggagctaggaacagtggggagtcattaccactgcgaggccaaaaaggagttatgtgtggcaggggagaagccactggaatccagggagaggagccaggtcgtgccacacaggaggtgttgccctttagttacggggcaccgtgagccccaggtgaccctgcggggtgggagaggtgggaggagagcagcaataatggtgtgaaggcagtccctgcggtcagcctcccagggtacagggcagggtggggcttcgggggagcctggagggcccaggacatgggcaaggccagaggacttgggggctgaatgtgagggtggtaagaggaacagtcagggtgtcccgggtttctggcatgggcaccggtggcagatggtggcatggtgctctgagatagagcccaagagaaaggtggggcaggatatctgtgaggaaaggcccggcttccacctgaggctcccgcatgacactggctggctctgtcattctggcgacagcctcatcttgccctggtctctttatttctaagacaaagcacttaccagctacatgaggcggcctcctcgtgtcttcccaccccgacccctactctcattttcttgctgccgtaactcaagccaggcacatggcctcttgtagccccttcttccacgtgggcagcattttggggaacacgagctatctggagacagtaaggtacaggaaggcccgagctctggagtcagagagaattgagtttggcaggcacaaaagtgtaagattttatacattcaagatgtgcaaaatcatagacctttattttctataattcatttcatcttgctcttgagctcatattcccacagatgactgggaagggagtaggggaaatactttagcttactaattaaagatagctcagccttttccagcttaaaacagtctctttcaggttaactcaacatcttttgcatgaatactcagtctttcaaaattcaaactctctatcaggactgtttctctcccctttcgatatatcttcattcaacttcctacttcctaaaatggcagctgaatgcaggggggagctcacactgctcatggtggcaaagggaaggacatccggcctactgctgccttttgggcttcactggtctcagacagcgtggctggaccagctcccggtgcccacttaggtgctgagtccttgaaaccctgttctggcctctggtcatgaagtctgcatcagccacatataaactaggtgatgctgtgattgataacaaacgctccccaaatctcagtgatgggcaacaaaggtttatttcttgcttgtgttacatgtcatcacaagtcagtggtgggctctgttccctatcaacactccaggatccgggctgaggaagcagccactgtctggagcattgctggtgactacagccgagagaaacgagcgctatggagggtttcacatcagcggttcaatgttctgccctggaaatggcacaagccatttcttatcacagcacactggccagaactagtcatgtggccccaccattgagccagaagctcagtcttgccctgagtcaggaaggggagtgaaactgcaatacctgaccaacagcacaagcctctaatatctgacctgaccccagacctatctgaatccaccctcactcttctctccccaggaccccttcaagggtctagaaacatttaagtgctttctctccactgtggcggaaggggcagaggccctgcaaggctgccccttggctcacccaccttcccctgccatttctaaaccactgcctggatggtgcatcctgcctaacacctgtagacccagagctttgttaaggagctggtcttgttcccggtctagtccctgagaggagaagagacaatgcctcccactgggaaggccccaaccccatctgggtgactgactctatttcccctgtgcttgaacaccagggggcaaccaggactgcaacagctgacccctcacctcttttcctgctgcattttagtggctcagatccctccacttcctcttcctgcaagggggaacttcccctgtgttgtatcctctgtattagtccattctcatgctgctaataaagacatacctgagactgggtaatttataaaggaaagaggcttaattgactcacagttctgcagggctgcagacacctcaggagacttacaatcttggcggaaggggaagcaaacatgtccttcttcacaaggtggcaggagagagaagaatgagagccaagcgaaaggggaagccccttataaaaccatcaggatctcgtgagaactcactcactatcaggagaacagcagcatgagggtaactgcccccatgattttattacctcccatcagatacctcccatgatacgtggggattatgggaactacaattcaagatgagatttgggtggggatagagccaaaccatctcatcctccattctccttatgctggggcttacagtaaaactctaagtccaccaggcttgactcagttgtgtaaaaggagctttaggaacttagaaaaccttctctgtctccactaagcctgattcttgatgtgtctgttccactgtggacacagccctgttttggaagtctgcacgttgagtctgcctctctttgccttcctgcttcaataaccctgagcatccctgaaacagtggtgcctctggctgagtgaaaagggttggagagcacttaagaaactggaaaaaaaaaatcacatgacattatttttaaaatatcatttcttcaactttggtttgaattgtaccaggtgtctgaccttgagtaagtcacctaacccagcatctagagcttccactgatggagcctcagtccaggctggctccgtgcccagctgtggagcaccctttctctgcagaggagctctccagagctgcctcccaccgccagctccctctgttctctggctgatcccacgggtcatttccacttctagctgtgtgaccttagacatgttggttgactttgccaagactccattgcttcacctgtaaactgggggcagtaatagcctctttctcttaggactgttgtattaaataaaacccttgaagcagtgtctgatatcatataagtgccatgcaagtgttagctactatgattattgttattttcccattttttcccttcctggagaaccctttgtgccctgaagccttttatcccagtacccaggcctgcctagtatagagttagttcgttcctgcttcatctctggctggctgcctctcagtcatcccaggcctcacatgcagggcccacgctcagaatcatcacaggggctctgggagtcctctgccccagtaccctcatgtcccctttaccatttctgtgagctcctccccacctttgaggtgaatgtgcctctgaccacctcacattcaattctctggatgacttctctggaactgctgagccagttgtctggagttgacatccctggggtggccttggccaatgaccaagggctggagtgtgaaagcccagctcccttgcccccagtcgggacaattaggaagcatgatcatgtcccagagctccccatgcaggatgagactgatgctaccctcgaggggactgaaactgtctggagtcttccctccaccacactcctcccaccccacaccagcttggcttcttccccttctctgtccttcacccactccttatagatttctcctgggaaaccctccttcataaatcatgtgcgtcctcatctcaggatctgtttcagagggctctgccctgagacaaccaaggccccacagagctgcgatcatgcacaggttaggccaagaggatcagctgtttctggagagcctgctgtgtgcgttgcacttcatatgcctcatctcacttaatcctaaaagtggcattgctcgatggaacacatgagtatctccattttatagataaggaaactgaagtttagaacagccatgtgactcacttctgagggccatcggtggctctgtggtggcagacgatttggatccaggactgtgggactctgcagcctgtgccttctacacccacgctgggatgcaggggcaggagcagggcccagactcccagagcaggaggccaggcagttagcgcaagggcagagcaagagcctttatggagaaattgaggggagagcaacatagaaagagctcaaagtgcacccgaggtggagaggcagaccccagccaacaaatgaggctaggaacaggctgagctaagccagctgagaagcatcggatgcccccgccctgccccacactgacacacaccctctggggcacacaacagggaagctcagggggtgacagctcacatctcaccttcccgtgcagggactttggtctcccccatgccactcttctggtgccagccaccctcatcttgcactagaaggctctgaaaatggctctggccttcagggagagagggataggcaggaaagtgggggtcaggaaggggaaaggaaggacaggagtggccagcccatcacagaggaacctgcaccagaatgagggacagtgtttgcagctaagtggcaggtgtgggctggtatgtgcctgcaggcagagaggggaagagacaagggaagctggagaattactgtcctttagaaatggcacatgctgtccaccctgtagccacggaagtgactgggaccttcagtttcaagcccttccgcagagtcaccagcccccagcataccttgctgcagaaaacggttgggatagaagagggccctggaacaatgacagggataagaaagctcagaactccaggttggaaacaaggggaggaaaccccaggtgttccctgagcagaagctggccctggggatggcttgcctggtcctgtcctcctctcctggggtccccagataggacaactaactaccccttaaatgaagagccccagcatcctgacacacccataacctccaacaaaacacctccccccgaaaccaaacgccaattctattccctagtcctgacaattctactaaatccagctggaagccttatttgacccctgacctgaatctggccttacccaaaaacccactctgactggcctcaaaccaaaccataaaccttacccacccctacctctacttttaatgtctccccaccctgcgagctgggtcctgaccccagtccacacttactgtggcatacacgtgtccagggctgtggcttcatcaggacccggtggccatcagcctctgcccgccccaccatgagggccacaggggaccccttagggcagccggggctctgcatggttctggccgtccctgcacgggtgatggatgagctctggtgttatcagcaccacaggagggagtcaccaatttccctgcctgtcacttcaccataatttctaaagcacaagaggctgattccatctctcgacaccatttgactctgttccctgctctggcaggccttctcggggcaggccccagcagggatgctgggtgtgggagcgtcgtccggaggtggacaggtgcacgcttcagcgcttatatgttctgctgctgtcctaaaagacagatgccatgcctggtccattccacctcggcctcgcactcctggctcacctgagacctggataccaccacgagctcctccatccccttggagctgatggaagaaggttaggcacacaccatgagggctccccgcccaggggccgtgccttcagccccgctggaaaatgagagaaaccctaaaatcctcagcggcgctcacggtcggaggactgagatcttcccataccagcaggagaaataccagcagggcctgacgtggcctctgtcccatcaccttccccattgcaactgtcccaacaaataagcacgagctgcctctactgccgtcaaagcatcccctgggcagtgggcaaagctggtgggtggtggctgtgtgacccattttaaagccaggcagtggtttgggggaaaaggagtttagaaataagccagcaggtgcccgggaggagagatgctgtggccagagcctagcaggatgaccccccaggtaaatgaaaacattgaaggcacagtgtgccttgaagactgatgctaccatggacagagctctagggtttcagccctgaactcaaaagcagaacctgccaaaaggagtaggagagggtttcccaggactgtggtattgtctgggggtggcagccccaaggggctcagtgagtgttagagcttcctcaccctccaaggtccacagcctcaggacaggctctcctaggggccagcatctggagagaccaggtgctccagggtgttataatggagagggcagcaggggtgtcgatcagaatattttagtccaatataagaaaaaatttccaaccatcacagcatccagtgtaaaagaaaatctaaaaagaagacatcacatcaagtctctgattgtttgtgcgctttgaagactgcctgtaaaactgcctcagtaattaagtagaatgactccattttgccacataagtatggttatggctcctgggtggctgcaattaatataaaagcagattaaggaagccatcatcaaggcgtaatgagtttttaaatattaattaatatgttaataaccattctaggttaagagtgaggttttggtgctgctagagattatttctgccagggacccaggaatgcctgcatcctgcccccataccaccactcttccagtggggttccagagggagcggcagcagaacagaaatcagagcccaggctcatgagcacccgtgctgtgtgaatgcccacggccctggccccgcgtgctgctagctgacgggaacatggaccagcggcttgaggtcctcagcagggtctttcactccctagatctacctgtggcatcagcacatccaggtgggcctggaggacacagagaaaccccacgagaggttctgagcccacatatcctcccaggccatggaaccagaagggatgagaggagaggagcagaggagagatgacctcaggacccagggctcacacccttcctgggtcagcaagaagccacgaacctgagttggtgccggctaagcctgtggccacacccagtcaatagcttgggttctgactaagcagcttggcaaagccctcctttgaaggaagctgggagcagttgtcaaagcgtccttttgtctctagtcacccggttttgtctctcttgactttctgatctgtctcacagaagcatagctgcctcccttgggggacaatcagcagcccatccacacagctccgtttctagttccactgatacctactagagcagctgcagtccccaaacctgctgaaatcggttagaacaggacattattaatggactccaaggccacctagacatttaagccaaaaatgtgccaccaccccctcctctttccccaccttaagttacaaccagtccatgtccaaaattctcccttccccattgtttttcggctgtctcaaatagagggggtcttcctcggaggaggcctgggggagtgtggggtgccttttacccttgcagcctggatggaattcttctgtcattttcaaggttgttttgagtgaacttaaagtctctcatctgtgccattcttcctaaaactgcatataaaacagccacagccccagatccaggccatttggaaccaaatgtgaccactctagcagtggcattcccagggtgggatgaaggtctggaatttctgttggcagccatgggccacagctgggtggttagagcctggggacaagggtcaggtttcattgccacctctggccctatgtgacattcatcaaatcagtttccccttctgcagactgggcacgagtgtcctgccctgcttgctttgcagagccacggagataaacccagaggaatcactttgcaaactgcaaggtgagccgccaagatgagaacactatgttacccaccgtgtctcctcctctcctccttgctctttctccacatgaaacagctccagggacgaggtggcatcagttaggagaaacccctgccaggcccggccggaactgcctcccagaatcctcccatccctaccccacctccgctctcaccctcatttcccttcctcattcctcctcatcctatttccccagataaaatatcctatcctaaggtacagtcctaagggcatccaggtgtcctaggttgaaggcaggtgctcatactcagagctagaagcctaattccctagcagatcaacattccagagtacaagtctgcaaaacctcacacacacacacacacacacacacacacacacacacacacacccctcagacaccccacatcatgctcagccccacccagctcaagcacaggtctaggaagcaactggggaggtgacttgaacatcctctcccagaaaccatccaggtacacttccacccaggggcatgaagaaagtccagaatgctgtgaacacagagctgccaccttctgttcagatggtttcaaacttgcagggacaaagggctgagctccctgaggagcagcagctggggctggggaagcaagaggagtgctgcaagacttgcgggcaagcccacatcaattaggctctgattagaggagggggccaggtgggttgctggctgggcgccggcccctccgcggctgaagctgagcttccgtaattggaagcccagcctggcagggctgggcacagacttcatgccgagagagaagccagccaggcgcagcctgaatgcttctgtttctgatctcttcttgcagaaaaaaagagcaaagctgctggagctgcctggcctccagcttccgggaggaggggaacgacgggttcaagcagcggccgctgcctgctaattgcggcttctgaggcttgaacaagggctgcagaggcaggtgtgagggtggggcttttcccatcaactttcccacagagacccttcccatgctgccctcaccaggcagtcagtactctgaggcctggagggtgccagggagaagattcccaaaggttttagcctcaaagttctaccccaagctgggcaggccacatgcactgagtatggggtgactgataaccacagaggttaatacggcacacctgactgttgtgcatggaaatgtggctggtctgactgaggaatcaaatctgtcatttcatttatttcaatagccacatggggttagtggctacggtactggacggctctaggtcgaagtgaggagatgctgcccagatttcccactgggtcgcacaactggtgcccagctgggtgagacctggaggaatgacttggctgtcctctgaccctgtcctctccatctacaaaaacggggtgttccttcctctccttgtccagcctgagcagcagctccaggcccgcccttccaggtgcagtcagggattgaggccagcagcacagcctctggggccaggtggactggctttcacatcttgctctgccacttaccaacaggccactaagcttttctgaacctccacttcctcatctgtagaatggggatgataaatactaatactatccactgagggttactgagagggttgaacgagtgagtacacaaggtgcttagaccagtgcctggcatgtcggaagcgcttcgtaaatggtagcttttgttgctgtcaccatcaccatcaccatcatcatcacagttggcatgcaacaaacagcagccacatggagaaggagtgctgataggtctgttctgcagtgaggctgcagacctgacaaatggagtttgagccaggagcttctccttgagtaacagggagtaaaagctgacgggaaagaaaccaaacgccgttctaccccgtaacagggggtgcaggggtggggagctggggacggaggattacactttgctaactgaggaagtacatcctttcagagcacagattcagatctaacagttgctgaaaattgagtgggacttacaggaggtgtgcaggaatctgcccgttagttacaggtatgaagctcaccccagtgggaacagagacagggaaatccacccaggagcatccacgtccacctttgactgtgagcctggagctcttcctgcccacagcagtcctgtgagacccaggtggcactgggccttaggggaaggggctgtggagggggagaagaaggagtgggggcctcaaactcctccaaagtgactggctgacaggggaccctgccctgcgagggaggaccgacggctcgccactgtcatcctttcctgcggacagtggtgaggttttcgtgggagaggtgggtgggatgtcagacagggaggtttaaagaagaccagtggtgggggcgtggggggaccttagggctgatgggggcagatttggagcatgagggcacccaggaagaagcagttcctataaaggatcaacagtatcagggacatgcctgggaggctctggagagcctgtaaactttccctctgtccatagcaattcctgccaattccggctggggcatctgaggagccggaagaccctcatctccgctggctttgggaaacagggacaccagctgtcagatagctggaccgtgactcatggctctcagcagtggtgactgtctatggaggtccaaggcccttggtggagctgagagcactccgcatgacccccaatgccaggggagcactctggagctgactgtgcaagagagacaggagcctgaccccaagttggccctgagctagaggaagccgtccctgaagtggggcggggcccacacagctggactgcattaaatgaaggtggaggcgctgccccgcagttgtgcagcctgaggtcctgggtgcccaagccccagctgtctccctccttcccggcctgccctcttccctcctcccggcagggctgtcatcagactcattggctcccaagttctgaaatgaactctgctccaagtaattacagctcttcaagtttcccgtcctctgtttaaagaattcgtcctcttgccctcaatgccccatcggctccctaattagcagcgcgcggcgcgattacacattctctgcagctcgctgggtccggcccccgcaatgagtgtttgtggacagctgggagcccgcccagcagcccgcggagccaggagtcagggcccaggagtgcgagctgtcagctccgtgatggggctggagctggtcgcagccccgcgggcctccaggaggaaaggccttgaaatataaatgaagatgaatattcatatttggttcaataagtgccaactattaatatacatgtctgtcgggaagaggaggcagtgcagagccagttgtgccgggcataattgggctcctaattcacaattagccttgagctccaggcctctgcacagccagaacctgggctcggaaccgcgggaggggcaggagcctgctgcagggaagtccctgaactccccaagggtcctcctgccctcacacccctccccactaggagaaggctggggaagaagaggaggcccacagtccccctccaggaatcccccaggaattgcagccttcaggtgcaccctagggtcacctttgagccatgcaaactgctcctgaaaactggagtaggggagctctacatggggccaccagctcagatgagctcacacccagtgtgtcaccagagccccacattaggaaatgtctgaagaggtaagacaactgaagccagaaaattgcaggtactcagctcagcttggccactatcgactctgaagtttggtttaacaggggcttgcctgtatggccagagtctctctggccccgcctccccatacaggctcctggtgtcactcagcctcttttcctagcttgagctcaaagcagccctctcttggttctccagactctgcccacatgtcttctattatgacacagctgccactgggccttctcctgcacttcccctacaaatcaccggctgcccaccagtggccgcagagccgggctgaaccctgccctctcctgggacaccagggaagaccacactggaagacgtcagggtttgaggactgggggagtcccagcttggggtgggggggcatgtctgagctctagaaatgagctgggaccccaccctgctcacacctgaggaagctgcatagactcccttagccaacagctcagtccgcctccaatgcattggtgagtgggggcgccttgtgcctgtgtgctcaacccagatctgtgccagccaagggcaggggctgaggtctgccctccggccaaggtctaaccgtcaggctgggaaatgagcgctcaagatgccggcctgaaagagtagtcttaaaggcactgctacagggcgcctggagggtgaagagatggttgtagaggtcatccaggtactcttccacccgaggaatggccaggaacagctgggacagtgagagggggcgggtgctgcgacaaaccagcctgaaggggctcccactggccaaatctggggcaacgtgaacatcaaaataaataatgatagtagcagtttataacccattgaaagaaataggaagccatgaatccatactgacataaatgaataaattgaaaatttaatgaggaatgggatatttacacagtctcgtaataccttcccacatagttattaattacaaacagaaaaagaataaatttacagtggagagaaggctggcagataccaccttcctcacgtgatcaaagtgagcatcagcaatgggacagtcaaaaccctgtgcctcccgacaagaagcgcggggatgagcccacagtaacaggcctacccaacacgcacagcctgcgttgacccttgagaaacgttagataaacccagattgagggacagcctgtccaataccggcctgtcatcacaaaggcaataaggtcaggaaagaccaggcactatcccagattgagggagacagaggaacatgacaactgagtgagatgtgtgaccccaaaactgggtccttttgctctaaaggacattgttgggatgcttggtgcatcttgagtggggcagaagactgactgctagttatatgtcagtgctaatttgctgattttgctgtgttgaaggagaaggtgttgagggaaatgcatgctgaagtgttttcttgatgggccccacgtcatcaccctgtgttttcaaatggctcagggaaaaaagttatgcgtattggacttcctacttttctgtaaagttgaggttatttcaaagtaaattttaaaacggcagggagaggtgctggtctaaactgaggtccaatgctggggaaaacagaagcccagaccccatgtcttaacagcatgatgctgggtggtccgggcaaggcttgctgagcagagagcctcataggcctgcgcgcctcctcagtcacttgcctccaggtggtgggtgagacaagtgaggatttctctggagcgaccatgtagagctgctcttctcccctcctctcccccagggccgggacagcactgccctgcaatcagagagaggggttcttgaggggatgtggcctgtgtcccctgagttcgggggcaagggcctgacactttcctgtgcagttggcacaggggtggtctagcagaacttgcctgggcaaaggcaagcatcccccttagcagcaagagaaaggccatggggctccagctttcttagaagaaaggagacttcctggtgaggcatggtgacttccagaggtgaccccaacagaaagggcatgcagacacacccagggtggtagtaaggacagttagctgatgttccagtgctgtggtccaggctggctcagcccaagccttggcctccagggctcacccctgcacaagaggactgctctaggacctcaaagcagcccctgcctctttgtcccagtctgttcctggctgctgctaagatgcaggtatctgtaaattcaattattgctgcgacttgatggtggcatgacaccctacaactccacagtttagagcaacattgatttgcctgttcccaggtctgcaggttggctgggtgactccacttcaggatgctggtcagcaagggatggctgcagggtcttgttgggttcaggccggttcctctggcccagcagaaggcacagctcccgggcctgcacttcctcatctctaaccatcaaaggagcacgagaggctaggcagaaacacacaaggcctagccccaggtccacattgtcacttccattgtccattgtccaatacaagtcatggcatatattagtcttttattgctgctttacaaattaccatgaaattggtggtttaaaacaatgcccatttatgagtccacagtctgtaggtcagaagtccagcacagtctgatgggctctctgcccaggcagaaatcaaggtgtcagctgttgcattctcatctggagctggggctcctcttccaggctcattcctgctattgcggctgcaggatttttccatgccctcggaatactgatgtccccgtttccttgctggctggcacccagcattgctcccagcttctggaggccgcctgcattccttgtcatgtgttccctccatcatcaaactagcaatagtgcaacaaatccttctcgtgctttgactctttggcttccttttgtgttgctaaccagggaacatgctctgcttttaaaggtctcacttgcttggtttagatccatgtggataatctctgtatcataaggtcaactgacttaggactttaattacatctgcaaaatccctccacagcagtacctaaattagcgttgcattgaaaaatagggatcaggaatcttggggggtcacctttacaattctgcctaccacatacggccaggcccaacatttttgggtgggaaaatgtatacctcaagagagaggggagcgaaaggttagtgaaccattatcccacctaacagtgttcctggaaagcctgaggttcattcatctatccaccagctatccctgcacctgggcagggccagagggaaggggagggctccatgcctgttcccaagaggctctgtcacttccttcttcccaagatggtccgggacaaccacccaggtctcagagacccgcctgagcctccctcctggccccctgtcctgcctcccttgggtggttgtccagcctgcacctcattccacatcgagcctttcctgggcagccaccaacctgcatctgaccagacccctgcctgccctcaggtctcccaagaggctgaggccccgcccttcaccccagcccccacccacctgctcactctccagcatttgccctctccaccgcccccaccaatccctgactctcaatgtgccaggctcgcctcaacctctggacctttcgttgcactggtctctcctcccctctgagctctggggctcttcttctcttatccctatatccaggctttcccaatccctcaaagcctagcttgtctcctctgcttcttcaggaagccccaccagctgctcaccttgggctctgtcttatctgtacgtggagctggtggaacgcctctgcaagggtcaggacaggatggcaggatccctggcccacacagcagcacagtggcatggagggggtgttccacggcagcgagtgggcacccaccccaccactgctggatcccctgccccatatgtcagtgggcaggagcctgtgctcacgcgggcccatggccaccctctcacatgcctgcttggccactctgcttctttctcacctggtcagacacctccccaggacggttcagtatctcggctgcctcattgccccagatgtgacatcagtttggaacaagtctgtgcctccatggggcctaggagctggactcagtttgactagagagggtgagctgccttccaaactctggctctgactgttctctgggcagcagaggcttgggaagggagggccggggcccagcgactgaggggctttgagaacaaggtcacatatcggcaaccgagagccagtcaagctccgtccatcaagtttttaactagaaaaatagtgtgcccatttctctgtaatacacctctgggcttttttatgatgacttcatttccccttgtaatattggaacgtctctataattgtaaaagtgtaatagaatctaatggaatttcatttggcgcccggaatgctccatgccatggtcgctcattcggagtgaaataatgatgtctaatgcccacacacggctccccgtgaccttattcaatcttggggctgatcgggaaatatattgattcaattatacactgatgacaaatgaactcaaagaaagaggaaaaaaaggtcagcatatatttgaaaatgtaaatcttagcaatgtctttggggttcacccaacaaaaaaaccatttcaaaacgccatttgtggctaatagtgtggagttccagactccattagggaggcacgtcactggctgggaaggcattaatggggtgtcgcttctctagagctgggatcaggcccagatcctccctgagcagctcctgccctgcacggcctctccctgaagctgccccttcctcagcagcagccagcttccttctcctttttttcccatccatttgccatccctccttccttcctccctccatccctctctttctgcctctctccctccctctcttcctccctccctccctcttccttcctctctctctcccttccttccttcctccctcctttccttttttccttccttcctgagagagactgaggagacaagggtgacagggtcacgcactgcacacctgaagggagtgagcctggggagggttctgggtgagcttgggctccagggtggagcaggtgccccttgggcgggaccagagcagcaggtgatgaccgaagtgggagaaagtgaagattagcgctgagaagtccggcatgggctgaggagtagccagagagagggaagggcaaccaggagggccggattactgggggcgggcgagggaagagagtgaagaaggggaaaaaggccagccacatggaatactgtcaaattcttgaagatggagctgcacaaaattcacaggatttctccacttaaaaatttatttatttaagaatattttacataaagtacacacattttcagtatacagctggatgatttttaaaataaatttacatatgcctgaaaccaccacccaaatcaagatctggaatatatcccacaccccagtggacttcctcatgacccagttagtacccccacctcccccaggtaaccactcttctggcttctacccccatagattagtcttgcctgcctttgaacttcgtgtgactggaatcataaagtttgtacttgtgttttgcatctggcttcttcccagcgttgtctctgtgagagtcatctgtgcaggtgcatgtaccagcagctctcgctttgcacagcggtgcgtgcaggacacacaaacaaccgtgcgaattgaaatcacacggggagatcctagtcagtggaggaaaagtataattgttctgtgacctttagaagtttctttgtcaaaacgttaaaaacggttactgttagttataaatatagttgggaaataaaaacaatagtaaaactaatactcatttagtattagttttaattctgatgcaattttagacatcagagacattaagaattaaagtgtttcatttctttgtaaaaagcttatgaagagcagattgaacagtgctggtcgtgtcacttacaatacaggcaagcatcttttctatgtgttggccaattgtcagactgtgttctgagtttggatctgcttccaacatttcctcctttgtgttttcaatgttgcgaaatatctctggaagttccttcggtgtgaagtgtttttgcgagcgtcactatctctggggcatgttcatccatttcatcacaacctccttcctcgtttatgtcaatacgttcgtcttcactaagttcctctgctgcacatgtggagccaaatggtggcgacgtcgtcggtggacgttcccagtcagctatttcttctacaactccatttacgttggagtcgaattttacttctagcattatcattttcatttctttgttgcaatttcctctttgttaactaattccttctttcagttggagatttttctgaagtgtcatgtgggtttctaaactgaagacaaagagacaacacaactgcacactttgctgtgtgtgaactgcctggcagatgcccagtgtccaatcaccaacggccttagaaagagtgatgtgattggtcattgatcatgatatgtatctgctattgatggagcaacctgcaaactgaagagccagcagggaagtttaccccttaggccactactcacagtttaaaatatgccagtaaaatggtggctgaaatttgaaccaccttgttgagagactgaaactgcttaattaaaccatggtaactggaatttgtgcatatcagaatcacataaaatgaagactgtctatgtacgtagtttgttctttctcattgctgtgtactacttcattgtatgaatatgccacaatttatttatcccttcttctgttgatggacgtaggggttgtaccagttttgctctcctacgcatatagttgctatgaatgttcttgcacctgtcaacatatgcactcatttctattggttaaagatttctccacttgggttcaccaattatttcatgtgaccccccccgccccgcccaagcaaatccctatgctcacaaagctgggagcctctgagccacatctatgaagagggaggagtcacagtgtcatgattgggctgagatgggaggaagggccagcagggaacagctggttagtcccttctcctcctcccaacccattttacagatagaaggaaagactctagacccagggggacgtgtctgaggtcacacagagagtcaaacctctggggccactcagctgccctccacaggcctcactgccctgccttgaggtgcagttgctccccagctgtggggctggaattgccttattctggggctgctggagttctccctttctcttcaagagcaaattcctccactctcaccctcatgagggggctaggaagctgacggggaccttccctccctgccggacaccccagaagctttcagcaacactcagctcagccccgctgccccatttaattctcataattagctgacagctcattagcagctcattataagccctggaaatgcagtgacagtaacaaattcagtgcagccagccattctgggggtgtccccaggggcctgacccaggttgggcttccagggggctgctgggaatgagttcagcctctgcccatgtctgaatccacagagtctgaatcctattccttggatcccatttaccgttaccacccctccacctccacctacccactgccactttccagcccagctcccggctgcagggccttcagctacctttcccacgtttctctcctgagaggacaggtaggaggaagtagcctggctccaacccaggaagggaacccgaagcctctagggggcccccgagaacacagactctctgccattactgggcacctggccaagcccccaaggcccatgcgcccaccttccaccccacagagtcctggaactcgggcttcagcacccctctccatttgtccttccagctctggtctcagcctttccgcctgtctgtatatctgtctgtctatctgtctgtctcggtctatttccatttattcaacatccattaggcacctactacttgcctgttctggggtaagtctgaaggagctgcagggatcgttagacaaagtccatacaggaagactttctcacggcacagtggggaaggaaaagggggaagcagaccactacaaccttgtgggataagggctggatagagaagaagttgctgaagcatcagaaggggatccagctaggcctggagtgggcccatcaggggaggcttcctggagaaggcagcctcttggaggagcaggagtttgctggtctgtcagtctgtcccaggccagcctctgcaccttcatcctctttgcagcccaggccctctccttcctacagccaagcccttccacttcttggtctcagtctcactgaaggccccaggacacaggacagagactgtgaacagggccagccccacaggagacggttagagccggagggaaaggagggacaagagcgacttctacagaaggggtgggagagcacagacggggtcgggggaggctcacatgtgaggggctgagtcctgagtgcccaggtggccccagcctctagcaggccaagtgaccttgggcaagtggcttatctcccctgggttccctttcccctctgtgctctgcgaggaatccagcaaggtggggcctgaccacagtctgtgtgcaggaacaggggcatccagtgtggccaccaaagatcaaggctctgcaagagaggcccagaccccaatcctgagctcccagttccaccttggggtggccatacatctgccacagggatcgatgagaagtcattatcaatgcctcatgttaatgacaccaattaattccccatctgtgggtccaatgcagccttcagcgctgaaggttaaagggaggggactggctcaggatgagttttccccagggatggcagctacaggccagtttgtgtggcttgtgagagtctgaggccttgcacttgggactgtacagtgtgtgtgtgtgagcacacacatgtgtgcaagtgtatttgttattcttgtgtaaaaagaatacatccatgccatgtgtgtacataggtgtgcattctatgtctgcattgtgcatatacaaagagtttatgtaacagtttatgtgtagaaagtatacgttttgtatatatgtgtgaacaaagtactaaatgtgtacaaagcgtgtgtgtataagttctgcttctacatcatgtttgtagacaatggagggcttatatctgtgcgcactatgcatgccaaggttatgtgtgtgagtcctacgtctgcaaatgctgaggacaaagtatttgtacctcctgtatccatgcagattgtgagtgcgtgggtatacattgtgtatatacacgcatcattgtacagatgtgtacaagcccatgctgacgtgtgttcacatcattgtacattcatgttctgactatgagatatggggaccacaggctcctctctgcttctttaggtactgaggttctgcccctgagcccaggactctaagggtagatcttcctgcactgtgacatggacctgatgctgcctgaacttcagctgggtcttgaagaatgagtagcaactcaccaaataaatggagtagtagagaagggaaaggggttccagactaaagatgcttttcaaacacaatgattgttctgagtgtgctacacacactcacataatcttcacagcaaccctacgaagtgggcactatcaccattcctattttacagatgaggaaaatgagttctagagagtttggtagcttgcccaaaggcacatgaggcttgaaaatggtatagtcgggatttgaacatacactcatacattcacatacacacaatgatatgcacattgaacatgcagacaagacagtggacacactcatcacacacacacacgtatacacagtgcacacgcccaaacccaggctatctccaggtgttcccatctgtccagagtgacttgggccagagctctggctcagccctagcttctatggggtggtggagcaggagggaagggcagcgagcatgtgatgaagcgggactgagggatataactgagggtggtctccatcctctaatcctactcctgcagccaagcagcagagggcgggatcctccctgcccatcacacccaaagaagtggacccacttcaaaaacctcagtatagtctcacttcctccatcagctatgggggaaggattctgtccaccctgtccctgcatggctatggaaaggactccctgggaaatgggagaccctaatcccccacccgggcctcctgtgtccccagtttcctcaagagccagcagtcactgagtttcaaaaacaagatacctgaaagctgctgcctgtcccatgcacgatgttgcctcttgcccaaggagggtccctgagagcgatgctgtccttggcctgtgccatcaaggtcgaactgggccctggctaccccctcaccctcagcagacccaggatgggcagcctgcccagcccaacagcgccagaatgcccggcctgtcgcctctcccctgggctctgtctcttcttaattaatagaaagccattgtgaatactaaagaagaaattagcacatgccagtcatttccgggtgtttatagatttctggatccatctctaattaacccctccagttctgaagccctgcccgagtggcaggttcttgcctccccttggatgggagcttggcccctgccctcaaggagccccagtctggttagccttgtttccctgcttcaaagtgacttcccattaatctcaggatccaaaataacttaccgcatttcccccggggagggccccaaccaccttaagacattgggtggtcagatcaagacatgaaataagcatgccctttcaccttcaaatccacatctgggaatttatagaaaggagctgatcacacaaacgagcagtgtgctgaggcagccccattacacagctgttaccaccgcagaagccatcagcgtctgcgtccatctgtatggaatgccggttaggggacagagagagctactgggcagccatggaagggtcgcgatacacatctcggttcactgccatggggacatgtcctttatgcactgttttgacaaaactgcaggttactaaagtgtatttataatatgacatttacataaaatcatattcattgagagagaaagaaggctcaagaggcaggtgttttgaagtcaggataatatgaacacttatcatctctgggtagtgaagtcactttttttttaccttctatttttacagttttctgtggtgtttgggtttttactctgtgtgtgtgtgtgtgtgtgtgtgtgtgtgtgtgtgtataatcagaaaatccagccaaggtgtgctatacgatggcacaggcagctccaggaagccccaggggcagtgggaggggctgatgggatcttcagatctaagagtggggacagagggagcttccagagaatgaggaggctaagggagtcctgcctgatgaagcttctttgtcatttgtgtggaaagcttccttgcaggtgggggcagtggggcctggggagggagggtggggcagcacctagcctcagttctcccacctcctctcctcctccgcctctgcagccagtgggagggtgcagctggcctgagtggggttccagagagctctgatgccggagcttagcaggcctgatctctcttcctgctgaccccagtttctttatttgtagaattctgaactctcactgcttgcaaattcctgaaaggctgagctccagcaaggccccaggaccttggttgctgtgcatgccctctgcacagctaaggattggggctgggggctagtctttgaggcttgagatgctagggctttagcctaaggggccagcccaaggaacactgtcgccaacctgcacaccaaaggctcagtcagtgagtgtttctgagtgagaattcagagccctggatgggggatgccagagagaggcagttgtctgatctgagtctctgtctcaggcccttccgtgttaacaacagccccgttctggtgctccagctacaccaatgaaggcaggaggagaccccgtctgaggggccacctgccctcccaagggccagggctggcttggagctgctttgggaggattgcggtagagctaagggggaacagggaaaataggctgattcaaacctgggcctcaaaagatgaggcttttttttttaaagaagtggtgcctcactctgccacccaggctggagtatagtggcacgatcatagctcactgcagcctccaactcctgggctcaagcaatcctcccacctcagcctcctaaatagctgggactacagaagcatgccaccacccccagctcatttcttaattttgtgtagagatggggtctcactgtgttgcccaggctggtctcaaactcttggcctcaagtgatcatcttgccttgcctccaaaaatgctgagattacaggcacgatccaccctgccaggccccaaagctgagactttctccaactccctggtgctttctccacttagggctgtaagggagaagcagagggcagcactgggcccaaaaacactccattcctgaggctacagatacggggcccagacctccaacaggggacctcagtggggcaaatgcaacatcctgaatttagggtcaaaaaatcaactgctgaagttgcagctggaggagacaaggtagctcctgggggctggaggggccccgggcaagagtgtcacaccctcagccacccaaggcactgccaacctaggctctcttgtcaggaggactgcgcccagcacgagaagtggctgggaatttggttcctgggctccatgtaaagagccatgttttaagagggactttgacaaactggtggtccagaaggggatgaagaggatagtgatgagtttggagatcatgaagtgagactagggctggagagagttgtggaaggagcggggctgtttgccctggaccgaagctgaggagcatggctaatgtctgatcctggagggctgttgggggctgaggaagcacaagtgctcagtgggggcctggggcagaggaggaaccatgaaggaacgtaatgggctaaagggtgtcctcccccaaattcatgtccatttggagcctcagaaaatgaccttgtttggtaaaaacgctctttgcaaggtgaaactagttaaggatcacaagatgaaatcatcctagatttagggtgggccccaaatccaatgactggtgtccttagaggaagaggagaggagggaccacccagagagacagcaaggaaggctgtgtgaagacagaggcagagactggagggatgctgccacgagccgaggaatgccaggagccaccaggaactgggagaggcaaggacggatcctgcccaagaagcttcagagaaagcatagctctgcaaataccttgatttggacttctggcctcctgaactatgaggaaatgcatttctgttgttttaagccacagaatttgtggtaatttgttacacagccttaggaaactgatatagggagaaagcatgggaggaagggttcagatgagcaagaggacttttcctttctctttctttctctttcttttccttccttccttctttcttcctttcttttcttttctttctttcctttctctccctctttcttcttttctttcccctttcttcctttcatttatttccctcccttcttctctccctccctccctctctccctcccttcctctttccctccatcccttcgttcctttctccctctccctctctctctccctcccttcctccttccctcccacccttccttcctccttccttccctccctccctccctccttctctttatttttcctttatttttatttttttgagactgggtctcactctcttgcccaggctggagtgcagtggcacaatcatagctcactgtagccttgacttcttgggctcaagcaatcctcctgcctcagcctcccgagttgctggacccacacctagctaatattttgattttttgtagagatggggctcactttgttgcccaggctgatcctaactcctaggctcaagagatcctcccacctcagcctcccaaagtgctgggattacaggtgtgagccaccatgcccggccaagaagtcttttctagtagctggaatcacactattccagagcagactgccctataagccatgagcttggtgttgctgcaaggctcaggccaagttctatgaacaccaatcgggcccttgtaaggccttacaaggtctcactctgcaaagcagggggctttgagtgatccacggggtccttagaccaagatcccatgtttctacctggctggctcaggcctggagaaggggtgggtgggagagggggtagggaaactgctcatacttgaaagcctcaccccacctggggtccaacatgaacaccagacaccccagtctttcaggaaaactctcacaacctcagcttcccagttagaaactagtagaaaggcagacactcatgagagaaatgtggggacagtgaacctttggcgcttagactttggatttgaggcctgctcttcatgcatcccaccgcataggcgggttgaagggcggctagtcctgagttcacagccacatcttcttcccaaggctgactgggacaggcgtactgcctccctgactgcctcaatctgtggggttgcccactacagcccttaagacagcatccaagggccaagaccatgtctttctgcagactgagttcatgtcttgctctggcttgcaaggctgagggcgtggcggcctcttccgggggctctgggaccctgccactgaccagcctctctgagaagatctgcttggaaggtgaggactgtcatggaggtagccaggcagggctcatcaagaccctaaaggtcagcttgggaaaagaccccatgcagcagggagggcttctgcatttagcgctttgggcagttgcagagtccactgttccccttagggcagacccaaatctggggagctgctaacctcaggtgggctgtctcccatgtctggaccttggctgggatgactgggctctgtgccatatggtctctcaccctccgggaggctggtctcggcttgttctcacagcaaaggttgggaagcaagacagcagaaggacgcgaggcctctgaaggcttaagctcagaacccacatgtttctgggcatggcatttcatcggccaaagtgagtcacaaggccagcccagactcaaggggttggggaacagactccagctcttgatgagggggctacaaagtcacactgctgggggtgtggagccctcatggagagagaacgctgcccagatgattttgataggacacgtcagcctctacccctaccaggagccctgggttaaaggcaggggcaggatgtagcaggttgcctgggagctgcgaggaagacgatgagggtgctagtatgaggatcaggctgggcccaggcatggctgggaagaatatgacagcagaaaagtagaaaatagacaggaggggcctccacacagggggctcagggtggtctcaggcccagatggctctactggtcctcagcggcatcaccaggtgatactggctccactgccaccgtgatggacccagctataagcagaccctcttcacagcgggatcatcccagtgattgaggcccaggctgcaggttgtggggcgtggagttcctggaagaacacggctgagtgtgagctggaaaaatgtaagtgggtggccttctgggggcctccctggaacccgtgcctttgactagtggttctcaaagagggggctgtggctgcagctgcagggggcccagaggcccctcctgcctctcaccagcagtccaagtgttcaggtgccttcctgggcacttagccatgacaacatgcaattcctggtcttccctgtcttctttcatctcaggcctccttactgatacccaattatgtaagcgccaaagttattaacacaatgcttatgtgtgtcttcccagctctcagctgaagcccttgctgcctccaaatccagttagacagcctgtggaagtctagagatctggctgatgtctccaagctgccagggctgactttctgatgcttctctctgtgccactgggctcccactacctctcacctgccccagggtccacaggggctcactcaagggccaattagagcacagagctcaggcccctccctagctcccacccccaacccccttgtactctgtgagctgggaggttgggggcgttggtagaggtaggaggttattttcatctgctcgagctaccataataaaataccacaaaccgtgtggctcaaatgagagaactttattttctcacagttctggaggctggaaagtctaagatcaatgtccttgcaggttcagtttctagtgagggctctcttcctgccttgcagatggccaccttctcactggcagagaaagagagagagagacagagagagagaaggatagatcatactcggggtctccagtgtctctttttataaggacactaatactattggctccaggccccaaacttgtgaccacaattaaccataacatacctctataaaatccctacctccagatacagtcacactgggggaagggctggagctttacacaataatttggaggaggggacacaaacattcagcctgtaacagtgatgttcacgcagagaggtcacactgcaaacagagtgtttcaattacctcgctgttcttttctccctgttcacccagagcagtggacacatattccccaacccacccttccaccagcccacctctccctcaaagctctctccagattctggtctggcggccgcctcatctcctagcccgaggacccaccaagggatatttggcagggaagtatagttcccttcctatgaggaattttaacagataacatttcctccatcttgtagcacagactaaatttattaatgtgtttccagaggattctgatgccaagccctcctaaacagtctggcagcactaatgctcccacagaaatgcacacttgcaaggtttgaagagatgccatcctgagtgactgtggttttaattaatgttactcttgtcttttaactacagactactattaatttagcttcatcattatcaatttagtcgcttgttggttaaccctacaacttgcagtgacatttatttgcaatagggtttccaatgtacatctttctaacaactagcatttaaggcaggcatccatatgggttgaaatgggaaacatttctatcccatggctacctcagaggcaggaattactcaccacttcctccccccattgcttgacagaaagaaacttattattggtgatatactcctggaacttgtgttaatttaagtaactggccatatatggtcaaggtaaaaataatagaactactcaatgattttcaaattcacagataattgctttaggatgtgtttaagcttatattccttaatagaatgtaggcagttcacacacggtgccagcagtgagttgtctgcaacttccttgtttgcaaattctttccctagaaagtggaggcagatcagtgagccatgggggtggtttcccccatgctgttttcatgatagtgagttcttacgagatctgatggttttatagagggctcttaccccttcacttggcacttctccttcctgccaccttgtaaagaaggtgccttgcttcccctttgccttctgccacgattgtaagtttcctgaggcctctccagccatgtggaactgtgagtcaattaagcctctttccttcataaaggaaagggcaaattggaaaagagtctctggcagttctttatagtagtgtgaaaatggactaatacaaggagtcctagccaggagagttgggaaactcagcttggagaatacaggctaatctccaggcactcaggctacttagatttccagacatacaacagggcaaatgcattcctttgcttccttccagagccagccacccagggaatattccaaagaggctccaggggaatgagcggggtcagagctgtgattccagccagcccaagcatcactgagcgacagccaccagggcaaggctctgggaaacagggatctcggttgatccttgggaacctgggtcctgggcaggagggggcagaagtgactatgactttatgtgtgtctaagcatgtcacgggggcaagctcaaatctgtcccctgcagcagtgagggacagaagctgcacacacgtgtgttcacatgtgcatgttgggtggggctgggtggagggtatttaataccattagccaaagccaggagaaggcagacggcttaagacagaatttggttctccgagctctccttcccctcttctctcctgtgcactttcttcatcaggtctgatctctgcaagtggagaggcatttgcaatacagtcttgtcctggcaggctttgattcttttttcttttttttttttagatggagtctcactctgtcaccaggctggagtgcagtggcatgatctcagctcactgcaacttctgcctcccgggttcaagtgattcccctgcctcagcctcctgagtagctgggactacaggcaccagccaccatgcctggccagttttttgtatttttagtagagatgggtttcaccatgttggccaggatggtcttgatctcctaatctcgtgatcctcccacatcagcctcccaaagtgctgggattacaggcatgagccaccatgcccggccgattctgcatttcttttaagtgagatcacatcttccagctgccatactttggctccaaccatccctagtatagtctgaaacctgaagtcctcaacagtctgactgggcaggaaaggctccactgtagaagccttcgtaacctcccagcttcagaagcataatctgaagctgttttcctagtatcacctctctcctccccagtgtcctatatcctgcccatgttggtccatttatcaaaaccactaactcgacagtgcccctttgcaccttgtacaatcctccattttccttcaaccaagacacagccaaagcaaaaactagaagctagagatgatgttctcattaatcgagagtgaccagtagatacccctatagttgtggggttgatgctgctggatccattgcctaggcagggccattgcagaccccttaatcttcacctttgtctaaaataaatcccccctaaaaactggccaattaaaacacacttcaaaatgggatatatcatataaacataattaaaataaaaatcatatgatcatttcaatagatgcagaaaaagtattcaacaaaatacagcatcctttatgataaaaactctcaacaaactagccattgaagggacttaccccaaaataataaaagccatgtatgacagacccacagcactccatcatactgaatggggaaaaggtgaaacattccccctgagaactggtacaggacaaagatgcccactttcaccacttctattcaatatagtactggaagtcctagctagagcaatcaggcaagagaaagaaagagcaaattggaaaagaggaggtcaaactacagctgtttaccaattatatgatcatatacctagaaaaccctgaagactcctccaaaagattccaagatttgataaataaattcagtaaagtctcaggtaataaaatcaatgtacacaaatcagtagcactgctttataccaccaagttgagaatcaaatcaagaacttaatcccttttacaacagctgcaaaaaataaaatacctaggaatatacttaaccaaggaggtaaaagatccctacaaagagaactacaaaaactgctgaaagaaaccataggtgacacaaacaactagaaacacatcccaagctcatgaactagaagagtcaatatcatgaaaatgaccatactgcctgtattagtccattcttgggctactatgaagaaatactcaagactgggtaatttataaaggaaagaggtttaattgactcaccattccgcagggctagggaggcctcagtaaacttacaatcatgatggaaggagaagcaaatgcatccttcttcacatggcagcagcagggagaagttcagagcgaagtggggggaagccccttaaaaaaccatcagatctcttcaagcctgtaatcccagcacttcgggaggccgaggtgggtggatcacctgaagtcgggagtttgagaccagcctgaccaacatggagaaaccccgtctctaataaaaacacaaaattagctgggcatggtggtgcatgcctgtaatcccatctactcgggaggctgaggcaggagaatcgcttgaacctgggaggcagaggttgcagtgagtcaagatcgcaccattgcactccagcctgggcaacaagagtgaaactccatctcaaaaaacagacaaacaaacaaacaaaaacaaccatcagatctcatgagaactcactcaccatcacgagaacagcatgagaataaatgccctcatgattcaattacctcccactgggtccctctcacaacatgtggggattatgggaactataattcaagatgaggtttgagtggggacacagccaaactatatcactgctgaaagtaagctacagattcagtgcaattcctatcctaacaccaacatcttttttcacagagttagaaaaaaaaaatcctaaaattcacatggaaccaaaaaagtcccaagtacccaaagcaatcctaagcaaaaagaacaaatctggaggcatcacattaccagacttcaaattatactacaaggctatggttaccaaaacagcgtggtaccagtataaaagtagacacgtagaccaatgcaacagaaaagagaacacagaaataaagctaaatacttaaaaccaactggtcttcaacaatacacacaaaaacataaattggggaaaggagaccctatctaataaatagtgctgggaaaactggctagccatatgtagaacaatgaaactggatccctatctctcaccttatataaaaatcaactcaagacggatcaaaagacttgaatctaagacctgaaaccataaaaactcaagaagataacctaggaaaaactctcctgcacattggcctaggcaaataattcataactaagaacccaaagtaaatgcaacaaaaacaaaaataaataaatgggacctaattaaactaaaaggcttctgcacagcagaagaaataatcatcagagtaaacagacaacccacagaaggggagaaaatattagcaaactatgcatcaaacgaagaactaatatctagaatctacaaataactcaaacagattagcaagaaaaaaacaaataatcttatcaaaaagtaggaaaagacatgaacagacatttctcaaaggaagatatacaaatggccaacaaacatgaaaaaatgctcaacatcactaatcaacagggaaatgcaaattagaaccacaatgaggtaccacattactcttgaagaatgccctttttttaaaaattaacttttaagttcagggttacatgtgcaggtttgtgatataggtaaacttgtgtcatgggcgctttgttgtacagattattttgtcacttcaatattaagcctagtacccattagttattttttctgatcctctccctccacccacccttcaccctctgataggcccccgtgtctgtggttcccctctttgtgctatccataagtcctcatcatttaactcccacttataagtgaggacatgtggtatttggttttctgttcctgtgttagtttgccaaggataatggcctccagctccatccatattcctgcaaaggacgtgacctcatttatttttgtggctccatagtattccatggtgtttatataccacattttctttatccattctaccaacgatgggcatttaggttgattccatgtcttttctattgtgaataatcctgcaatgaacatacacgtgcatgtgtctttatgacagaaaaatttatattcctttgggtatatacccagtaatgggattgctgggttgaatggtatttgtgtttttgggtctttgaggaatcaccacactgttttccacaatggttgaactaatgtatactcccaccaacagtatatgagccttaagaacggccattattggccaggcacagtggttcatgcctgtagtcccagcactttgagaggccgagatgggtggattgcttgagttcaggacttcaagaccagcctggccaacatggtgaaacctcgtctctactaaaaatacaaaaaatagcttggcatggtcatgggcacctgtaatcccagctactcaggaggctgaggcaggagaatcacttgaaaccgggaggcagaggttgcagcgagccgagatcatgccattgcactccagcctggttgacaagagtgaaactccttctcaaaaaaaaaaaaaaaaatggctgttattaaaaagtcaaaaaagtgggcatgtggtgaaaagggaacaattatacactgctggttggaatgtaaattagtacggcccctatggaaaacagtatggagatttcacaaagaactaaaagtagatctaccattcaattcaatactgggtatctacccaaaggaaaataaatcattgtatcaaaaagacacctgcacatgtatgtttattgcaggacaattcacaattgcaaagatacggaaccaacctaagtgcccatcaaccaatgagtgcattttaaaaatgtggtatatatacaccgtggcatatacacactactatacacacatatatacacactactcagccatcaaaaagaatgaaataatgtcttttgcagcaatttggatggagctggaggccactattccaagtaaaggaactcaggaatggaaaatcaaataccctatgtcctcacttacaggtgggagctaagatatggatatgcaaaggcacacagagtggtataatggactatggagattcagaaggagtgctgggtggcgaaggataaaaacctacatattgggtacaatgtacactactcgggtgatgggtgcactcaaatctcagatttcatcactgtacaattcatccgtgtaaccaaaaaccacttgtaccccacaagctattaaaataaaaaaaattaagaaaacacacctcattttaaatctaacttgcaaaggcagttgtggggactgctacataattagtaaggggtattccaagtaatctgtcagccgagagtctcctggctgccccttccccactccattgtggctaagggttagggctcctgctgttgacccacggagaatgaaagcagggacagctgctggggctgtgagtgactaagccacaagagcctgtgcctgccctgatccccaaataaggatcccacaggcggaaggtttatcccacagtgaacatcctgaatgcagaaacatgagagatcacctagcacccagcaccccacttgtagccgacaccccacctggcttctggtctagtgagcaccgagcagctggaacaccctgtccctgggccttgctgtacagtgaggggctggactacctctcaccctttacacctccaacgatgcctgtcattatttcttttgtgagctctgtgttttgaaatattttattacccaaaaactttaggtgagtgtggtctgagccatttcactataggcagatacgctttttccattatgttccttgcaatttggaaatagcctacagatccctttagtttggggcccagataggaaacagacacgttgcatgtcaggattacctggggagcttctgagacccagaagggaagggccagagcaatctctgctgagacctccttcccacccatatccctctgtaaccacagtatgcaccgtgcctctcccacaccacacctcttcccaactcctgcctcgcccccacccccacatcctacggcttatgtaccagcacacccttgccacccacatccactccactccacgaggtcagtccacatgaagggacatcctgcagcgaggaacatcggaggaccgcagggcccggctgctgtgtcacgctacattggggtgacacttgggatttgggcctggcgctcatcacactggacatgtggcatcttgctgggcagctgccgccacagcccctggctgaccagaggctgcacagtcgctgatggtagctggggagcagaagccctggaaatgaaagtgagaggcaaggacatcagaaatgatgcatctgagcctctgcctcaggcaaagagccacaagtggacaaggacatgtgtgaacactcctgggaattctcagagatgttcaggggagggcgctcagagtcttccctgcaaaagactcagattcctgatagtagcatggggagagagggctcagagccattccatttaggcaaagaagttaatgtgccccagtgcctgtgggcgggaggcgtggggacatgcagcttacacagacacagaccacacctgcgctcaccctgtttggagggtccaggacaggtcctgtgtgaggttgccaaacctctcctgtttcccaccgccaccccagcaggagctaagccactaaggcatcctctggcaagcaggcctgtaattcggtttgtgccttcttccctccccatatatctcagtggataattagcaagaccgatacttaaggaaaatgagtgtgtcttcctggataatctcagggctctgtgactcagacccaaccccagagcgctgactcaacacactctctgttgctccccacaggcaacacactgcaaaaagcctctttagcagtcactgaaagtccaccacaaggacactgataggaaaataaccatgcttcagggacacattgtcattaaagcctgtcctggtaaactcaaactagattgtccacgaatccctgttaacaggaacacaatggactgcagtgacagacgcacagtgttccgaggactgggggtgacgggccacacttggaggtctgacttcaattttggaaaaagacccagatgaactagaatgaagggcctagaaacatgtcactaaggaagagtccaagagacatggggatgtttagcctgaagaaggcacacagggctgtgggaattaccttcaaacccaaggggctggatgtggcagctggagaggcctttaaagagctccagaagggccagtgagcagcaggtgtcagatgataggaagaattttctcacacttaggtgtttccagagtggaattcatctgccttgggaggtagggagcccccaaccccaggaacgtgtcatcagaggtgggagctcactggagctggctgtgggtgcagcttctgcactgaggaagagttgggctgaaggaacagttcagacagtccaggattctgcaaatatgggtttcagcaaaatacctggcccaccattttctgatttattgctaatggaaggctatggaattatgatttagctattgagggcttgtaaactgtcactattcagattcaattaatcaagcgataaggagatttggccacatctcccagggatatttctccgaatggcatttcatgtcattccactccattctcatccttcttcttgccaaaatacagtcactgcctagtccttgagtgagggagacacacttgctgtgtggaccaagatggtgccttgataccaggtctccctggattctgtgagccctgtcaggcacccagaagcctctgcacacagtttcgctattaactctgggtctctcttcacatccttctccaccttagggctcttttctctctatccaccttgatctgctccaacccttaaatccatctcaagtagtcatctccactttgaggtctgatagagatctcaaacttcatacgatcagctagatgtgggcagaaagttacccaggtgccgaggcaagagagtgaaggcacaagctgttccaatataataaagaaagtatttagaataagaaaagttatactagaaataggatatagagatgatcatatatggataatcataataattagtttttagtattaatctgttttattattataaccaaggaataaccagccagtgcagagtcaggagctgaaggaacactgtgagaagtgaccagaagacaagagtgtgagccctctgtcacgtccggataagggccgctggagggcaccatggtcttgcggtaatgccagtgcctgggaaggcgctcattacttagcagaccgtgaaagggaaactccctttctttggaggagttagagaacactctgctccaccagcctcttgcgggaggtcggacattagccaggcctgcccacagacatccggaggcttaaacgtctccttgtggtgctgtgcttcagtggtcacgctccttgttcacttttatgttccgcctgtacacctggtcctccttttaacttcctagaagacagcagtagcagaaatagtgaaagtattaaagtgtttgatctctctgataagtgcgtagaaaaaacgctgacgtatgctgtcctccctgtctgcttcggcgatcacaaagggatgggccccttgtcctgtaaacacgtgacttgcttgaccttatcaatcacttgagatgactcactctccttaccctgcccccttgccttgtatacaataaatagcagtgcgtccagccatttggggccactaccggactccgcgcattcatggtagtggtcccctgggcccagctgtctttcatactcttagtcttgtctcttatttttctacaatctctcgtctccacacatgaagagaacaccactaggccctgtagggcaggaccctacactagaactcttcattccactgccagcccaggcctggccttccccaggaagcgacaccaccatcaatctggttactgaagccaaagtcatccctggcctcctcacccattcttcttcaaccatcacctctaatccatcactgaatcctatcaatttgatttccaaaacatatttcatatcaatccatttctctccatcttctctgccaccatcttattcaatgtcctctaactaatctccctggttccacttttgttccactttgcataattcatttacacagaagacaaacggatcctttaaacacataatcagacgtcgagccctcaatggcttcccagtgcatttagaataaaagggtttcttcctgtggccccctaaatcctgcaggacctgacccctgtctctccccttccctgatcatcctggcctttgggccaagtcctggactccatcaagctcttcccctgttccctctgcctaaaacatccctccccggctcttcccacggttggcttccttagagaggctttccagagggttcctatcctgtaatcctctatgatagcactctatatagaaatgccttatctctaatcacaatatataattattttacgcatttgtatagatggccatcatctgtctctgtgcccccatggctacaagctccctatgttgggcaatggttttgactgcctttcacattgttttatatccagcgcctatcagtgcctggcacatggtaggtggccaacaactatttcttgaatgaatgactgagtctctcaatccagttcctttttttttttttgagatggagtctcgctcttttgcccaggctggagtgcagcggcgctatctccactcactgcaagctccgcctcccgggttcacgccattctcctgcctcagcctcccgagtagctgggactacaggcacccgccaccacgcccggctaattttttgtatttttagtagagacagggtttcaccatgttagccaggatggtctcgatctctgacctcgtgatccacccaccttggcctcccaaagtgctgggattacaggcgtgagccaccgcgcccggccaatccagttcttaatgaacatcttttgtacaactctgtccatgctggtgccacggggtctgatgctggtcatcttatacaggaaaagaaaaagattttggtggtagtcagactattcccctccaagcaatcagaatcactgcaggtaagacatttctgccaagatttcacacgggctgggctacacagtaatgaagcctggtcagggactgctataaaaaagttggtgagcagaaagttgatatgaaacttaagtggctaaatgactatagtctcatgactaatttctgtgctgatgggggcaagggactgaagctacaaccaggtaattacttctggaagaaaaacaactcttgtaaaaatttatccatttgcatggttttgggtagctagaagccttttcttccaaagttccaaaacagcaatgaggatcctgaataagaactgcctctcttctcctgggaccaagtggcaggcagtggcctgggaggtgggcagccagggggaggtggcaccatcccccgctgctggcttaggcccagagcagacgtctcccgtcctgcaccacagaatccgcggagcctatgggaacatggctgccccctgaaccaggacggtgtcaatgtgaaagggacaaaacgtcactgcgcctaaccgtcctctaaagaagtgagcaatggcaaaagctagaggaatgcaggatggggaggtggactccacatctgaactccacctgctcagcggcacagctgctcacaccacctgatgaagggatgtgggaaatcgaaacatgatagtgattctaacccccagctgccctgagatgggaatcacactttgctcctggtaagcatcgatctgtcatgtctgcacagaaaggacggtccctgtgaattcctgaggaaagaacggagcctcttttctctcttcggttaaaaacatattcaaaggcttctaaagactgctccagacaaaaggaccagttaaagccttgagaacttacttttatcacgcaaagtccttcagaatgcagctttccctgatatagtgcttgagtctcgaccaaattcgtcaacatgcaaaataattccactcccttctgaaacctcaagcccaaacttgtcaaaattatcactctaggctcctgctggagacagaggtgtttgtgagttgctcggccttttgaaactctgggatcaaacttcacggtagcttaggcctaaagagtaggggagcaaaaacacgaacatcttgagaggcatatagtacaacagtgatacttgagcacactggccaggttccagtttacgttctgctacttcttagctgtgtgaccttggacacaagaccttggacattaagaccttggttcttaatctctctgtgccttaattcatttctctgtagagataataatggtatcaacttcacaggccgtggtaagaatggaaagaactgatacacgtaacgtgcttagaatggtgtctggcatgtataagtgctctgtaactgttgctgctgttacatcatgactctgaaagggggttttagttaaaatggatcccatccactattatagctcaaagtccagcttgcaaaaagactttgattctagtaactaagtggaagccagtgtttggaccaggaaatatcagctgccacctccctgcaagggcatcttcctcagggtccagtgagggggtcagttgctctccatcttccaccccacccgccccacccttcagtcacatgggaatgctgactcctccagccttgcaattgctcctggggatggagacaactttttgtgctgactgagctttcctaaagaatagcctggcttcaggattttgcctacagggaggttttggtccccaaagggcagggagacttctatggcccctgtatcaatgccctggttatggtgtgaagatgccacaggatctagttcggagaggaaccagcagaagcctggacggagacagggtctgcacggcgtctctagtcccattctctgggccaggacaggacctgatgcatgtttggaggaggaggtccaggatctggctaaggtacctgggatggcactgggcaacagggaaggggaggtcctgagagtgccatggtgacactgcaaaagtcctattaatcttcccaatggggcagtggtgggaacccccaccactcctctgagggctgacccagattattcagggaaatatggagaactgacccagcaagcacagagttgagctgattatagcagggactgaagaaggcagccacaagaaatgcaagacagccgcagatgcggcctcgctttgaagaacaaaggcaaagaaaattggctcaccaatgagaattaagtgataacaatgtactgaacagaaatcaaaatcggttctcagccagctcactcagaaaaatgcaggatcctgaagagtacaactgaacgatgtgagacctttgaatagtaaaaacttttaccttaaaatgcttttgtaaagtgatttcagtgcttgtagagatgaagcgaacacgaagcccaggagacgtcttgtcttcaggtctcctgtgcttcctgggctccacggggtcccctggaagccccttccctggtctctcattggcagcaagcagccagtgtagggtggcctcctcccaggttctgttggctgtcacagtgaagtgttgcattctttaggctcccaaaccttgagcccagacaatttcagatttcaggttcggtatcgggcaacgctccaggtatcctgccctacctgggtcccaacctcaggaacatctccccaccagcccctccccaacccttagtgaccacccaggtgaatctctttgtgtcaggaagagctcgtttatcttttttgccctttactgtactttggtaggagactggcagccagagacaaaactaccttgggtcaggaacaatgcagcactgataaggaaagggtctccaccacttgagttgcagccaaagacaggtggtaaacttaaatgcggaagctgaggatttaacagagactgttcataaaggcactgagagggtttgggaaaacccacaaaggaagacatagtagccagggcaacaggctggtcttggcctgcaagggcaggggacacagctgtaagagggctgcctggcaggagccacgcccaccaaagaaggcagcaaatgcccagcagcctggcccagagcagggaggcactcgggagtcagcgtctggacctggctctccccttctctcatctccccttggtgccttcattgacagaatgccaatgaatccagaagcccagggagtgtgttaatgcagtacctgaagatcagcctctctgggcagagacggcagagcaggcagagtggttctggaggggcagatagaaaatatccagcccagggtcatttcccagaggccacagctccttggtctctagccaagcacagccattataggacgcaacttccctggccaatttcaaagctctgcttgctgctgggaatgcatgtttaaacaaagcctttattctctgttccaacagcgcggctggaatttaaaaagcttcattttcaagactggttgcttttgatctgtctaacctggaacttacattttggagtcaaatagaattatttaaacaaagcatttcagtgataagcacaagatgttttgattttttttggctggcccccacccaacccccgcagcaccacacaacattcctactcaaaatgaaaggacaactttgtggctgactcttaaaatctcagcttccatttccctgggtcttcgtttcctcatcctgtgcctttttctaggtttgcctgtgtacgggccctgggagggggctaactttacctcagactggcctggaacaaccaaatattctatgagcagtgcttccctcctctcgctccggcttccggctttggcagaaccatgtgttgtcatcctgtcttctttattaattataatttattttcattttgctccacatatccccattttccttccttctctgatgtaaggccttctctgatatcatcctctattctcctcaaatgaatttgtccccagcttgcctgcattcctctctttttatcatattttgcctgccttatctgtcactcaagttggaatgcggatcgctacttgaattccttgaaaataacacctgcgctgtgctgtcctagacagactatgtcccgctggatcacagcaaaacccagctccccatgctatggagcacaggaggtgtcacagtgtttgttattggtgccttcgagttggcctatcagtcattgaaagtcaatctgaaatggaagagcgcccttttttcacagctgtgaaagcaaatggaggaaggaaggccatatatccccagaccttaaagaggcacatctgttggaaacaaagctcagacatggcctggtccaagtgtgttctacacaacgaagtaacaaaaataccactaagtaacacaaaaatgatgtggaaattctctctagaaagagtgagctaaatttctattaaaatgactcctacaaatcaaatgaacacctcgatggaggggcgttaatagaatgcatcatatgacaggcagggtggctggccttgcctggtgtgaggtgggaataggtgaagacacactaacgtgttataaaatgacttcatcttttagttagtggttagttctggacctttgctcaagcttactgagcagaatcgctaatttttagggccaagagaagtgtggatagtactctatctaacaataggatcttctaatcccaaaagaatatcactgtgaaagtaagagtatttttaatatacagaatatttcattttcaagcccagggaataggcagaatcaaagccaccatcttggttaggcttttctgcaaggagacaagcagccaccgtgcactaggtccctgcttctccccgccggaggtgacggaactgcagtgcacacatctgcctttgagactactagggaagggaaggctccacttagctaatgaagccagagttctcatcaggtgaacagaacacgccctttaaagactggcttactaaaccctgagagaaagcttaaagctcaggatatggtttatgggcttatgatacgactggaactagacatcaagaagggagaaagatcttgaagcagctatgttaatgacagtttaaaataaaatacagacaatttccactagatatgccttggccagcaggttcccccaaggaaagcacactgaaggtactaagaaaatactggcagaaccacgtggggcaacacaggccagtgctatctttgactcattcggaatcacaatagtgtcttctaaactaactgcaagaagcacacgtactatttttagttaccaagtggatttaaatgcaactagtatatgctcagctggccagatgtgggccattttggagacctgacagttccatggggggttggaatggaactaggttatgactttatgaaggtaaaagcaattgcaaattctttctttagaatttgctttggaagcaaaggaaagtagctattcaaccagtttgacttcaactggcaaaattagttacccaggtggaaaggagatgtctataaagctaagagaaatgaggtatggtcccctgtttcttgcttcatgatcttccccaaagatgtgtgcctaccattgcagcagtagaacaaacttataatttgcataaaggcttagaggaccttattatattcacctcttgttaacataaaaattaatgtgctgagtaacatctgttttttattgatttaatcaatacattgggaatttagcagcaagttaatggcaagcagttacaaaatctcctatttttctacatttaaaataagctgtcttaaacaatctatagcaacctaaaatctcacgaacacatgtgaatgactgaagcacttctgctgtaatacgtatggcaagtttattagtaattttctaacaaagtcttctagtgcaaagtgcacataattatttggcacctccattactatatttggcctcttgttttcccctataaatagctgtgcctaaacataagaatttgaagtaaaaatgagcaagtgtgcccacagccttaaattgaaggtatctgcccccctaaaaaaccttcgtgtacatcttgagttgatttccactgcagcccactgccaagcctactggtggctgtcctttaatgccatgtgcagcttatgctgctttggagataagcagcttcaattttaagctggtgcaaacacatggcggggctctgtggagctaaaaggctacaagctcagcatagggctgtcttcttcccctcctaccccctcatcaaagtgctaacaagagcagctttgtttttgtactgtccaacactggagggaaccttagagtttctttttggttctggacagggcgccggatttagcagggtacttggttgctgttccttggcttggagtcacaggggttttctccatttctcccttgatttcagctggaaggagtttgctagatgtgaaacttgaactgcacatatcaaagttgtccttactggttgcaggaaattgcttttcataagcagtagactgcaaataaaaggtcttgattaattttcagacacaaagcaatgcacatcaattcaaagatgcaaggaactacaaagttgtccaggatttgcaagttggagccctctctagatatagggtccaaactagtcatattgtaaaattattattaaatgccaaaagatccttttgcacctttaagaaaactgaattgtttcatgtttggtgtggagcaaactctacaggctcaatttcgaaacctctgtcgtccaaaatgtaagtaaatgtctggtaacatttgtgcagggaagtccgcttagacataattgtactcacttcatctttacagatttctacacaagctctgacatttgtatggataccctgataagtacaatataattattctttctaatctgtgtatgaagtgctacataaggcccacactcacatccccactatcttcccacattaattccagagactggcttctaatcccagtcacactactcaggcaggcctgtagacctctttgagcctctctattccttgcccttaagtggaagcaaataatatttgcacatttgccacaagagcttaccataagaatgaagagaaagggtggccatgaaagtactatgtgagctttaaagtagaaaacaagcagatggagttttaacaggcaattgtattttctcaggtcgcctcattccacagtaaaggaagaagtggtcttgaatcctgctgtcatgagggaagcagggtctgttttgacgttaggcccatttttaaagtgatcacttttaattaagtgaagctggagcatagagttctaaaagagtagagattgtctcaggagacccacaaagcagcacaggggcccagccactggggtagagatagggaagctctggtttacagagaatgatcgaggaaagagctcacaggtttaatactctggttacctgaaagtcacagcacacttgggttaaaaatcaggttaacaattttcaaagagtgtgataagatggtgtgtaacacaaaataaatgcagtgtttctttgatcattcaggttcttgtgatgtaatgaccacgtttaatattcagtagtagcacttaatatatgtttgcctagtgaatccatgactttccagggctgcaataaaactctgggtcctgtaagacttttggcacctatatttcaagaaagaaaatccacctgatgtttgcttgctgaagaaagcctttaaagtgtgcctcttcagaacatcactcgtgtctgattttataaccagtatatgctaattcttgagcaggtaacacttaaaaatcattttgtaccttaaaattttaatttctataaaatttgaaatgtaaaaaggtcattttctttagttcttttcccccctaagcaaacttctgggttatttctgtgtgttcttttaagaggtagaaaatatttaaaattctttagtattccctcacataggttgtatttttatcgaaaactccttatgttcagtgataaggtgaggatacaacacccctgatgttagagcatctggctgagaacaagttgctttgtttagtacagtgctggtctctaagatatacaccctatctttaaaatttcaattcataaaatttaattacctttacatacaaatgctattaaaaggtgaatctaagtgtaaccttctgtcttttgacatttctacttggattttgagttatcatccaagttgttgaggaagtagttttcaacatgtccactacaactaatattctatcgagcaggaataaagattcattttcctttaatgtgcttatattcatatctggcttaatggttccattcttctttactgcttcatttgttaatgtaattgagtcattatagtagtttcaggagttgcagtcaccaggaagaaatactcagaaacagtctctgtgaacagaattattgatgtagaatatttttctttttcccaaaaacgctacagatgctggtattttcttcttggatacaatatcttgagatcattattaaagtcttctggcaaagtggaaggaaaaagaaaactaaacaatgtttagttgctttggtgtagaaatatgatatttctgttttattttgtagtaagataagaaaatgattttcctcagccaaatttttttgtaattttagttatttatttcttaaatagatagtacatccccatgattaaatattcacaatgttcaaaatctcctccttaccccctagttaactgagctctgcccccaaagacaaccaatattgtcaatttatagtgtacaatttcagagagattttatgcatcttcaagcaaatattaggtggaaccaaatggatgtggttgtcattccactgtcatttccattggttgcaggtcaaaaacagtctaataatggcaatttcctatggttcaatctaattcattgatgcggtttggctgtgtccccacccaagtcttatcttgaattgtagctcccataattccgtgttgtgggagggacccagtgggaggtaattgaatcacaggggcaggtttttcctgtgctgttctcatgacaatgaataagtctcacgaaatctgatggttttataaagggcagttcccctgcacacattctcttgcctgctgccacctaaggcgtatctttgctcctcctttgccttccaccatgattgtgaggcttccccagccatgtggaactgtgagtccattaaacctctttttctttataaattacccagtatgtctttattagcagtatgagaacagacaaatacattcatctactgacatgctttcttcctgctttttatacaaatagtagccaactataaacactcttttacaccttgacttttttcaactaatgattatcttgaagatcattccatgtcaattcatagaaagaaaaaatcctcattcttttttctggctatgcaatattctcttgtttagaagtaccataatttatttaaccagtctcttcacaatgaacactcaggtttgtttccaatcttttgcaagcacattttgcacatgacattttgcacgttcgtaagtttttctacaggatatatattttagaagagaaattcttcggataaatggtatatggatttgtaattttgaaagatatcatcatgttgccttccactgcagttgtactgatgtataatcttaccagtagcatacaagagtgcctgttttcttatttttcaacttggttttaatacatgttaaaactaatacagtcatccatattttaattgagctccaaaatcagcctaacgctggctaccccgaaacaaatcacagtatttgctccttcactccctggtaacatcaattcaaatctacttacctttctttatgcaaatatatatatattttttgaggtggagttttgctcttatcgcccaagctggactgcaatgacacaatctaggctcactgcaacctccgcctcccgggttcaagtgattctcctacctcagcctcccgagtagttgggattgcaggtacacaccaccacacccagctaatttttgtatttttagtagaagcagggtttcaccatgttggccaggatgatctcaatatgcaaatgtttatgcttctgtgtatatgggtttgtcttgtaaaatactgtatgtgtatgggtaccttaccatttctctctttactaaattccagttgcatgaagtttaggatggcattgttcagaaagcagaatcctaaaagtttttctaaaagaatctgagactcagtggagccaagatggccaaataggaacagctccagtctacagctcccagcgtgagtgacgcagaagatgggtgatttctgcatttccaactgaggtaccaggttcatctcactggggagtgttggacagtgggtgcagcgcaccgaacgtgagccgaagcagggtgaggcatcatctcacccgggaagcgcaaggggtcagggaattccctttcctagtcaaagaaaggggtgacagatggcacttggaaaatcgggtcactcccacactaatactgtgcttttccaatggtcttagcaaacagcacaccaggagattatatcccgtgcctggctcagagggtcctacacccatggagcctcgctcattgctagcacagcagtctgagatcaaactgcaaggctgcaacgaggctgggagaggggcgcccgccattgccgaggcttgagtaggtaaacaaagtggccaggaagctcgaactgggtggagcccaccgcagctcaaggaggcctgcctgcctctgtagactccacctctgggggcagggcacagacaaacaaaaggcagcagaatcctctgcagacttaaatgtccctgtctgacagccttgaaaagagtagtagttctcccagcacgcagctggacatctgagaatggacagactgcctcctcaagtgggtccctgacccctgagtagcctaactgggaggcacccccaagtaggggcagactgacacctcacacggtcgggtactcctcggagacaaaacttccagaggaatgatcaggcagcaacatttgctgttcaccaatatccgctgttctgcagcctccgctgctgacacccaggcaaacagggtctggagtggacctccagcaaactccaacagacctgcaggtgagggtcctgactgttagaataaaaactaacaaacagaaaggacatccacaccaaaaccccatctgtacatcaccatcatcaaagaccaaaggtagataaaaccacaaagatggggaaaaaccagagcagaaaaactggaaactctaaaaatcggagcacctctcctcctccaaaggaatacagcttctcaccagcagcagaacaaagctggacggagaatgactttgacgagttgagaaagaaggctttagatgatcaaactactccgagctaaaggaggaagtctgaacccatggcaaagaagttaaaaaccttgaaaaaaaaatagacaaatggcaaactaggataaccaatgcacagaagtcgttaaaggacctgatggagctgaaaaccatggcatgagaactacatgacaaatgcataagcctcagtagccgattcgatcaactggaagaaacagtatcagtgatggaagaccaaatgaatgaaatgaagcaagaagagaagtttagagaaaaaagaataaaaagaaacgaacaaagcctccaagaaatatgggaccatgtgaaaagaccaagtctacgtctgattggtgcacctgaaagtgatggggagaatggaaccaagttggaaaacactctgcacgatattatccaggagaacttccccaatctagcaaggcaggccaacattcaaattcaggaaatacagagaatgccacaaagatactcctcgagaagagcaactccaagacacataattgtcagattcaccaaagttgaaatgaaggaaaaaatgttaagggcagccagagggaaaggtcgggttacccacaaggtgaagcccatcagactaacagctgatctctcagcagaaactctacaagccagaagacagtgggggccaatattcaacattcttaaagcaaagaattttcaacccacaatttcatatccagccaaactaagtttcataagtgaaagagaaataaaatccttcacagacaagcaaatgctgagagattttgtcaccaccaggcctgccctaaaagagctcccgaaggaagcactaaacatggaaaggaacaaaaggttccagccaatgcaaaaacatgccaaattgtaaagaccatcaaggctaggaagaaactgcatcaactaacgagcaaaataaccagctaatatcataatgacaggatcaaattcagacgtaacaatattaaccttaaaggtaaataggctaaatgctccaattaaaagacacagactggcaaattggataaagagtcaagatccatcagtgtgctgtattcaggaaactcatctcacgtgcagagacacacataggctcaaaataaagggatggaggaagatctaccaagcaaatggaaaacaaaaaaaaaaaaagcaggggttgcaatcctagtctctgataaaacagactttaaaccaacaaagatcaaaagagacaaagaaggccattacttaatggtaaagggatcaattcaacaagaagagctaactgtcctaaatatatatgcacccaatacaggagcacccagattcataaagcaagtccttagagacctacaaagagacttagactccaacacaataataatgggagactttaacaccccactgtcaacattagacagatcaacgagacagaaagttaaaaaggatatccaggaattgaactcagctctgcaccaagtggacctaatagacttctacagaactttccaccccaaatcaacagactatacattcttttcagcaccacaccacacctattccaaaattgaccccgtagttggaagtaaagcactcctcagcaaatgtaaaagaaaagaaattataacaaactgtctctcagacaacagagcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaatataccagaatctctgggacgcattcaaagcagtgtgtagaaggaaatttatagcactaaatgtccacaagagaaagcaggaaagatctaaaactgacaccctaacatcacaattaaaagaactagagaagcaagagcaaacacattcaaaagctagcagaaggcaagaaataactaagatcagagcagaactgaaggaaaaagatacacaaaaaaacccttcaaaaaatcaatgaatccaggagctggttttttgaaaagatcaacaaaattgatagaccactagcaagactaataaagaagaaaagagagaagaatcaaatagatgcaacaaaaaatgataaaggggatatcaccaccgatcccacagaaatacaaactaccatcagagaatactataaacacctctatgcaaataaactagaaaatctagatgaaatggataaattcctcaacacatacactctcccaagactaaaccaggaagaagttgaatctctcaatagaccaataacaggctctgaaattgaggcaataattaatagcttaccaaccaaaaaaagtccaggaccagatggattcacagccaaattctaccagaggtacaaagaggagctggtaccattccttctgaaactattccaatcaatagaaaaagagggaatcctccctagctcatttgatgaggccagcatcatcctgataccaaagcctggcagagacacaacaaaaaaagagaattttagaccaatatccctgataaacattgatgcaaaaatcctcaataaaatactggcaaacagaatccagcagcacatcaaaaagcttatccaccatgatcaagccggcttcatccctgggatgcaaggctggttcaacatacgcaaatcaataaacgtaatccagcatataaacagaaccaatgacaaaaaccatatgattatctcaatagatgcagaaaaggcctttgacaaaattcaacaatgcttcatgctaaaaactctcaataaattaggtattgatgggacgtatctcaaaataataagagctatctatgacaaacccacagccaatatcataatgaatgggcaaaaactggaagcattccctttgaaaactggcacaagacagggatgccctctctcaccactcctatttaacatagtgttggaagttctggccagggcaatcaggcaggagaaggaaataaagggtattcaattaggaaaagaggaagtcaaattgtccctgtttgcagatgacatgattgtatatctagaaaaccccattatctcagcccaaaatctccttaagctgataggcaacttcagcaaagtctcaggatacaaaatcaatgtgcaaaaatcacaaacattcctatacaccaataacagacaaacagagagccaaatcatgagtgaactcccattcacaattgcttcagataataaaatacctaggaatccaacttacaagggatgtgaaggacctcttcaaggagaactacaaaccactgctcaatgaaataaaagaggatacaaagaaatggaagaacattccatgctcatgggtaggaagaatcaatatcgtgaaaatggccatactacccaaggtaatttatacattcaatgccatacccatcaagctaccaatgactttcttcacagaattggaaaaaactgctttaaagttaatatggaaccaaaaaagagcccacattgccaagtcaatcctaagccaaaagaacaaagctggaggcatcacgctacctgacttcaaactatacaacaaggctacagtaaccaaaacagcatggtactggtaccaaaacagagatatagaccaatggaacagaacagagccctcagaaataatgctgcatatctacaaccatctgatctttgacaaacctgacaaaaacaagaaatagggaaacgattccctatttaataaatggtgctgggaaaactggttagccatatgtagaaagctgaaactggatcccttccttacacctcatataaaaattaattcaagatggattaaagacttaaatgttaagacctaaaaccataaaaaccctagaagaaaacctaggcaataccattcaggacataggcatgggcaaggacttcatgtctaaaacaccaaaagcaatggcaacaaaagtcaaaattgacaaatgggatctaattaaactaaagagcttctgcatagcaaaagaaactaccatcagagtgaacaggcaacctacagaatgggagaaaatttttgcaatctactcatctgacaaagggctaatatccagaatctataatgaattcaaacaaatttacaagaaaaaacaaccccatcaaaaagtgggcaaaggatatgaacggacacttctcaaaagaagacatttacgcagccaaaagacacgtgaaaaaatgctcatcatcactggccatcagagaaatgcaaatcaaaaccacaatgagataccatctcacaccagttagaatggcgatcattaaaaagtcaggaaacaacaggtgctggagaagatgtggagaaataggaacacttttacactgttggtgggactgtaaactagttcaaccattgtggaagtcagtgtggcgattcctcagggatctagaattagaattaccatttgacccagcaatcccattacttggtatatacccaaaggattataaatcatgctgctataaagacacatgcacacgtatgtttattgcggcactattcacaatagcaaagacttggaaccaacccaaatgtccaacaatgatagactggattaagaaaatgaggcacatatacaccatggaatactatgcagccataaaaatgatgagttcatgtcctttgtagggacatggatgaagctggaaaccatcattctcagcaaactatcacaaggacaaaaaaccaaacaccacgtgttctcactcataggtgggaattgaacaatgagaacagatggacacaggaaggggaacatcacacaccggggcctgttgtggggtgggggcagcgaggagggatagcattaggagatacacctaatgttaaatgatgagttaatgggtgcagcacaccaacatggcacatgtatacatatgtaacaaacctgcatgttgtgcacatgtaccctaaaacttaaattataataataaaaaaaagaatctgagactcccctcaaatatctttcattgaaaccattcctctgatgctaacaggacacggatgctgaatggccaccatggtgccctccaggccaggccatagttttcttcacaaagagccaagcctcttagttcctggagtgggcaaggcaaattccagcttccaagctttatctagaaacatgaacaaatcttaatttttcagggctttattttgttaggttatagattatctaagttttgcgtttctccttttcttctctcatagctggagggattcctcagggatctatgctgtcactgatgcaattttatagttttgtaagtaatagaacagagaaatgaaaaatgaaattgccaaggctataagatcttccaggtcaggaaaagcaaatagaaggtgatgagctcccgtaagactgtacaaagggggagaaagataacagaggaatttcaacacttagttctaaggggaaagattgtaaatgatcattatgagactgttgggcatatatttaccaacccaagagaagacctcaaaatcactgtaggctgttctttgaagatactagtctatgtaccattgcacactggtcagaaaaacctagctatcatcagaaagcattttagaaatcaaagaaaaaaatttctatccttatataaaatcatgatgaattcgtacctgaaacactgcaaccagcttgaacagatataaagggaccagagaatgtttacagacaggctactaatatgattaagggatgaaggtttctttttaagagagctcttcaatctaaaaggtaaagaataagaggctatatataatcaaaatctataaaatgaagaaggaggcatatttcagcactgtggaggtggacagcatctctgagtgctgcattcaggacggttacatcaagggctgcctcaagcagcatttcaattgttcttcatctctggcaaattcttaccatttgggacagttgaagaatagtcagttctattggaggcagaatgatggaaaagatgaccttacaagccttcctccagtttcacctttttgtaattcagtacccttggcctaatttctctagcttatattattaatcttgaaaagggggctccatgtgtgcaaggggagatatgtaacaggaaaactggactaactatacatatttccttattcactggcatagctttaacctgatgaacttgtctggtgataatggatgcaaaacctgtaagctctaggcatatccctgccagttaataccagtgcatgattactagaaactgttagcatttctctgaattttgagtaaaatacatgctatttaagtaaagtggtttatcaccatagcaacaatttctagagtcacacattcaaattataggcctgcacaaggtccaaatgacaaaattctgatataagtttaatgctatagttttgtgtgtaatggctacccaccttcctcacatccctatggttttcagaagaaggaagggaaagaaaagctaagggaagaagaaaaattgacttccaaatatatagacttctaaggttacttgcataaagatctgggtcttgtgtggagtcaacagaaatgaaatctaacttgcaaattagagaaaaatataaatatctttcttttctttgtaactgaggtataatctatatacagaatacacatatctgaagtgtacagtttgatgagttttgacaaacacttaggcctgtataaccaacaccacaatcaggaaatagaacaattaccaagaaagttctctcttgccacaacccagtcaaccctcttctcctgggggccacaactattctgattttttcaacataaattagctttgccttttctaaacttcatatacatgaaaaagaatgcattatgtactcttttatatctgagttattctgcttaacatttttaattgaatttttattcagatattcgtagattctcatgctattgagacataggtttttgagattcatctatgtaatagtaactcatttcttttttcttgccaagtaatgctccattgtatggatgtaccacaatttgtttactcattcttctgttaatgaatatttgggatgtttccagtttggggctgcttatacataaatccgctacaaacatatactacaaatctttttgtgaacttgggattgctggataaatggtaaatgaatgcttaaccttaaaagtaaatgccagccaggcgcggtggctcacgcctgtaatcccagcactttgggaggccaaggtaggcggatcgcgaggtcaggagatagagaccatcctgactaacacagtaaaaccccatctctattaaaaatacaaaaaattagctgggtgtggtggcacacctgtagtcccagctacccaggaggctgaggcaggaattgcttgaacccaggaagcggaggttgcagtgagctgagattgcgccattgcaatccagcctgggtgacagagcaagactccatcacacacataaaaaaaagtaaatgccaaactatattctgaaagaatagtaccattttgcattcccaccagcaaggtgggaaaattccagttgtttcatatccttgccaatatctggacttgttagtttttaattttggccgttctagaaagtatgtagtgatatcctgtggtggacttaatttccattttcctgatgactaatgatgtttagcatcttttcatatgcttattgactacttgtatatcttcctatgtgaagtgtctgttcaagtctactgactattttaaaacatggattgccttattgcaatgtaggagttgtttatatattctgcatgcaagtcttctgtcatatatatttattgcaaatattttctccctgtctgtggcttattttttaacatgcttttgatgagcaaatgtgttttatttttaggaatcattttaccagtttttaaaagtgctttctgtgtctatgttctaagaatctttgactatctgctggatggaagatagtctcttatgttttatcctaggagctttacagtttcgcttttagatttagttctacccttctcaaactaatttttgtgtacagttttagctagggggtcaaatttcatcttccctcatatatatctactattgttctagcattatttattaaaaagactatcatttaccccttcgaattgctttgaaatctctgtcaaaaatcaactgactgggccgggcgcggtggctcacgcctgtaatcccagcactttgggaggccgaggtgggcggatcacgaggtcaggagatcgagaccatcctggctaacatggtgaaaccccatctctactaaaaatacaaaaaaattagccgggcatggtggcgggtgcctgtagtcccagctactccgcaggctgaggcaggagaatggcgggaacctgggaggcggagcttgcagtgagccgagatcgcgccaccgcactccaggctgggtgacagagcgagactccgtctcaaaaaaaaaaaaaaaaaaaaaaaaaaatcaactgactgtataaacatgggtctatttctagactcccaattttgttctactaatctatttgtttatccttacatcaataccacattgtattaattactgtatctatgtagtaaatgttgacatcaagtcatataagtcttgcaactttgttctttttaggttattttgtctgttccaggttttatgtatctccaaataaattttagaatcatcttgtcaatttataacaaaaaagcaagtgttctagatttcaactgggattggtttaaacatgtaagttaatttggggagaactgacatcttaatagtaccaaatattctaaaccataaacatggtatatctctccaactatttcagtctttttcaattttgctcaacagcatttcatggttttggtataaatattttgcatatattttgttagatttttcactaagtgttttatgttttgtggcaattagtattttaaaattttatttcccaattgttcactgcgaatatataacaatacaatttttatatatagatcttgcatccagcaacctctttaattcactttttgtagattccttgggattttctatgtatacaaacatgtcatctgcaagtaaagacagttttattcttcctttacaatatatataattttatttcttttaattgccttgttgcatcagctagaaccttttgtacaatgataaagagaattagtgagagagaacatcgttccttgcctttctcctatctttagcatgaaaatactcaatattttgccattaagaatgatactaattgtagttttggattttttttttttgtaaaatctcttattatgtaaaagaagttcccttttattcctagtctgcagaggattttctcatgtttgagtgttgaattttatcaaatgcttttcccaaaatcattgagataattatatagctttctcctttatctatacatagtgaattatgttgtttgatttttggatgttaatccaaacctgcattcctggaatacactgcaaacacttaattatgatatgctattcttttatatatttctggattcagtttgctaatatcatttgaaatttttacgtctataatttatgagagatattggctaataattttcttgtaacatccttgtcatgtttaggtattgttgttatttataaggcaaacatgccttataaatgagttgggaaatattctcaagagttggtgtataagttttctcttatttcttcttcaaagatttagaagaattagacagtgaaatcatttgggaataaagttttctttttagtaaagttctttactacagacatgattttaaaaataaatacagaacgattcagattttctatttttgtgtaactgtttttgtacttttaaaagaaatttgaccatttcatataaatttctcaatgtactggcattaagtcattaagagccagtaagcctgaagatagatcaatagaaagtatccaatgtaaagaatagaaaaaaaaagattaaaaaatggatagtgcctcaggaacctatagaacgatatcacactgtctaatatatgagtaattggagtctcagaaaaaaaaggaaaaggtaatgacaaaacttccaaaacgtggctaaaggtacaaatttacagattcacagagctcagcaaaccccaagcaggataaaagtgaagaagaacacgcttagcaatagcattgttaaactgctgaaaatcaaagataaagagatgaccttgaaagcatccagagaaaagtgacacaatacatataagtgaagaacatttcaaatttccacagatagttcatcagaaaaaatgatcaaaagttaagaaaaaaggaaagaagagtatcagaaatgataactatctggataaatataagaaatttttcctcttaatttcttgaaaacatacatgacaatttaaagcacaaattatatcattattttgtggggtttataattatgtagatataatacatgtaacacttatagcataaaggtagggtaagagataaatggacccaaattaatacatttgaaattgaagcaatacttgttataacccaacacaatgggttggttctctatagagaaaggatatgcatagcatggccagacagctataggccctaaggggagctgagcaaaagtcaggcttgggaagagagggaagtgatttaaaggattcactaatacatctttgcaaaaatgggaatctggttaagcctgtggtaaaacctaagccttatacaaaaagctcttgtgtgggagtagaagtagggacaaaatatccccttagaacaaaagccttgtttatgggagcctatgaatccaggccagcaactcgcattgcaagcagcattagatcaaataacaggtcaagattcatgttagcacaattagttatttgtacctgtattagtctgctattgcagtagttattcaactatgtttgagaggtccccacaatcacccccaggttcaatgagtcactgggaggactcacaggacttgacatttatattcgtactcatggctatgacttattacagtgcaaggatgcaaagcacaaccagcaaaaggaaaagacacttcaggctaaatccaagagaaaccacgagcaagcttccaagtgtcctctcccaggggagttgcagaggatgtgcttaattccccctgcaattagttgtgacagcatatgtgaaatgttgccaaccatggaagcccattggagactcagcatccatggtcacgtaggcagcctctgcctagcatctaccaaaatcccagactcccagaaggaaagtaggtattcagcataaaccatattgtttgcacaaacagtttagacaaaattagctaagttcccagaaatgagccaagggtcaaccttgcaaataaataggtcttttgaaggatagcagttgaggccacctatttaactcttttctgcacaactatacaacaaacaactgcaaaaatctcagtatcttgtaacagcaagtatttatttttctcaattaatttcagtttggttgtgccaggctaaacttcaagtattagactgaattcagatctgttccacaaatctccacaattctggaacctgtggctttctgcaggcatgctcttctcacggcaggtgacagaaatagaagagagcaagctaaatcatgcaaacacttttaaggtctctgctttcattacacccttttaacgttccatcagccagaataacggccaagaccaacattagtaggatgagaaaatagccttcaacagttctaccagggagaactgcaaagtcacatggcaaaggatatgcatgtacaaattatttacaggaaaggaataattaattggaaacaagaatccaatcttccacagtaccttaagtaactcaccaaactcagagggcaaacaaggttagaagcagcacattatcacttctgaaaatgaaatttcttggtctgtttactagtttattcccacacttatacccaaaggagccttgatacagccaggaaaatatatgcaattttagtaatattctatatacatttttagtaatataataatgaaagcattaatggctaacattaataagtacttaccacgtgacaagagtgttacgtgcatgatttcacctagcacttagttggtgagattattattcctattttacagatgagaaaatggaggcctagagacttgccgaacatcataaagcttgtaagtggtgaagccagaatctgaatccaggcagcctagatccgaagttatacttttaactattatgatattttaagggctgtgcttgggtacatatgccatattgcaatgcttcaatactgggataagaaagtgtgccacaattatgcaagtactgtcacattttcatatgatagttctcatggactcagaaagctaaaatgtaattttcaggaaaagaaaatttttatcccactcactaaaatatcacgaaaatttaagtttttcctcacagaaacattatcaacatatcaaagtattaaatttcaatgttatttaaatgtcaacatttcttgtctttgaaaaaatgttttacgaacacataccatttatcaaaataatttttcaaagtttttaaaccaccatgcctttctactttctagcctagataaagcaactgctacatgtactatctcctacaatactataacaactaggttttcagtcaaggaaaaattatcacaaaagaaaataatggcaaaaatctattttcttttcttttcttttttttttttttttttctgagacaaagtctcattccattgcccaggctggagtgcagtggcgtgatcttggctaactgcaacctccgcctcttgggttcaagcgattctcctgcctcagcctcccaagtagttgggattataggtgattgccactgtgcccagctactttttgtatttttagtagagacagggtttcgccatgttgtccaggctggtgttgaactcctgacctcaggtgatccacccatctgggcctcccaaagtgctgggattacaggcgtgaaccaccacgcctggcctgaaaatcttctattttcattaaacaaattcattcaagactgtgttaaataaacaattttataactaggaagtttctccattacaaagcaagaattccataatggaaatatacttgtattgcatctagagattccagtcccttcctctatggttatggggaggtatactttaattatggacattcatttctctccaattgttttctgagcttatgaataatgaaagcatataccatttatcaggcatcattaaggacctaatgttaaaaggcacactactgcaataagcagtggtctgccaagtgtctcatcagaagatgagcaaatgctattgcaggagtgaaagtcaagtctatccagtaaagctgataaagactttgtcttagagaattcagaggattaccaatagcacaaaacattatctagatgtcctcggcatgtgagaaacaagatatacatgagagaacattactgtcctcagaataccataaccaatggtggaaataaacaaaaggacattgccaagtgccaactatttgaaaacaaatctgaaacaagtgtgtgatatcttagtccaaatatgaacaatgaggagatgcagactgcattttcccataatgtccgaggcatttggaactaagggaccattatttagggaaggaggaaggtgctgagttcaagtgcttttgcttttgtttttgtttttaacacatcctcacttaccctgtctgctagttttccaagagctctgccattgtttcaaaaggtgtgattaccctggcttttgagaaattcccaaacctaagcatgggaaagttccttagaggacatcaagggaagacaagctcctacccaccttgcaagaattactgttatggcatttataacaagtagccttccagagtctgcttgaatacttccaatgatggggaggtggaaggtttgttacccacggcccagcctttttccattgctggtgaactctgactatggaaaaatttttcctgtcgatgaaacctacattcctaaaatatcaaccaacattcttaccatttctatattcttgaaatgtcaacccactggtatagttctagcatccacaaacaattcaaattccaattcttctgttccctagttgatgtagctgagaatcacatcataagtttcattaatttgtgacttgcaggggcggctggaggagtgggaggggaaaagtgtgacacggcaatggaaaaggggatggaagacatttggttcgcaagcatattttatgttagatgcagtgacaaatacaactcaaggccacaaaacgtgtgtataattgtacatatgtgagtatatgtagatgtatgtatgtgtaagaatatgtgagtatatgtgtatacatgtatatgtgtatgtgtgtgcataagtatgtatatctgtacaaaatgccaagtcagccaacaaaaatcttcaaactatgttcaataagaaatgcaaacatggaattttatgatattatttttaaggagaatataaaatacactcaagagctaagcatcgtaggagttaacacactagagaggaaaaagaattcaatgagcttatgtctacattatggtaaaaatattataatctcaaaatatctaaatcattatgttatgcttattatctaaacatttgctataaagtaatgaagaagttctcaaccactaaatcaaaatcaatgaatagatcatgttaccatgtccctttctgtaagttactgagaggattcttggcatggaggggtgtaggccagcaatgctgcacctccctgaatctggtccaggatttaccctggcagtccctctctgcactctgcctaattctgatttctagaatcagaaaccagtgactcctcacgagaagtctggctaccctgaggtgaacacagtccctgctggcaggatgctcaattattaaataatagttcagatatgttaattagatttcaagacaggaaggagaacaaacacatacagagaaattttctgcaaattcagaaacaaacaaggaagcagggaagaggacctttgggtaaactttgtcaggatatccagttaacggatcacaatctagaactaatcaaaatgttattcaattctattcattaaaaagaataaaactgcattcagaactaataaggtaaaataataaacctatataaaaagtttttgttaccataaattcagacacaaataactgaataattatcattttctaagtaatacatagatccattccaaattctatagtctggtagagtacaaaaattattaattttgattcttgggccaaatttggcatgccatctgttttgggggaaaaaatagttgagttggaacatggccacactcattcatttgttgtctatggctgttttcacgctacaacgtcagagatgagtagttgtgacaaagactactagggcccacaaagcctaaaatatttactgtttgttcccttacagaaaaagtttgcagacacctgccctacataatcaccaaccttaaaataaacatgtaggccacctcgctaaatcatgctagccttataaggcagaaagaactttacttgctatataacgctcggcctttgttacaaactaacaacaaaaagacagatttgcaaaaaaaatgttccaggtgtggtgagggtattttacacttgggagaaatgcagcaatgattcttcctacctgtttttcctcctcttcatctgaagtgtaattggcatcagggacatttccccagggttggtaacttttcaacttttcttcagtggacggcttattcttctcttctgttgtgttttcctcaacactttctgggttatttttccattccttcatcatctctaatacattggttggtctcaccgaagaaagtttattgccctaatattaacaatcaatttttggtgttataaacaacttagagaattgagacgatacctacatcatttagcgagacagtctcccaaattcagtaatagtcacatggaaaagattataatgctgaataaatatgaaaacttctgatgaccactggagtacaacccctgtactcacatggctcacatcccttgcatgatatcacgtgtaatatgtccaagttaacaggggaaatattcaggcttgaaagaacaatgcagcatgcttgtgcaaagaacactacacagggcaatttcctggaacccaaatacccctatagcgctgttcttagaaaattgagagggaggctgaaagaactaaagaagttgcccaaacgccagtgcgtccagtgctaaggatgagtctatacaacatccaaatatctaggcaaaaaaaaatctaaattcagtcaattagtcaagcactgtgtctaagaatatagatatttaattggaaatcccttacctgtctggaagatttaaatataatgtggtcatttgattataactgacttggtacagtgttcttatcccagcatatgactataccatgccaaaattgaccattttatattaactgtattttcccaaatataataccccatgtaatgtgccaagaaatatatgaatgcaagctcaaatagctcctgcttgattaggtgtgtcttaaatatttttgttcttacctcatactgttagaaaaaatttagacaaaaaaatggatcatatttagattaaaatgagaagttcaggtgtgggcatggctatgaagcgattctaaattaccctggtatatggatgtattgaaatgtttagcatcagtgacacagaaaactataagacagggtactttaggggtacccatctgaatacactgttgaggacttgttgagtttaatgtatttgtggctaaagacatagacaaacactaaatatggaatgctaataactaaatgaggatcactacgcaattaattctctgtgattcttctctgtccccttgttttaagaagctcagtactcctaccacgttcataacatcccattacaccttacactggttttgcacttgtttgtcccttacctacttactcctagaatgccattgccatttcttcctgccagtccatagcaagagcctacatttccttgaaggttcaatttaagatccatttctgtcagatatcccagaattcccaactatgtagtcaactcaagtgaaaacagacagtggctcagtgacagtaaccattaaagagctgaaatcaggtagaatggtagatagtctcagagcactcatctgaacgggttctgctctccagggctctgcttggtccctatgatccatctctcctctcttacaacttcttggcttcatcctgacctctaacttaattttcataaaatcagtgaccagggtcctggaatgcaagtacatacaactttgcctcaacttgattctttcactagcagaaagtgacaatctgacacatctaagtctgcaataccagttctcagtggctcctccctgacaagccctctccaggttaagtctttggaaactgtggtggtcactaatgctactcgcccagcatttcttccttctaggctcatggtagagtttcacttctctatccactttgggacatgaccatgtgccttactttggccagtgattcatgattggaaatggtatgtatcacttctgggtgaaaactttaagagatagtatgcaattcatcatgtttccaattcctgaactggtaattacagaagcatagagatggagtctccctcagcctgggttcctgagtaaggacaaagtgaaacagaacctcctcctctcctcccagccaattggtcatggaaggtactaagagcactgagatttgggtgtcatttgtcatcacccaagcataatctagcttaccttgatatagataccaaagcaaacatttacattctgtaaatcacctctaagaagccttaaaaagagtgactttattgtaaaaccatcaggtccaacaaaattataattactacagaactcatatgcaaccaatatgatgtgacagctcatttatttaggcagttcttgcgctgcacagtcctgatatgcctgaatttcagttataatttacttaaacagcattagtcccccaagagcagtttaaatttcagtcaacatggtatatgaactataactgcataaagttcaaactgcactgctagctcttcagtccacaaggcacacaaacgcatatcatgatcagtgaccaattttgtcacttctctcaaaggctgttggtgattagacattaggcatctgctattcagttcacacatagacagcaaagtgtgtatttgtgttgcctccttttctcccagggaattagccaacaaagatgaaagtgcagcaaagaaaataaaagtgataatgccgaaagtgaaaactgaataaaatacgaatggagtaacagaagaaattgctgactgggaatgctgacactaccaccgttcaacagagtatttgccaaggcataaaaaagatgctccctctgtcttataagttatatggtaagaagaaggtaagcactatttaaatgaatcttaagtattttatttaaaaagacactttaattctcagtatttctaacattctaaattacagtgtactaaatgaacatcagctttacttttgtctcatttccctacatatttataaccaacagagagttattaagattttgacaaaaaggtaaagggcatgaaacaatcataacttttcacattgattattgagatcattttttcacagtttcatactgctctgctattttactgtcccacactactgtacaaagcaaggattgcctacattattttgaatctgcatctctagcaatctttcaaatgcctggttcacatacacatacacccaagagcttggtagctgagattctacatgtctaaaggagagtgccttagtacttgaagaaatgaccctacttctcattctatagagactgtggagaaaagcaaaggatccagaataagagtattatccctatttcctatgtggaaatttttagctctttgcctcctatactcacttgtgatatcaagcctggactaggtggtatagagtccaggctttgcctgttgtctaatgtgcatctggataacttactataccacctacttcttgcttgctagcagctgaaggataaattgtatcagatacttggactaaccaataataagtggtccacaacaatgtatcatgagccttctagttcaacagaaattacaaatgaagcaaccaaacaaaactggggcagaactgttagggcagacactgtagatgtacatgtcacctcaccatcagaacactaacctctgaactccttttactggctgcatctaggtgatcaaatactgaactcatcaattacaaaataacaaatgacaagaaagcagtagcaatagtttgatcatctgaagctatcacaggtagagaccagccttttggataaataaatttccacttgcttaaccaacagatagttgagactattaatttaatatcgaacaactagaaaaatgaaactcatggaagagaagaactgcttaaatactaagatttgaatttaatcccttagtagacaggccccataatggagacccaatcacatttcctcatctaaaaaatactgccttttaagagatagtgcctatcagtgctttgtaaacagtaagcacttaataagctctttaaaataaatgaatgaataatacatatgagctggggtgagatggtatgagtccaaatcggcgaagctaaaggaaacattctggatctttagcatgcagtcaccattctctgtttttgcaaagagctagaagactttattttgtaaagttcctaggagtaaattttttcagtagaaaaatggaacactttatttaaaaacatataaaagaatggccaacttcaaaaaataaaattcaagtcaaaacaatgtggtgtcaattttcacctaatagatagacaaaaatttaagtttgatattccctgtgtcggtgagggtgtggaggaacaagcactctcacttacttgctttttatgagaaggtaaattagcaatacttgatcaaaatgtaaaatgcacattctctctgaccagtaagtccactgttaaaatttatcttatataaactggcacagtatgcaaacacatatttacaagaacatctgttgtactactgatgtaatagaaaagatctgaaacaatttaaatattcacagggactatttacaaaatagtttatagtttgggatataatgctggcttttcattttttttttaatttttaactttttttaggtccaggggtacctgagcaggtttcttatataggtaaactcgtgtcacaggggttcgttggacagattattttgtcacctagttactaagcctactatccaatagttatttttttctggtcctctccctcctcccaccctcaagtagtcccagtgtctgttgttcccctctttgtgtccatgagttttcatcatttagctccccttctaagtgagaacatgtgctatttggttttctgttcccacgttagtttgctaaagataacagcctctagttccagccatgttcccgcaaaagacatgatcttattcttttttatggctgcatagaattccatggtgtatatgtacattttctttatccaatctgtcatttataggcatttagactgattccatctctttgctattgtgaatagtgctgcagttaacattcatgtgcatatgtgtttatggcagactgatttatattcctctgggtatatacccagtaatgggattgctgagataaatggtagttctgtttttagctctctgaggaatcgccacactgcttcccacaatggttgaactattaataatttacactccacgcaacagtgtgtaagtgttcccttttctccacaacctcaccagcatttgttatttttttactttttagtaatagccattctgactggtgtgagatggtatctcactgtggtcttgatttgaatttctctaataatcagtgatcttgagcttttttcgtatgcttgttggctgcatatatgccccatcttgaaaagcgtcatctgttcatgtcctttgcccactttttaatgaggttgtttttttttctcgtgaatttaatttccttttagacactgggtattagacctttgttagatgcatagtttgcaaatattttctcccattctgtgggctgtttgttgatagtttcttgtactgtacagaagctctttagtttaattacataccacttgtcattttttgcttttgttgtgattgcttttggcgtcttcctcatgaaatctttgccggtacctatgtccagaatggtgttgcctagattgtcttccagagtttttacagttttgcattttacatttaagtatttagtccatcttgacctcatttttgtatatggtgtaagaaaggggtccagttttaatcttctgcatatggctagccagttatcccagcaccatttatcgaatagaaagtcctttccccactgcttggttttgtcagctttgttgaagttcagatggtcacagatgtgaggtcttatttctgggctctctattctgttccattggtctatgtgtctgttcttgtacccataccatgttgttttggttactgtagccctgtagtatagtttgaagttgggtagcatgatgcctccagctttgttctttttgcttcggattgctttggctatttggactctcttttggttccatatgaattttaaaatagatttttctagttctgcaaagaatgtcactggtaatttgataggcatagcagtgaatctgtaaactgctttgggcagtatggtcattttaatgatattgattcttccgatccatgagcatgtaatgcttttccgttttttttaagaaaatcttccctatatattaagtgaaaatagttgcataatatgaacccatttgtgtaaagtatctacataaaaatgtatggaatgttttttgaaagcatacataaaagacttaatgatggttatctttagtgagagggaatgagagaatgagaggagaaagcaagttatttttcccattttgtttactcacttaaccatggataatctcaattattaccttaatttattttattattatttttgttgttgtagaggagtctcactatgttgcctaagctggtgttgaactcctagattcaagtgatcctcctgcctcagcctcccaaagtgctgagattacaggtgtgagccaccgtgcccagcctcgactattaccttttacctttacatgactaataatcaatgtaaattatagtaagaaaagacatgatgtaagttttagatacccaaagaggactgaaagcacccaaaaaatcaccaaacatgtcctgaagtgtttcagagtccaaggcagcagaatatcaagataataagtaaagtagtcaactgtgtaccactttcatgtttttcctaacaaaatcacctcagtgatttttttccacaagtatagtaactatgtgagtagataaggcttttttattaatattcctattcttcaggagaaaacggtttgagaaattaatgaatttacccttattccagaagtgcatttcgaattgcctgccaagaatttctagtgagaggtatagctgagccttctactcagtgtattctaaaccacgcaactacaaaacaagaaaactagaaaacaaacaataacttgcatccatacacctagttttcctccttcttgtcttcctgccttctatcacctgaggtgactgctatccagaatcttgtgattaacattcccttgcttttgttttgtatatattttttatcacaaccatgtgtattcaaaaaggaatattgaccaggtgaggtggttcaagcttgtaatcccagcactttgggaggatgaggccagaggatcacttgagctcaggagttcgagaccagcctgggcaacatagggatacccctactttacaaaaataatttttttaattagctggacatggtggtgcatgccggtagtctcagctacccaggaggctgaggcagaaggatcacttgagcccaggagttagaggctgaagtgggcatgccagcctgggtaacagagcaaggccctgtctgaaaaaaaaaaaggggagggggggaatattttttgttttagttgttttaactttcataatattattccttttttgcttatttccagtacaaaagccttttctcagtttataacttatcagctttccttctggtgttgttttattaacaagagttcttaacatagacaagctaatccatcatttcttttatgttagtgcctttggttatgttgcttatgaaatcctttcctacacaccccaagatgcagaatatattcacctatatttccacttagagtttcaacattttggtttttactataagtccctgattcctttggagttgatttttgtctgtggtgtgaaatagaaatttaactttactttttccatatggagaactcttgattccagctccatttattgaatagtccctcctttctcccctctcatcttccatacgacgactgtcagaaaaagttccagatacacctggatatgtttctgtactctgttttattctgtttgtcaataatcatactgccctaattaacatagctttataagtcttaatatccggtagagcaagacattcagaaatttcttggctatttttgatcctttagtcttccacataaattttatagccaggaaagtttgtgaaattttgattgtatttgcactgaatatgtatatcaatacgggaaaaattaatttttgatattaagtctcctgacacatgattgtgatatatctttatatttatgtattcttcaatgtttttcaataaaatgttctaactttccccaaggaggtcttataaatcttatgtcatgtttattactagatgttttatattctttgctactattttacatgatgtcttcatttttattacattttctattgttagttgctaatgagtagaagtgcaattgacttttgtatattaatcttaaatccagctacctttctcagctctcctatttctaataacttatttgtagattactataaataataaatcttatttctgtttttcaagtctcactttagtcttcagttgactaagatcagcaatgttggaagaaaaaaaagctgactttcttgactattctctattttaaaggaaatccttctcgcatttcctattcagaatgacattttctgcaacattttatcaggttaaggaagttttcttttctttttaatcatgaatacatgttgagtcttattacaaatgatttctctgaaatgatcatatgattttttcctttaatatattaatgtggggatttatacttacagattctgaaattaattcatcattgtattgttggggatactcaagttggccaagatatattatctgttaatataaacagctacatccaacttgctaatagtatgtctaaggttttatatctatattagtaagtgaaatggatagttttcctttgtcacaatgtcgtggtatagttttgtatcctgcagtttagaaggtatagtcttaggataaattaggaaaatttttctcttttgaggggtagaagaagagttataagtttaagatgaaagtatggtagaactctaaaattatttgggcctggtgttttgcttgtagaagattttgaactattgcttcaatttatttaattattacaagacagttcaagttttctatttattaagactgtcttgtataactatatttttctaggaaaagaattgttttcattttgactgagtttgcagacgtatttgcatacacctagtagtattacctagtagtattctcttatctttgtaatctctcctttatctacggctatattcccttttccatatgtaagattttttttctctctctcttttttttcttgagacagggtctcacattgtcacccaggctggagtgcagtaatgcaatcacgagtcactgcagcctccgctctcctagactcaggtaatcctcccacctcagcctttcgagtagctgggactactactaaaactcagccgggcatgggccaccatgcccggctgattttttaaattttttgtagggacagggtctcactatgttgtccaggcttgtctcaaactcctggactcaagcaatccacccgccttggcctcccaaagtgctaggattatagccatgagccaccatgcccagcctgttttctgtttctttcttaatttcaccaaagatttatttattttgtttttttttcaaagaaccaaatattgaccttgttgatcttttctattctacctttgtgttctatttagttgattttcgctcttagtttgatctttcctactactttatttggttttactctgttaaaattctgaaatttttagatatcattaattttctgtatttctccttctctaatataaatattaaacttctactgaagtacatgtttgctgtatcctccaagttttggtatgttgtattttcattatcactcagttctaggaatttaaattttttcttattggggtttattctttaacttatgagttgtttagaagcatgtgatttattttccaggtatatgcagatatttaatcttgttgtttactggcttttaactgcgtattattagagaacatgatctgtgttaactttattaaggcttccttgcttcacggcctaggacaagaccaattttggtaaatattccacatgtgcttgagaacatgtacattctctaattagagaactgtgtatgtgtctactagaataagcttgtcatattattaaaatcatccatatatttttgtttctttgtttcatatatcagtagttgagagaagtgcattacaatctcctactataatggatttgccaatttctccatgcaatgttgtcaatttttgatatatatttaaggttattttattagttgcatacattattaaaattactatataatctttttgagttgaatctttaatccttataaagtgaccttctctatcccttaatgatgatttgtttgtgttaaggtatatatatatttttattatactttaagttttagggtacatgtgcacattgtgcaggtttgttacatatgtatacatgtgccatgttggtgtgctgcacccattaactcatcatttaacattaggcatatctcctaatgctatccctcccccctcccccaaccccacaacaggccccggtgtgtgatgttccccttcctgtgtcctagtgttctcattgttcagttcccacctatgagtgagaacatgcggtgtttggctttttgtccttgcgatagtttgctgagaatgatggtttccagcttcatccatgtccctacaaaggacatgaactcatcattttttatggctgcatagtattccatggtgtatatgtacctcattttcttaatccagtctatcattgttggacatctgggttggttccaagtctttgctattgtgaatagtgccacaataaacatacgtgtgcatgtgtctttatagcagcatgatttataatcctttgggtatatacccagtaatgggattgctgggtcaaatggtaattctaattctagatccctgaggaatcatcacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgattcacatttctctgatggccagtgatgatgagcattttttcacgtgtcttttggctgcataaatgtcttcttttgagaagtgtccgttcatatcctttgcccactttttgatggggttgtttttttcttgtaaatttgtttgagttcattatagattctggatattagccctttgtcagatgagtagattgcaaaaattttctcccattctgtaggttgcctgttcactctgagggtagtttcttttgctgcccagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagcaggttttcccagcaccatttattaaatagggaatcgtttccccatttcttgtttttgtcaggtttgtcaaagatcagatagttgtagatatgtggcattacttctgagggctctgttctgttccagtggtctacatctctgttttgctaccagtaccatgctgttttggttactgtagccttgtagtatagtttgaagtcaggtagcgtgatgcctccagctttattcttttggcttagggctgacttggcaatgtgggctgttttttggtttcatatgaactttaaagtagttttttccaattctgtgaagaaagtcattggtaggtgttaaggtatatttaattggtattaattccattatacaggttttctttgttagtgtttgcctgatatgtccttttccatttttgtgtttcaatatttccatgtctttctgcttcaaatatgcttcttataaatagtagagagctagatttttaaaaaattcaattagacaatatacctttaaacaggtattttaaaccaatgtacttgtaattatttctgtatttggacttgtttctcctatctaagcctgtttttgaaaagggaaaagttccctcatccccttggcagggcatgcagtggggggtgtggctcgcttcttctgtgtcccgcggctcaaacctctagagggaggatgcagatgggcacatgtggggttccaacaccagggcagcatctggaggtgaatgtttacagctcctgaagccccagtgggtgtgtgttacagggtgttcttttagtttacccatccataggtggcttgtgttagtcagctcaattagaccccctgcctcatcacaaggacagagggctttctgtatcccagggtttctagccttggtgtactggaagaatctgatcacacgcgggcttggagaatgagtccaaggttttattgagtggaggttctcagcagatggatggggagccagaagggagatggagtgggaaggtggttttcccctggagtcaggcagctcagcagcctgggctctcctccaactgccccagccaaactccgtattgttctgccggtggatggcttgcaggcctgctggccctatgccgcggagtgactctcaatgtccagctgcttgtgcgtctgcctgctagggtctcgggttttttacaggcccaggatgggggcatgtcaggcaggggtggtcttggaaaatgcaacatttaggcaggaaaacagaaatgcctgtcctcacctaggtctgtgggcacatgcctgggggtggagccctagccagggactatgccctcctctacctaccttggcctcccaaagtgctgggattataggcgtgagccaccatgcccagcctgttttctctatttctgtcttaatttttccaaagatgtatttattttgtgtttttttcaaagaaccaaatactgaccttgtcgatcttttctattttacctttgagttctatttagttgattttcactcttagttttatctttcctactactttatttgggtttactctgttaaaattctggaatgttaagttagatatcattaattttcagtctctgcccccttccatatcattgttatttcagtttctcccactctttatatgtttttcattccttcctactttaaaaatctgatgcctccatattctcctttagcacactttcatgtgctgctcccatgcccttgcccccttcccagtgctcctcatgtggatattatcatgaattttaattctgggttatcatgattatgttttctcttctttggttttgtgttttgtttttgtattttttgatatcagcgaactctaccaagacatttaaagactcttgctgcacatggctcttgtggcatctcctggatttgtttttcctcctctgtaagtacttctaccatgtgttttaactcctgtggcaaaccctctgagctcttgtatatttgaaaatatcttaatcattccctttaatatgaataacaatttgaatagatataacattttaactttaaagttctttttcccttaatacagttaacatattactccagttattcttgcatccaatgttgctgctgaaaagtaggatgtcaatgtgattcttgttcttttttatatgatctgctcattctctctgggagcttttagaatttttcttattgatgttttaaaatttcattacgtctatttgtcagtttttttcttctctcttattgggtagtctatcatctctttaaagctaaggtctttctttaattctgatgaatttatccccattatttcttaaacgatttcctcctccccctttttatttttgtaatctgagactcctattagatggattttggcacttttacttttaaccccatatatcttttcttttatattttcaacttatttatcctctcctgctcccttctgtataaagttctacaatctgatcatctagttttaaaattcattctttagttgtatctactatgtatcctatatcactgcattctatatttcaactattatatttttcatacctacttggttctgtttttatttcttattcttgcttcatattatcaacatcttcccttatctctcttagtatgttcactttgttaatttttaaattctaggactgtgtattctaaactctcttctaatggtgtttgaaacttggcccctaagctcctgtttcccaggaagcattggcaccccagaagacaaggcatggatctagagccagtcctggcccttggccttgggagatcaaggaagagtatggggaagaaccttagacaccaaaaacctgccccactaagcaactcctcagttcagggtttcacacttacccacctcctcccgccaggagaaataatctgaggaggaggtactcctaaagtacaccaaaagtatcagccaggagtcctagagtttggaggccaagaggtaagaagtcaatgcctacaacgagttaattcccacacattttccttggcttctcattcaggcacggcttcagtgctgctccgactttattacttcagacccttgtgaagggatatgtaagcactggtgtcccaaagcaaatgacaagaggaaaaaggaaaaaccgggttgttttgtgtttctattttaattccctgccttggctgcagcctcacccactatccataccagctcaagctatccctttattttcccagggatttctcactcttctctgaatcctggtatcatgaggtttctctctaaagttactttaggtttaatcttcagagaagacacagtatcttggcaggaaccagagtctcctccagcaggcccttcactgagtggtcttgaaacgtaactcaaacagctgtgatgaactgcatgacactactatgtcaaaactccttccgttcctatccacttatttatataaggttctcagtgtctattaaaactaaaaacaatacaacattgctgaatattgtctcattctaacaatagaaatattcaatcgtgtatgaatgaattaattgggagggaaagcagccctatccatccactaaagcatttccaatatgatactgttatgtttagtaattctaaaaaattataatcatgttctcttgatcaattatatactactgataataatcataatgaaaagtcattcttaaataatttttagaaattatagagccttagagtcccaggaaataaaaaaaaatttaaatataaatttgaactttttttgtaaaatgagacaaattataggtgattaataaaatccattcaagcaaaaatattacattaggataaaattctgtggaagaagtagaatagaaaaatagagacacaaattcaaagagaagaatgaataacctagtttctgttaaagaagaacttgttcataaatatctaaaagtgaatgagatggatgtcccatatgggtaaaaaactgatattagctttatttttaattacaaatgtttatatgataaattataccccttgcaattaattacatttatggtgaaaatttttaaagttcaacctaaaaatatctgagaagactcgtcatttttcaaaattcttttttgttatcattcaagcataaaagtttgaacagattgttccaaaaacacttcattcttgttccaatctacaaaaccagcacttctagactttaattttgtctcacaccattttcctagtcacctaagaagcagttttgattgctcttactctcttacctcacacttctacttagttacaaaattatgttttctttctcaggtcttctttctcccctcttctctgttcccactcactgccctagtttcagtcttcgttatcttaccccagtcctacttcagttctccggtttctgcttgccaccacgacaaccatatcacacactgttgccagataactcttactgaagttccgtctgtcctggcaaacaatgcatccaccaactcactaactgatagagtctcaaacacttggctacttgttcccagcctgttccaatactcatcttgtttctatttaactcctgactcttggttcacctcctcgttaagaccctgcttccaccctttagccaccacctgctccctcaagaccttcaactccaatttattcctagggctcttcctagattcaactgagattcagactatctcaggcaagatactacattcgagttcttccctcagaatctagtcactatctctagcccacagacctcatccaagtccactcacataacgctccaagggtgagagggacaaaagagaaaactcacacaagcacagcagcaatcatggcacttgagtgcctttcagtagtaagtcattgccaaatgaatcaaatgtaaactcttagggtctagaacaaaatagctctaaccttccttttcaacataatttcccactactctcctgtatgccttctatggttatagaaaaaaaggaactacaaattattctctgaatatacttcatattttttctatctttatgcctttgaaaagttatttctatctagaattctcttaccttccttaccccgactcctacatgaatttctatttttacccactttttaaaaagccagatcacatattacctccacccttaagtaatttttataatcccctaaagcaggggtttccaatcttttcgcttccctgggccacactggaagaagaattgtcttaggccacacataaaatacactaacactaatgacagctgaagagcaaaaaaaaagaaaaataataataataaatctcataaagttttaagaaagtttacaagtttgtgctgggctgtgggttggataagcttgcttaaaagaataatagctctcttcttggaaatttagtagtagttgttgtagtacatttacatccttgttgatctatcattctctacccgtgtttttgttttaaaccctctactaggctgtgggcaacctgtgggcagggaccatgccagactgatccttgtgtcctccaaagcacatagtagctatccaataaatatttgttgaattattgagtatataccaataattgaatactgagtaaatccccaagtgtcctggctcatgagcttttccttaacataattttttttttttttttttgagatggagtcttgctctgtcacccaggttggagtgcagtggtgcgatcttggctcactgcaacctccacctcctgggttcaagcaattctcctgcctcagcctcccaagtagctgggactaccagcacccgccaccacgcctggctaatttttgtatttttagtagagatggggtttcaccatattggccaggctgatcgcaaactcctgaccttgtgatccgcctgcctcggcctcccaaagtgctgggattacaagcgtgacccaccgcacccggcctccttaacataatttttatagaaggcttcattagagactcaaaaatatattcatatacataagataattcagaatgtatgaataactacatatagtaaaataaaggtaagagttaacatatttaggatgaaaatatacagaaggagaaaataacagccaacagttaggtatcagaaaatttccatcctcttatatagagtatatatgttaaagctaaaggtcaaaagccaatgatcaaaacccgaataacaatacataaattaatgaacaaaggccctgttcatacattaggaaagaccgttctgaaattagtccctacaccttgattacaaagtgcttttgcaaggttgtgactataaagcaaagtacagacttacttgtggtaaattaattactcaaggagaggaaccgttttattcatctttgtacccctctagtacctgatggattaaataaaatgatacttgcaacaatcaatatagacatttgagtgattgatgtcctatttaaaataagccacctggcaagactgatgcactttaacaatattaataatttctttaagagcatacaactcttctttactacctatggaatgaagttaaaattgtaaccctggttcaagtccactcacgattttcttttttttcttagtctcacaattttctttccttttctggtctcatttctcacttctttccttcaagcttcttatctgccagtcaaattaaactttctgacttcatacttgcttgcctccatacctctggtcattttgtaatttcttaagtcatttatcattttcttccttgcgttaaatcttatacataggttgttttccttactaaattgtaagttccttatgtcagagaccacgtcttacgtggctttaactatattttatacctagcacctagtacctggtaggggcacacgtgcgtgtacacacaatgtgttgaaggaattaatgtttgaatatcattaaagctcaaactacattatggcaagacataaaagaaaaactgacttccttaatttatagcagtggcttttaaatataagtgggcagaagaaatacctggggaacttgttaaaaatgtaaattcttggtgttatttgtcaccaggagacttgaaggaataccaaggcaattatctaataagaagcaattaactcctgaaccacagttgacagtaaaaggaaacaaggaagaaatgaatgaaagaaaagaaccggcatactccggccattagagtcaaactcttcctttgcaagaaagtcatttattgggtatttttccttccatctaaccactgactttttaaatcaggatgacaatatgtatgtgtttatttgaaattccattcccttaaatgtacaagagaaatagttatttttcttagaatacttttcagatatttaccacatttcaaaatgcacagtacataggctaaaccatagaaactttatagaaaaatgttactatgtgttaggtattacaaaaggtaagctctggttgtaaagcagcagggcgctgagagaactacatattttctttagattacttcaaacaggggatatgaatcatagaaagtaagacttcaagtggttaagaagagttttgcctttcagaagtttgtaaaatgccagtattctaaatttcatccactgaattccttaggacaatccaatatagtatacaatatctgtcacttctctatccatttggcaaagacttcatagagacaaatgttacagaggctcaaaaatggagactactagaaaaatgaccaaagccagaaataaagtatgtgctaattagaaaacaaataattaaatggcccaacccgaatgttgtgtgatgctgaaaagagataaatttctaaggcacaccatctgttttacagtttattttgctgtactacaaacctactcaatatagttctgcagtgatctagctgctaactcatttgcacaattactttaggccagaaataactgttgcacagaatcctttgagagagcaacacattcatggaagagggcaaacataattcattcttgggtgaagactatttttagcccttaaagaaaaaaaaagttattcaaagaaatgattagaaattgccaaaggaaaattagataatttaaaaggagagtgatatcactatatatttatgtatctaaatttatctgaggttcttaatgttttagtgcctaaagacatgttgctgggacctcttctctctatctgtattttcttccttatttatcttttcagcccagtggctttaagtggtgtttgtatactcatgattctcaaatttatatcttcatcttaaatctttccagtttcaaactcatatattcaattatctgtttgatatcaccacttggatgccacataagcattgcaaactgatcctatctaatatagaacctttgattcaccatccgtgtcccagaaataaatctatttctcctacagtcttccatatctcagtaaatggcaccaacatccaaccagttgttagaataaaatctagatgtcacccttatttcctctcttagcctcattcttcatcgaatccgtcatcaactcctatcaattatacctctaaaatatatctcaggtttttctcttcatcgctattgctaccaccctatccaagtcactattatctctcaacagtactacttcaacatctatctaattccctatttccaagccactcccccccaccccaatagtcagagtgatcttttaagaatattatcggccgggcatggtggctcacacctgtaatcccagcactttgggaggccgagccgggcagatgatgaggccaagagatcgagaccatcctggccaatatggtgaaattctgtgtctactaaaaatacaaaaaattgctgggcatggtggtgcatgcctttagtccctcaggaggctgaggcaggagaatcacttgaacccaggaggcagaggttgcagttgacttgaacccaggaggcagaggttgcagtgagccgagattgtgtcactgcactccagcctggtgacagagcgagactccgtctcaaaaaaaaaaaaaaaaaaaagaatattatcatatgctaatttatattttaaatgtaattatatcatgtatccccaatacctaacacagtgtatagcaaataatagatttataatttttaatagatgaatactctctagtaatattcccatatatctctaataatttctaatctcagttctcagaaaaatttctgagatacctaaagacctatccacttactgaatcattcactcattcagcaattgtttgagtattgtattaattgaaattaggtccagctgcacactatatcgtaaagatgacagaagtctgtttcccgttcatataaaaaattctggaggtaggcagtgaaggattcacatggcagctctgtgagctattatggttccttgcatcttgttgctctgccatttccagattccactttataatctaatatggctactcaaactcacacctgcatctaccaggaaagaggaaggacatgagaaatgccatatcagatccatttaaggacacttcccagaaattgcacccacttcgacttgcatctcactgaccatcacgataactagcaaagaacactggggaagagccttttaactggacagcaatgtttccaactaacagtcagaatccttattattatagaaggagaagaataaatactgagggataagcagtagccttttccaaagttcctgctgtggccaggtaatgttcgggtgcagggatacgaagatcagtaagacacaaggtctgtgcttgaagcattagtctaatggcagaaaacaatatgtaaataaataaaattccaaaccaggagactgccactgtttggagatcatggcttttctgagtccccaaagattttctacaccccaagagttgaaagagaggtgagtggttccagtgttttacatcactgaactatacagactgtttcaattttccacagctataatactggacatttttcagctctgttctattggacatgatactttcatgacactgagcaaagatcatttaaacctctataaatatatataaacaactgtgacaacagttctaacagtttgaaaatgcccattttcagaaatttgtcaagactcaatgttttttaatttgacagaaaatcaaactaattgactgttttaagactatgaagaaaactccaagacaaaataaaaagaaatgagcaatggtagcatgtcagaaagaaaaaagtaatattgtaacttactgttaaccactggttatctagtagttccttagctgtgattctgtgagcaggatctactttcataagttgtttcaaaacacttttagctaaaaataagaaaaaaatcctgaaaaatcttatttaactacaattaatagcatacattttacaattttttaggattaggtcagtataacaggaaagaaagatgccaagtgtacaataaaaatcatcagtataaatgcctaataaatatagtttaaagcctaaagtgaagttttattgcctggattacctagtttaatggtctatagtaaacattagctagatgatcagcaaatttcctctttaacttttactatgtattttccgtttttgaaagttttgatgatgaacaatcacagtgaagatatcgctatttccacaagtaaatagtgttcatttccacaagtaaatttaatgactaaacagagatttaaaacattttaaccacaggccaactttcttatgttacttatattagctttagtaaataataacgcatctatacttaccacagtcacttatggaattccagactgcattttcaaaatgtagttctccttttcttattaactcaaaaagcttctcttctgagcttgccaaaaagggtggttctccacgtaatctgcaacaaaggcaatcactttgtttaaattttttaaataataaaaataagcctattaaaattaagtttccataggacttggaagtagtgttgcttcatatttaaggaaaggatgggaagagatgggtacctccctggaagtaaaaatggaaacaacagggttttccaagatcagtgctaggctcttatttcaacattgagaggaaggatctggtaaaggaagtatgcaagtatacactgaaacctccagatcagcaaatgacccaaagctcttgcaggtggggaaacactaagcttaaatggggttaaaatacgggaaggtgagtgtaagtgtacaataatagtggtagctaatacaggagatacactttggagtgagcaacaggaaggtaataccttaaggaacataatgcaaattgactcaactgaaaaatacaatgagttatcagggtctaactagttaccaaagtctaatggccacctaaggcttttatccatagtaaaatactgtacaaatgttagtaataacaaaaataaaccaagactaaccccgggaatttcttctttttattttttgagatggagtctcactctgtctcccaggctggaatgcagtggtgcaatctcggctcactgcaacctccgcctcctggattcaagtcattttcctgcctcagcctcccgagtagcagggattacaggcacgcaccacctcacctggctagtttttgtatttttagtacagacagggtttcaccatgttggccaggctggcctcgaacttctgacatcaagttatccacctgccttggcctcccaaagtgctgggattacaggcatgtgtcaacgcacccagccctaaccctgggaatttctataggacctaagtcaatgccaaaaagccattaaaacggacacaactcatcaaaaattgtatatgaaatcaaaagggtctgaatgtggaaaaatcagacaataatttgaccctttggcctgaaagggtgaaagctaagtgtacctaatgaccaacatcagtaaaaccatgagcactgtgtataaagtgaacatggacttgttttcacattctttaatacagaaacaatgtacctttagactcttaatagaacatggcaagcctgtaaagctattacttcaataagtgatctaggtcaaaactacaagaacaagcttaaaagctgagttcaattcttcataacacaatatcaacaaatgtcagccatcctcattactgtcaactccaacatctgagggcaatcctatagataacaaccagatttgtccaatgacaaccagacagatgtaattagattcatcacaggggcaactctgtgtctattcttcaactctcaggaatatatttttatacttcattgatgaaagaataaaatggcataatttcattatacttcccaaactgctggtctacactgtacataagtataataatctctacatcttttaacagttacatttttactaattttctttatatttttctttatttaaaaatctaactcatgaacattttctgaataagtcaaaatttgattttttcatagtaatgatgatgattatgatgacttttgtggggggaaaagttgctttcatcctagtggtttatcaaactagaccagacaatagagctttttcatttaccaataggttcttactaagtatttatcagtatcatattgttctgcaaactcttattttaatactttttatctctctagctcattctgatttcctctctctcatcctattcaccttgctattgtttagttttaaaatgcaatttaaaaagctatggaaaacaaaatagccagaaaaatggccttctggacaattactatctattaaaacagtgcaggccagcaaaggcctagttcattgagcctgttatcaaccagtgatatgcacatccaccaatttcttagctgcctctgcattgcctgactagcatgcaactatagcttaagggctacatcttaaaaaattcacttttttttctgttctttgcaattttatttacataaaaatgtatctaatggttggtcaatcagcagcatacaaaattttatgacagcaatttcctgcacatccagaaaagggaatccaagacacgaaaaatatctcttaaagtcttcctactattttgttgcattcatagaaatcaaaacagcagaggacaaaaactacaaagaatatttacttatgctaacttcaccttgagaaagtatgttatcaccatctgattaaatagaaatgaatcaaaggtaacggataaacaagaaaataaaccccctggagaaggtaatatgtttgtgctcttgattaaggaaattataacaccattgggctcagacagattaatgaataggcactgattagctaagtaagagtctactgtaaagagaagacaacattattatggtgatatgcagtcacactctgaagcagaaaaattaaaattatatttctaagaaagagaaagatatttaagatataatacattcactttccttaacaccaagttcaaactaagaaggcagcaaacactacatgaattgcataatattagattatatataggatgtttgactcatggtttctagaaagtcttcagagtataaaagactaatttaaaagttatatttgaattaaagactaaggctcagaatttttgcactatgattttaatcagcacaaaacgatgatcaaaaactttttgaatacttttatactttatgtaatctaagcaacgatgtgtgttgaccagctgagttacagctacaatcacatcatccaatttctactgcctgtatattccatttcacacaactgtgaaaatgtaactactgtgatgtcaatatttagaaatgatctggaagaggcagtgcatagtgaaatcttcaatatgaccataaaactaatgttgcatcaacataaaaatgttcacattcagcaagaggcagaacaatggtcactaacttttcagaacacctcttagaaaattcactttaattcaatttaacaaacatattgagcactgaatgtatgtctattataccagataccaggaatgcaaagatgaataatctaaggtctctgtcctccatggaatttagaacaaggaaaacagatacaatatatataatattataatatggtttttaaaagctttatgaggatacataaaagggaacaatgaattctattggatttacacatgtgtaaaccttcctggttaaatgttcctattttattattttttctttcaacattactgttttgcatgataccttaaaatcttttgtggagcatgagaaagtatatacctaataaatgtaggaactctgctatggtggggtaaagtaggagtagagaaatagaaggccttaatgtttgagctgggtccacccaggagagaatcttacagagaaaaagaatacacacatacccatacacactccagaggcatatgacacagggtgtgtccgagtattgaaatgtgacctggaatcattatagcacagtgtaggtgcacaggaatacatatccagccccaaactggaaaggcattctggaatcaggtcatgaaagacctgctctgctatgccatgccatgccatgccaagatgctctgacacttctccgtatacaaatacatatatatatgtattagattacatatatattatattataattatatatatatatatatcagaggcttttatatatatatcagaggattttaatcaggaaagcagtatgatcagatttgtgatttgaaaggacacccctggcagcaacgtgaaggacaaacatggggagggtgaccagaagtagggagaacagtcagaaagaccctgcaatagtctagaaaaggaatcataaggagaaaagatacaggtgaagagaaatcaaagaataggtaaggatatttcaaaggaaaaatgagcaggacatggagtttgactgaatcttgagaatgacagagaaggaagaacaagaatgactgaaagctccagcagcacaacatcattatgggaactgggaactgtagaatactccctagatcctaagtgaccctctgcctagttagtgcccactcccacctatgctctgcctgtatgggtagaacaagtgccaggccacagtacctccctacacctgataagctataagtgaacctcatgagaaaacacaaagaagcttttggtttgtagcaaaggatacggaaggtgttaagatttttcattttgctcagatcatattgttgtatttatagatcaatgaaaaccaaagctgaaagttataaatttacagtattaaaaaatacctcagggatgtatgtatacctgacaactaataagagagcttttagaatgatctcccaattggtttttaaatcactttttaaaaatatatattagttttaatttaaagtctatatcactctactgttagaaactatccactcatcttaaagtgtacatttagcaggctacttacaacatgtacattacgacgcctatgctccaaatgtcacactgctggctatagtcgtgggcactgataacttcaggggctgccaaacaagcagatataaaataacattaataatacaataaatgtcttttaaatgcttaaacacaagcatgaaaaatgtgctgatgtgctgtaatttattcccccatagggaaaagagaaccaacagcagatcttaaatgaataatgcacaggccttaacaattgatgtcactgtaacctcactcctatcatttagcttctaatggaacaatggtgtaaactgtataactaaatgcactaccctttatttctttaaattgttaagaaatgattttgcaaagattctgtagttatagtagaagacaacaatatcccagccctttccacaaaatagaattaaatatatgccttaagtagatgtaacataatgcaggcccaatatgtggaaatctggattcacagaaaaactaaggtacgtggttataaatcactttagtaaaataataatagcatcactcctataacagaatatgaactattttctgcattttcaaataagaaagccaagacaaagagagagctcctataaaactggatcaaaaagccaactagtcacaggacatagactatactaaatatatatatgtgtgtgtgtgtgtgtattttttttttttgagacagggtctcactctattgtccaggctggagtgcagtggcatgatcacagttcactgcagcctcaaactactaggttcaaggtatcatcccaccgcagcttcctgagtagctaggactacaggtgcatactatcatgcctggctaattgttttttaaaaattattttagagatggggtcttgctgtgctgctcaggctggcctcaaactcctggcctcaagtgatcctcccacctcagcctcctgaataggtgggattagtggcgtgagacaccacactcagctggctgcctttttaaaaagtcacaaatgacactgcaggaacatgtctattgtacctctatagctatgaatcagatatatttaagaaaaaataaaaagaaaatagttataagcagaaaaatacaatatatgtatatatttcaatagaactttaaaatttatacttttgcataaattgttatttgtatgaagtatgttaagaattctgtgagatagatacgtaagcatttgactccctttgccaatgaggaaactaagtttcacatatattaagtgacttgcctaatgttacacagctgcagagtgcctcctatgcaaaaggtgcgtttttattttagaaaagtttcaatctctcccacctacacatacctacacctacacacacacacacacacacacacacacacacacacacttttatgactactaaaagcaaatggaatttcatttcctcctttttcctctgcctagtgttaaagagatgaaaggcaacaaaaaggggtcaaaagattaaacagaagaaagaatgtacagattactaacactgagcaatctgtctccaaatgattgaaaattaactaatatttccctttaagccattatttgtatttgttaactctacttaaaatctttaaatatggaatttttaaagttccagttgctctatggccacatgtctatgacaagggcaaattctgtgactagattcagtgaacgatttccacactggtgcagcacacagcaggggacgggaaatcctggtcctcgctctttcagagtcatcttaattatcaggggcatttcgatttgcactgtcatcccagccctcatagggatgcagaggccagagtaactgccaagaagccatttaggaagtcagcaaagctccacaaaccatctgtcttctctcttgttctcacttgttatcagtgtagacaactaataaggaggcattaaactcagggtgcttgaatatattttccccatgtaactacagaccagatgtcttttgccaacagggggatatgaacagaatctaaagtagccttttcccaaataagataaaacaatttcaaaactttatgcatctagcagacaaaaaaagcaacgaattacgtatactcttcagcaataaaaatgaataaactactgatacaacatggataagtctcaaaatcatgatgtaagacaaaagaagaagacagacacagaagagtatgtactgtatgattcaatttatataaacttctagatatgcaaaactgagctgtggtgatagaaatcatcagtggttatgggtgggggattgactgaaagggacacaaaggaactttctggggtgacagaaatgttctatgacttgaacataatggggtagtgattacacaagtgtatgcatttgtcaaaacttaaaatgtgtacatcctattgcaagtaaactatattcctaaaaagcagattttaaaaaatctactaaaagtacaaaaacaatgtgtcaaagacctttcttggttaatgactctcttagagatcaacagaagtggcaagcaaaaatacaccaacaatatggaagatctgaatcacaaaaatatcacatttcatttaataagcacacacagaaatttttatgctcaacaaaccaggtatacatacatatttttaaaatatccaacgcatcatttgcaaaagctgatcatgtgttcagtcacaaagaaaattcctaaaagttgaaaacctttaagatgcaatcacctaccacaataaagaaaaccagacagataaaccaaaaggctaggacaactaacatgcattccatgcatttcaaacacatctcaaccacctggaaaaattctaaaaacacttataaataatttttctattaaacaagactaaaattaaaattaaagtatatcaagagattaatcacaattagaacaccgtatggcaaaaaaaaaaaagtcaaggtactcagaggaaaatatacagcctccaatgcatttcatagaaaataagcctgataataaatatgtattcaacttaggaagttataataaaaaacaaaccactagccacagtggctcatacctataatcccagcactttgggaggccaaaacaggaggatcgcttgaacccaggagtttgagatcagccggggcatgagatctcatctctactaaaaattaaacagaaaaaagttatctgggaatgatggcacatgcctgtgctccttgctcctggctcctggggaggctgaggtgggaggaacgtttgagcctaggaggctgaggctgcagtaagctgtgactgcaccactgcactccagcctaagcaacagagggaggccctgttccaaaaaaataaaataaaattaacaaacaaaccaaaataaagaacaaagaaggaattcagaaaaataaaagcagaaattaatgaaaaagcaaaccaaataacaattagatatgagctggttcttgaaaagcccattgggagctttatttattatttattaactgtcctaaccactaacaaatttgatctagataaaattattagtattacaaagagctaaaattcaggcctaagtgctagacactgctaagcactttatatattttttctcatttaattctcatgtcaacctgataaaaaaaaactattgtcttctaaacacttcctatcacccttccttttttttgtactcagcactttgctctaaaacatcagatttataaaaatcttgtttaatgtttgtgccacaagaatgttaagttccatgaaggcaaaacatttttatgttttgttcactgttgtatttttaatacctagaacaatgtctgacactaagtaggtcctcaaaaaattttttagaaatgagtgacataattcctattatacatatagaaactgtgataagagcagataataagtgcatattgaatttataggagaatataaccacaggtacacaggagaatatgaaaataataagtaaacataatatgcatatttatgtcaatgaaactgaagtctcaataaaagaaacaattttctagaaaaacataaattatcaaaatgattcaagaaaatgcagaaaacttggataatttagtataaattgaaaaaataatagaaactttatccccaaaaaagcagcagaaccaaaaaatttaagaggaaatttcaaactattattagataatttttattatctaaaaggttcattttttggttccacataaactttaaagtagttttttccaattctgtgaagaaagccaatggtagcttgatggggatagcacgaaatctataaattactttggacactatggcgattttcatgatattgattcttcctatccatgagcatggaatgttttccatttgtgtcctctcttatttccttgtgcagtggtttgtagttctccttgaagaggtccttcacatccctgataagttgcattcctaggtattttattctctttgtagcaactgtgaatgggagttccctcgatttggctctctgtctgttattggtgtctaggaatgcttgtgatttttgcacattgattttgtatcctgagactttgctgaagttgtttttcagcttaaggagatttgggactgagacaatagggttttctagatatacaatcatgtcatctgcaaacagagacaatttgacttcctctcttcctatttgaataccctttatttctttctcttgcctgactgccctggccagaacttccaatactatgttgaataggagtggtgagagagggcatccttctcttctgccagttttcaaagggaatgcttccagcttttgcccattcagtatgatattcgctgttggtgtgtcataaatagctcttattattttgagatacgtttcatcaatacctagtttattgagagtttttagcatgaagtggtattgaattttatcaaaggctttttctgcatctattgagataatcatgtggtttttgtctttggttctgtttacgtggtggattacatttactgatttgcatatgttgaaccagccttgcatcccagagatgaagctgacttgattgtggtggataagctttttgatgtgctgttggattcagtttgccagtattttattgaggattttcacatcgctgttcatcagggatattggtctgaaattttctttttttgttgtgtctctgccaggttttggtatcaggatgatgctggcctcataaaatgagttagggaggagtccctctttctattgtttggaatagtttcagaaggaatggtaccagctcctccttgtacctctggtagaattcggctgtgaatcggtctggtcctgggctttttttggttggtaggatattaattactgcctcaatttcagaatttgttattggtgtagtcagggattcgacttcttcctggtttagtcttgggagggtgtatgtgtgcagaaatttatctatttcttctagattttctactttatttgtgtagaggtgtttatagtattctctgatggtagcttgtatttctgtgggatcagtgctgatatcctctttaccattttttattgtgtctatttgattcttctctcttttttcttattagtctggctagtagtctatatattttgttaatcttttcaaaaaaccagctcctggattcattgattgtttgaagggtttttcgtgtccctatctccttgggttctgctctgatcttagttatttcttgtcttctgctagcttttgaatgtttgctcttttttctctagttcttttaattgggatgttagggtgtcgattttagatcttccccactttctcctatagccaagacaatcctaagcaaaaagaacaaagctggaggcatcatactacctgacttcaaactatactacaaggctacagtaaccaaaacagcctggtactggtaccaaaacagatatatagaccaatggaacagaacagaggcctcagaaataacaccacatatctacaaccatctgatctttgacaaatctgatagaaacaagcaatggggaaaggattccctatttaataaacgatgttgggaaaactggctagccatatgcagaaaactgaaactagactccttccttacaccttatacaaaaattaattcaagatggattaaagacttaaatgtaagacctaaaaccataaaaaacctagaagaaaacctaagcaataccattcaggatataggcatgggcaaagacttcatgactaaaacaccaaaagcaatggcaacaaaagccaaaattgacaaatgggatctaattaaactaaagagcttctgcacagcaaaagaaactatcatcagagtgaacaggcaacctagagaatgggagaaagtttttgcaatctttccatctaacaaagggctaatatccagaatttacagggaacttaaacttacaagaaaagaacaaccccatcaaaacgtgggcaaaggatatgaacagacacttttcaaaagaagacatttatgcagccaacataccagaggtacaaggaggagctggtaccattccttctgaaactatttcaatcaatagagaaagagggaatcctccctaactcattttatgaggccagcatcatcctgataccaaagcctggcagagacacaacaaaaaaagagaattttagaccaatatctctcatgaacatcgatgcaaaaatcctcaataaaatactggcaaaccaaatccagcagcacatcaaaaagcttatccaccatgatcaagtgggcttcatctctgggatacaaggctggttcaacatacgcaaatcaataaatgtaatccagcatataaacagaaccaacgacaaaaaccatatgattatctcaatagatgcagaaaaggcctttgacaaaattcaacaatgcttcatgctaaaaactctcaataaattaggtattgatgggatgtatctcaaaataataagagctatctatgacaaacccacagccaatatcatacttaatgggcaaaaactggaagcattccctttgaaaaatggcacaagacaaggatgccctctctcaccattcctattcaacatagtgttggaagttctggccaggacaatcaggcaggagaaggaaataaagggtattcaattaggaaaagaggaagtcaaattgtccctgtttgcagatgacatgattgtatatctagaaaaccccactgtctcagcctaaaatctccttaagctgataggcaacttcagcaaagtctcaggatacaaaatcaatgtgcaaaaatcacaagcattcttatacaccaataacagacagacagccaaatcgttagtgaactcccattcacaattgctacaaagagaataaaatacctaggaatccaacttacaagggatgtgaaggaactcttcaaggagaactacaaaccactgctcaatgaaataaaagaggatacaacaaatggaagaacattccatgctcacgggtaggaagaatcaatatcgtgaaaatggccatactgtccaaggtaatttatagattcaatgccatccccatcaagctaccaatgactttcttcacagaattggaaaaaactactttaaagttcatatggagccaaaaaagagcccacattgccaagtcaatcctaagccaaaagaacaaagctggaggcatcacgctacctgacttcaaactatactacaaggctacagtaaccaaaacagcatggtactggtcccaaaatagagatatagaccaatggaacagaacagagccctcagaaataatgctgcatatctacaaccatctgatctttgacaaacctgacaaaaacaagaaatgcggaaacgattccctattcaataaatggtgctgggaaaactggctagccatatgtagaaagctgaaactggatcccttccttacaccttatataaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggacctaattaaacaaaagagcttctgcacagcaaaagaaactaccatcagagtgcacaggcaacctacggaatgggagaaaattgttgcaatctactcatctgacaaagggctaatatccagaatctacaatgaactcaaacaaatttacaagaaaaaacaaacaaccccatcaaaaagtgggcaaaggaaatgaacagacacttctcaaaagaagacatttatgcagccaaaagacacgtgaaaaaatgctcatcatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagacagtgtggcgattcctcagtgatctagaactagaaataccatttgacccagccatcccattactgggtatatactcaaaggattataaatcatgctgccataaagacacatgcacacatatgtttactgcggcactattcacaatagcaaagacttggaaccaacccaaatgtccaacaatgatcaactggattaagaaaatgtggcacatatacactatggaatactatgcagccataaaaaatgatgagttcaggtcctttgtagggacatggatgaagcggaaaccatcattctcagcaaactatcgcaaggacaaaaaaccaaacaccgcatgttctcactcataggtgggaattgaacgatgagaacacatggacacaggaaggggaacatcacacactggggcctgttgtggggtgggtggggggagggatagcattaggagatatacctaatgttaaatgatgagctaatgggttcagcacaccaacatggcacatgtatacatatgtaactaacctgcacgttgtgcacatgtaccctaaaacttaaagtataataaaagaaagaaagaaagaaaaaagctcatcatcactggtctttagagaaatgcaaatcataaccataatgagataccatttcacgtcagtgagaatggtgatcattaaaaaagtcaggaaacaacagatgctggagaggatgtggagaaataggaatgcttttacaccgttggtgggagtgcaaattagttcaaccattgtggaatacagtgtggtgattcctcaaggatctagaactagaaataccatttgacccagcaatccattactgcgtatatatatacccaaaggattataaatcattctactgtaaggacacatgcacacttatgtttattgcgacactgttcccaatagcaaagacttggaaccaagccaaatgcccatcaatgatagactggataaagaaaatgtggcacagatacaccatggaatactatgcagccataaaaaaggatgagttcatgtcctttgcagggacatggacgaagctgaaaaccatcattctcagcaaagtaccacaggaacataaaaccaaacactccatgttctcacttataagtgggagttgaacaatgagaacacatggacacagggaggcgaacatcacacaccggggcctgttggggggttgggagctaggggagggatagcattaggagaaatacctaatgtagatgatgggttgataggtgcagcaaaccaccatggcacatgtatacctatgtaacaaacctacaccttctgtacatgtatcttagaacttaaagtataataataaaaaaaagttcatgatcataataaaaaaagttcatgatttttattattttttcaataacaaaaaaaaagttcaagaagttaaaaaaattattttttaaatgaggccagcataaccctaacatcagaaaagacaaaggaagcacaaaagaagaaaagctacagtcaaagctcctaaataaaagtgctgacaaattgaataatgcagtacattaaaccatgtgaggttgaatttaaatgtgcaaggatggttcaacattctaaaattgattatgtaattacttcattaataaatttaaagagaaaaatacgattatctcaataggtacagatttaaatagacacttcaccagaaacaatatatgaatgcctagtaagcacatgaaagatgctcaacatcagtaatcattaggaaaatgcaaattaaaaatcacaataaaataccacttcctacaacaagacaccacttcctaagatactagtcctaaggactagaactgtataatttaaaagataggtaatatcaagagttgtcgaagatatggagaaactggaaccctcacaaattgctggtgggaaggtaacgatcattttgtaaaagagtttggcaatttcataaaaaattaaacataaacttaacatatgatccaacaatttcactcttagtaactaattctaaaaatacttctaaatgaaaccacataccctcacaaagacctgtacatgaatattcatagcagcattattcataatagccataaactggtaaaaatccacatgtgcatcaggggtaagtagataaacaaaatgtggtatatccacgcaatggacaactattcaacaatatagaagagcagactacagatacatgctacaacatgaacgtacctcaaaagcattattctaagtgaaagcaagccaaatgtaaaagactacatgttttatgattccatttatatgaaatgtgcagaaaagaaaaaaaaagaggcacatttagagagacaagaaggcaaatctagagagattagtggctacctgggactgggataggaataagattgagtataaacgagctgagggaactttttggagtagatttgttttgaaactggattgtggtgatggttgcacaactctgtggatgtatgaaaaatcattgtatttttattgtaaaacaaaaatatatcctacattgtaaaggatgcacaaatatcttttatggtatttaaattaaacttcaataaagctgttaaaactcacatttagaaaaataggaaactgctgctttctttacaaaatatatctaatcagtactccatgaaaaactgtttgatggcgatgaaactggataaaaaaatgcaaagagggctgggcatggtggctcacgtctgtaatctcaacactgggaggccaaggcaggcagatcacttgaagtcaggagttttagatcagcccggccaacacggcaaaaacctgtctctactaaaaatacaaaaattagccaggtgtggtggcaggtgcctgtaatcccagctactctggaggctgaggcacgagaattgcttcaacccaggaggcggaggttgcagtgagcccagactgcgccactgcactccagcttgggcgacagagcaagactccgtttcgaaaaaaaaagcaaacaagcaaaacatgcacatgattttaacatgagttaacaaaagcaataattaagtttggggtatgattacctaagagatataaacaactttaagaagagcccagagaaataacaaaatttttttaaatctttaaaggtaggaactgtaagtaaaatactaaaacaagtgaaattgcttgacctaagaaaagcctaaatcatgggtcattatgtcatgatggcaaaaattgttcaagctgtaatccatactggttgttctacttttttacacataaaagaatcaagtctggtgcagtgtctcaagcctgtaatcccaacacttgggaaaggagaggctggagggatcacgtgagcccaggagttttgagaccatcccgggcaaacagtgagactgctatctcttaaaaacaaaaaaaaattaattagccaggtgtggtggcatacacctgtggtcctagctacttgagaggctgaggtggggggatggcttgagcccaggaggtcaaggctgcagtgagccaagatcatgccactgcactccagcctgggcaacagaggatgatcctgtctcaaaacaaaaattaattttaagtctactaacttacccatatagataggagtcccacatgtggcctgcagcatggcttcactcctactttgcttcttcaccgctaagccaaaatcagtcacctgggagaagaaattcaagcacagtcacctgttttcctgtcctagagctcactcattctgaagataagacttcacattgaatttgcattgaattctggggttcttgggggtgggaggactttaattgaatcattaataaaaattttgcatttccttccccacccacctctctgtatagaggagaaactgggtaaagagaagcttgcgttctcaaatcttgagagaataccatgatttaaccattcttgccatctgattaaattcaccagtctaacatgagaagttgtattttgaggcatttaatctttttcatataaaaaaggtatttttgtttttaaaaaaagttctttccttgtaaaatatattctggctttaacatattatctatgtttctgataatcaagttatattccagtttaaagcactgttataaatgcaaataattatccctgtcagcactcactgaaactctccttttttataattatttataattggtaaacagtatcttttctttactattgtttcctttgtgtttctagagtatactaattaaaacaattactacactattaaaaactacaacaagcatattaacaggaaaaaaaccacaacaacaagtattaactacaaatacactggtggcctagtgccgcaactgtaggccttctgctcagttctaaatcttggtcattaaacatttagttattaaatattcagtatgtggctttggaattatctcccaaagtggaacacccttagactgaaggcagaaaaacagacacatttattgattaagtaaccaaatataggctctttgtccagagacaatgaatgcaaagtttccagtgccttatggagtaagaaaatgctcctatttacatgtgatatcaccatttttctaaacagatgaatcaatttctccattagttttcacaaacatctcacttggagcatatgatacctatctttctttacagaaaatccattcagacacatgaaacatacaaaaagtttcacaatccaacttagttctttggagagcatctattccttcattcatcaaatgttaagtgaacacatactatgttccaggcactacttcaggtactaagtgaataagacatgcacaattcttgccttcatagagtttacaatggaactgttccagaacatttacttgggtaaaccaacaatgctgttaaacctatttctattacataggacttagcttctgcaacagagtgagttactcacagacaacattttatttctaaattaacacatttatatattttgaaagcagccactataatggtgctaaataatgtatcgtagcatttatttgacattagggaacacttaatttgaataaaatcttcaagaataaacacttggcacattaattgtacttaggacataaatattaatacacaggaaaattttcaataagaaatacagactttagaattaatttagtatcaaaagcacacgcaaggtgtgcttttctctaaatctgtaacacatttacatcaaattaccagacataattttgaaattaattagaattcagagcatctgtttgcttgctattaactaatgatttagaattattcaaatgaatatgtactttaaaaacacattcaatagctccacttaacttgcaaaattattcttgtcagttacaacctcttgtgaaatttttattttttagcacaagccacttattttctggctgctcaaaagctagcaacatgtgtctaaaaagaggatgtactttgccactttgctatcaaactgtttacaggcaaatatttaccaccattgctaatcttacctttatgtttaagtttatttcattgttatcatcaataagactgcttttaaccattatattttccagtttcagatctctatgtacaatatctaccaagaaaataaacaacaaatcaaatgaaatgaataatggaaaaataggagagacacatatagattaaatatatttgacaaattaatatccgctgttgaaaaatttgagggccaagcatagtctgtcctgttctattctctcatttataaatgcttcctccacatttctaaccttaaggagccattttctttgactccctcacctctacccatttccctgtgaccccagctggctgctcctcatgatgagtggcctggggagtgtgaaggaggatcctacccatgcttaggtattcccaggaggagggagatcatcttagtcacaaacccagccaggtttcccatatccttcggtcttcaaatacaggattacttctttacttctatgcatatgttactgtcagcataaacattttaacacactgtaacttggctacatatatacaaactatacttatttcagtatatttttctacaacatcaacacacattttcctactctttatgtagtaaaataaaaaacaaacaaacaaaaacccttgagacacaaaatctccagttgaacatgtcagagctcaggtacaatttttatgtacatacaaataaccatgtaccaaacacttcctttgcaaataattaattcagttcatatccattgcaaacatttccctagacttaaaaagttatacacggccaggcgcagtggcttgcgcctataatcccagcactgtgggaggctgaggcgggcggatcatgaggtcaggagatcaagaccatcctggctaacacgttgaaaccccatctctactaaaaatacaaaaaaaaatcagccaggcatggtggcgggtgcctatagtcccagctactcgggaggctgcggcaggagaatggcgtgaggctgggaggcggagcttgcagtgagccgagatcgtgtcactgcactccagcctgggtaacagagagagactctgtctcaaaaaaaaaaaaaaaaaaaaaaaaaagttacacacataattgctagaggaatgcattgaatgagtcctgcactggcaattatacctaatcatttatagctcccttacacaatccccaggctttgtttttggaatttttattgtttccattgctcttcttgtctctttttacataaataccacacagctttaacaaacatatcattatgcttttatccttgccagggcagatctccctgctgcctccattgttcttctttttcattgttggctatttttacccatttgagaataatcttatcaagttccatgaaaaatgttgctaagattttgtttggaattatactgaatttatagcttaatagggaaggactgacaatagcataatattaagcccttgaaaaaatcgtttccctctgcctagaaagcctgcctttttaatttttttctgagtttgtattcctcagatcaaatattgctccttcagtgaattctttcctgactttccaagccaaatgaggtaacttaaactcctgtaatccttgtgctttatatggctttccactggggagattatcatgttgaattacaacttgttttcaataatcaatctcccaccagcccaagttccttggagagcaggggccttgtcttttaatctttgtaatctaggaccaatctcaatgcagtaggtgctcgggaactatcagctggatgaaccactgggttccagtaccagctctagcacaccaaaccatgtcactgcacctctctggaacaaagtttttgttcatctgtaaagtgagaaggttctaaagtcacatgtaagccaaactaacctcgaaggaaaaaaacggggggaggagcagcagcagtaacacctaagaatagtaaggcaattagaataatttttaaatgtagtttttaaagtactgtgaaaccactctgtatgatactataatggtggataaatgacattacacatttgtcaaaaccccaagagtgaatcctaatataagctatggacttagggtgacaatgatatgtcaatgcaatatatcaatctagtgggggattttgacagtggggcaggttgtgcataagtgcgagcaggggagtatatagaaaatctctctacctttggctcagttttgctgtgaatctaaaactgctctaaaataaagtctacaaagacaaaaaaatgcctagaacatacagattctaatgttatgattaatagatgttttgggaaacttcacctttaccattgatttgtctacttttgattttataacattagcttctcttcaaactgttgaataaaaaatgttcataatttcatcttcgttcatatttctaattaaaacatatctaaaaagaaagttaaaaaggaaacatttttaactaaaaattaaatcttctatattagcaggtgttatttatatgactatgaatctggaatacaattacccttaaacaaaagtgacattagtattcatggggtcaatgagctggataaccctcttcttaccattattgtgaagatatgctatagctgatgcgagactttgaatgatccaccttgtctcattctctgagaaatgccctttcctatccagaatttctttgagttctccatcctcacaaagctccatcacaaggtacattttctgacattatatatataaaagagagagagagcaaattatatatctggggatctttaaaatgttatatatcacatatacaatcacagtcataatcattaatttattcattcaaaagtattatctattatgtacaagataccatactggatactagagaaacaaaaaggtaaagacatagtatttatccccaagaagctcacaaatagttatcattacagtatcatgtgataagtgctaatggccccaaatgccatagagttacagaagaggggcagcctctgtctaaagaatgccccttgagaagaaatattaagaccaggtctagatgtctgaatagggatttatagatagagaatgtgggaaagaataggcagagcacatggtatttacaaagactccaaagcttgaaacagcactgtctgttaaaagaataatctcagtgttaataacatggagaacttggtagggtggagaacaatgaagtggtgaggagtgaggctagaaagaacaggttggggccaggttgtaaagagttctggatatcatgataaggagtatggattttttttcccatatgcaataaggagccactgaagatttttaagctagtgccggggttgcggggtgcacgtgtatgatattaccaattgtgcatttctaaatgaacattctagcagtaatgtagaacagggctcaacaaacctttgctatagagatcagacccaatagcaaatattattggctttgaaggccatggagtctctttcacaactactcagtgctgttgctgtagcaggagaaagcagccataaacaacacaacaaaactttacttctagacttgaaaatttcaggtttatagaatttttacatgacatgaaatattactcttttacatttttgcaaccatttggaaatgcagaaacttagcttatgggccattaaaaaaaaaaaaaaacaggtagcaggcccaatgtggctctcaaactgtagtatgctgacttttgtttctagagggtagatgtgaggcatagaatcgagacaagaaggagggaaatgaaaagatttaaaaataccaacaagaaagaaacagtgggacttagtgactaattgggtgtgagtggtaagaagtcatagctgaaatgcctcttccatatttgctgttcatgtggggccatattaagatcactttaggtattccaacagccaagtcatctattgagtcaaaaaagattcacagtcaactaaaaagcaagtctttttcatacatatttctattcaaacacagggtaccctttatgtctcctttataacctatgctgctagatttttgttgtttttaagatcttgaagtctgattttgttcttataagcactgttagtgcaattctgtgttcaatcagtaagtatgaaaacaggaagcgaaggttaacatcctttcttcctatagcgcaattcagattcactgaatctcaggcagttttagaatttcaaaagtaactgcaaaatctaacacataaataagcttttgaactggaccatattttttccattgacaggactgtacagttcactggtacataaaatgataagtgaactatttggaaggaaaggttggattagcagtacttgaaatataaattggtcaattttaaatatataagttggtcaaagttatataagttataactgtgttataattattagaaacaactgtgtagacctggagaacacttagactcacaagaaaccatagcatagtcagactggatgatcagtaccatggcacaaccaatcaggtggcaatttctattaatacttaagatagcttcaatagaaagtctacatgcttgtgtgtatttatgaggcagagggtgtcagacctgatctacatgaattaagggaaagcaatacattggaaaaatcacagatgatggtttcctctgccttcaaacttactctagatttagactcctgcttgtacccataatggagtaacaaagaccagacttatcttcctacctgaaacaacttaagaactgggcaaaatatataaaacaataatttttagacattaaacatcagccagcatagggtagttattcctgagagagaggaaatacatgaggcattccccacgattattctagcttgctgtctagggagtttctagaccacagaagagggagagggaatccaagcagagcctagcagtctccatgagtagagggcatggagttggaagcccaggaaggtcaagacaactaaagttcacaggacggagcatcaaagaggagaatgctgtagagagagaaatctccagagatttgcagaggatcccctcaattcttcaggagagcatgaatcaacacatgtgtatgaggaaactacccaaagctgggggggaaatatgcaaaaagggcagagggaacaatcactggagcttacacacagccaggaacagctgtgttcccatgagctggaggtaaacctcgtaattcatggagcactggggagagcccctcagtaacaggaaaaaattagtcctaaaggttgctttggtgccacctaatgaagcttaaagcaagcttcaaaaagtatcaaactttccaagtgacttacctatatcctagaataaagcttaagaataatcattagaatattaaaatatctagcatccaacaaggtaaaattcacaacatctggcatctggccaaaaattaacaggcatataaagcagcaggaaaatagaacccataatgaaggggagaaaaaacaataaattgaaactgatctagaaatgacacccatgacaaaatcagtagaaaaggacattaaaacagttattataactctattcaagaagaccgagcgtgttaagtagacacatggaatatatagatatatatatatattttaaaaccaaatcaaatttccactggaagagattaacaacacatacaatactacacagagagattactgaatttgaagacaacaacagaaactatacaaaatgaaacaaggagataaaaaatgatttaaaaaatgaacagagcatcagtgaactgtggacaatatcaagcaatctaacttggagaccacaaagtggggtgaggggaaggcaaatacaaatgtgaggaaataatagcccccaatttcctaaaattgatgaaaaccataaactcacaagtccatgaaccccgaacacaaaaaaaaacatgaagaaaatgatatcaaggcacattataatcaaatggcttaaagctgatgataacgaacaaaactattctaagaagatttggggataaaagaaatcacaagtctaagactgaaaagggcagagactttgggcatcattgccatatactgctcttataaaggataactgtggtctttaattgttatcaagcacccctaatgaatcaagcataaggcacaacccaaattgactattactaccttagagactggcctaggagacaaagaacaatagagaaacatttaatgagacagatgctttatatcaattgtctcatttaatccttcaacagcaaccaagtgaggtcaacactgttatcaagcccattttacagatgaggaaactgcaatatgggcaagctgaataacttgtccatggtctcatggataactaagaagtggtggagccaggattcaaatgcacaggcaatatgattccacagtccatacgcctaatccgtacattattactcttctaagagaaaacacccaagcccacaagcattaaactgtctggaggcagaatggcaaataatccaggcttctgaacaactctaaataaaaattacaggtaaagagaagaatgatagcatctagggaaatatgaagataaaacatatcagtaagacatagatgaaaaaatatctcctacaaactgcagtgaaaaatatacccataccaatttgattatgtagttaactttgcaaaattatgaaaatattccaataaactttaatggagaaactaaggatcaaagcaaaaggaaaggcacctctaagaaagttctaatcaccatttggttgtgtatgaagttgttgtaattttaaacatttgttttcaacatgccacccagaacatattactgaagacatcaatctaatcatcagacatctaattatgcaatcaataataaaagtcctccagaatgttctcatcaatctccagtgacagactcatggccaaggacatgagcaactgtgccccaaagggattatttcagaatggaatgatattcattttgtaataataacaactttcaaaatgcagcgcctaatagaggtttacctttggcgtttcaaatacttgttccagatgtatgatgtgttcatgttttacacttttcagaatgttcacctctcgttcaagtaacttcacagcagagcttccagccttaatcaatgaagaaacacagatttcacataatgaaaatcactcctacattccttgatagaaaagttattttatgttttcctactttttttcctgtaacttcatatttgaagtgaattcatacattttttgagatgtttctttttcaaatgatatcatgccatttattcctgtgatcagattaaattatgccccttctttcctttgtccaattttaagttacatataattttgcctcaagccacatctgtttcttgaattgtttctataacttagctacaacatggtatctgtctcctcacaaaactatgaaaattactccaacttttaataggctttttgatatttcctttaaaaatatgttgatcccttgatgttagcataataaaaacaaaatctacttccaaggacataaattgaggaagaaaaaaaacaaaaagtttttctttgttttgctgttgtcttgttttgatttgattatatatatatatacatatatatacacacacatatatatacatatatacatatatacacacacacacacacacacacacacacacatatatatatatatgtatgtatgaaaaaataataggcaatgagattctacactcggctctgcactgttacttcctggcctgcctggttaactgagggagaaacagggagagagacggaaagagagagagacagacagacaaagagagacagagacagagagagagagagagatcttgccttcagatgttagatgtctcctaacatttaacactcaccatgcagatagcaaaaggtaaagtcagtaacactccaaggagcacaaggacttcattcgggtgtaggtaattgataatctacaatgtcctctatctcagaaattctagaagggctttctccaccctcaccatcaccgccctgccaaatcatcacccctattgatcttgaaattgtcattatttgaggataagcattgtcctcatttatttctaataaaaaaatctccctgcaagggataaaaaaggtcctattcctccacctcccatccacctgatttgggagagtacataatggttcttaagggagtggaaatggattagtcataaggcaaattttgcctaattaaaattttacctagtgtcattccagcttccaattacctttgctcctcaacctttagcatctcaggagtgggtgggatgctgcccatcatactatgccccacccaaggattaagtcacatttaaaggttaacctagagcagcagtccccgacctttttggtaccagggactgatttaatggaagacaatttttccatgaaccagggttgcgggagagggcatggtttcagagtgaaactgttctacctcagatcatcaggcattagttggattctcataaggagcatgcagcatagatccatagatccctcacatacacagttcacagtagagtttgcactcctatgagaatctaatgccgctgctgatctgacaggaggcagagatcaggtggtgatgttcactcgcctgctgctcatctcctggtgtgcagcctggttcctaacaggccacggacaggtaccggtccaagacctgggggttggggaccctcgacctaaaggatcaagagaaatagtgactgtgaggagtgaatttttgtctagactagatatggaaagttaccccaatttctcctaatatccatctcaattctgtttctcaccccttcccaaatggcttggcctgaatataacacaatattacactattcacttcatatactgactatatagttttatcttactatcttttggtcttaaaaactctcaacatcaatataaatatgaaagattattaattcctaaagttgcaagtaggtatgatagttatataacccaaaaactgaacccctaaccctagctaacaccaaaggagaaaaggaaataacaccttaggtagcacttaggatgctacccgaattctaaagatttctagaaaggctcttaatccctttactaagattgatatgttaccttactaaacattagggacaaatggtatgtaatttgctacagtttgttttaaataatacataaaacctaccattttgttttttaaatgtggtatttatcatcacaaatcctaggggaaaacaccataatgttgtttggtttttcccaggcacagaaatgaaaaaggttgatgaaatgatcaggtgtaaagtctgaggtcttagattttatcgtcaagagaagctcagtcgttccccagttcaagaggaaatctagtgaggagtgcagcagataaaagagtatagcagtagttagttgaagcaaaaagtggttcaacatgaaagagcaggcaggatgaataaacagaattagcgaacagtgaggaaatgaaaggagaggataggagaaaagtatatcaaaacaaaatcaggagagagtatctgcacttctagctaagatatctctagcccacagccctatgcctacagaacactgagaaccagcccttatcttcagcaaactctggtaaaatttacctattttttgttatattggttatgttattcctttcatttgttttttccaggcagcacttgcctacttgagttcagaaactagtccctttccgggaggctagagaaatgccacgcttctctgggggatcagcccaggcctgggacctcagggtgagaggcagcttgtgttagtgtaaaaagctgtactgtccacacccaccctgcactaacactgtgccctcagtaggatgctgctaatgagccttaccttttctttgttcacttttttaattgcccacttcgtttctgtttccttgtctgtcgcttcaatgactattccaaagctcccttttcccaatattcttccaaaggtatagatttcctggagaaaaaaaaaaaaagagttgtctctctatgccattcatcagctattaaaaatgaacatataatactgacagatactcacccaagggaaaagagattctgctccaagttaaaatcaaatagaagacactatatatttgcttcaatattaataaacacatcttaattaaccaaaataagcgttgatgaattttattaagtgtcctttggaggaaaaccataaaaatcctaatggtgaaatgtggaaaaactcaaaagtataaaaatgaatctctttcaaactataatatattaatgaaatatcttcataagaaaaaggagaaatgatttatatatatacacacacataagtgtgtgtagatataaaatacattcaccccaaaacatcccaaatttctgagagctatactacaaaatcgacacatagtaactactgaacaaatgtttctttatttaacaactaatgcttttcctgtatcttatgaaaaatcacttttgattccttttgctttaaaaaaaaaaaagcaatatgtgacaaaaatttcaacacagatcagcactgagaaaaaaataaccactacccataaaaccatcatccaaaccaagaatccatcctcttatcatttaacttctgcttataaagaaagaatacattggttttgccaacatcaccattttggtttgcattgtaaataataaacagctaaactcatttacaccttcatttcttatcaatttggttttgggggagtcagtctccctgatccaaatcaactccagggaattaacaagagtttctggacccatcgtgcataggaaccagaacatgggagagcagctgaactaatgccactaggtaatgccctggttgggtcagctagtcaaagccttccatagaaatgccactctcaaaatgccactctctctctctctgtatgtgtgatcactttcacattcaccatgtgtattagtccgttttcacgctgctgataaagacatatctgagactgggcaatttacaaaagaaagaggtttattggatttacagttccacatgactggggaagcttcacaatcatgtcagaaggcaaggaggagcatgtcacatcttacatggatggaagcaggcaaagagagggcttgtacacagaaactcctgtttttaaaaccatcagatctcgtgagacccattcactatcattagaacaacatggaaaagacccacccttctgattcaatcatctcccagtggttccctcccatgacacatgggaattatgggagctacaaggtgaaatttgggtggggacatagagccaaaccatatcattccaactctggcccttcccaaatcacatatgttcacatttcaaaaccaatcatgccttcccaacagtcccccaaagtctcaactcatttcagcattaactcaaaagtccacatctgagacaaggtaagtcccttctgcctatgagcccgtaaaatcaaaagcaagttagttacttcctagatacaatgggggtataggcattgggtaaatatagccattacaaatgggagaaattggccaaaacaaaaaggctacaggcccaatgcaagtccaaaatccagtggggcagtcaaatcttaaagctccaaaatgacctcctttgactccatgtctcacatccaggtcacgctgatgcaagaggtaggttcccatagtcttgggcagctctgtccctgtagctttgcaaggtacagcctccctcctggctgctttcacaggctgacattaagtgtctgtggcctttccaggtgcatggtgcaagctgtcggtggatctactattctagggtctggagaatggtggccctcttctcacagttccactaggcagtgccccagtagggactctgtgtgggggctcccaccccatatttcccttctgcactgccctagaagaggttctccctgaagatcctgcccctgcagcaaactactgcctgcgcatccaggcgtttccatatatcttctgaaatctatgtggaggttcccaaaccctaattcttcacttctgtgcactcgcagactcaacaccacattaaagcagccaaggcttgaggcttgcaccctctgaggccatggcccgagctctatgttgggccctttcagccatggctggagtggctaggatgcagggcaccaagtctctagactgcacacagcatgagaatcctgggcccagcccacgaaaccactttttcctcctagtactctgggtaatgggaggggctgctgtgaagacctctgacatgccctggagacatttttctcattgtcttggggattaacatttgcctcctggttgcttatgcaaatttctgcagccagcttgaatttctcctcagaaaatgggattttcttttctattgcattgtcaggctgcaaattttccaaatttttatgctctgcttcccttataaaactgaatgcctttaacagcacccaagttgcctcttgaatgctttgctgcttagaaatttcttccaccagataccctaaatcatctctctcaagtttaaagttccacaaatctctaaggcaggggcaaaatgctgccagttgctttagtaaaacgtaacaagagtcacctttgctccagttcccaagaagttcctcatctccatctgaaagcacctcagcctgaatttcatcatccatatcattatcagcattttgttcaaagacattcaacaagtctctagggagctccaaactgtcccacattttcctgtcttgttctgagccctccaaactgttccaacctctgtctattacccagttccaaagtcacttccagccgggtgcagtggctcatgcctgtaatcccagtattttgggaggccaaggcaggcagattacgaggtcaggagatcgagaccatcctggccaacatggtgaaaccccatgtctactaaaaatacaaaaattagctgggtgtggtggcctgtgcctataatcccagctacttgggaggctgaggcacacgaattgcttgaacccaggaggtgaaggttgcagcgagctgagatcgcaccactgcactctagcctggtgacaaagcaagactccatctcaaaaaaaaaaaaagtcacttctacatttgtgggcatctttttggcagcaccccacttctggtaccaatttactgtattagtccattttcacactgctgataaagacatacccgagactgggcaatttacaaaataaagaggttcattggacttacagttccacatggctggggaggcctcacaatcatggcagaaggcaaggaggagcaagtcacatcttacgtggatggaagcaggcaaagacagagtttgtgcagagaaactcccatttttaaaaccatcacatcctatgagatccagtcactatcatgagaacatgagaaaaacctgcccccatgattcaatcatctcccatagggtccctcccacaacacatgggaattatgggagctacaagatgagatttgggtggggacacaaaaccaaaccatatcaccatgcaacaggtaaattagaggcttgtcttcgtattttctaatgcttacattcccttcttttgtaacagaaaattcaacgcccaactaattactcacctccttcatgaagggcttccttgtttaacacaattgtgtctgttctgttatttttactcctttcaccatgtatgcattggtcctcaaacaatattattgcttttttgtttacaaaccttttggcttatttttttttcttccaagatggtctaaaagctcctaaaggtgctgtttcttttgtatctcttaaaaaaacctagctcttctctcttccttgataccacttaatagcacataatagaattaaagtcagaaaacttaattataaaatagtacaaaacataattttattcttatatttatatgcaactctcaactgtatacagagatacctcagagatattgtgtattcagttccagaccaccaccataaagcaaaaattgcaataaagcatataaaagttatgtttacactatattataatctattaactgcaatagcattatgtctaaaaatgtacacaaaattttaaaatgctgcattgcaaaaaaaaatgcgaacaaacataacaatgcaattgtaatctttttgctggtggagggtcctgcctccatgtagatgactgatgactgattagggtagtggtggttgaagactggagtggctgtgacaatttctaaaaataagacaaccatgaagtttggtgcatcaattgactcttcctttcataaaatatttctctgtagcatgtgatgctgtttgatagcattttactcacagcagaacttctttcaaaactgaagttagtcctctcaaaccctgccactgctttatcaactaagtttatgtgatattctaaattttgttgtcatttcaaaaatattcacagcatcttcactaggagtatattccatttcaagaaatcactttctttgctcatccataagaagcaattcttcactcattcatgttttatcgtgagactgcaaaaagtcagtcccatcttcaggctccacttctagttctcttgctgtttccattatatctatagttactttatccacttaagacttgaacccttcaaagtcttccatgagggtgggaatcaacatttaccagactccatcagtgttgatattctgaccttctctcatgaatcacaaatgttctcaatggcatccagaatgatgaatcctttccaaaaggttttcaacttaatctgcccagatccatcagaggaatcactatctgtggcagatataaccttatgaaatttatctcttaaataataaggctacaaaacagaaatcactctttgatccatgggctacagaatgaatgttgtgttagcaggcatgaaaacaacattcatcttgtacatctccattagagctcttgggtgaccaggcgcattgtcaatgagcagtaatatttggaaagaagacatttttgtgagaagtaggtctcaaatgtgggcttaaaatttcagtaaaccatgctgtaagcaaaggtgctatcattcaggctttgttgttttatttaatgagcacaggcagagcaaatttagcataacttcttaaggccctaggaatttcaaaacaataaatgagcagtggcttcaacttaaagtcaccagcttcattagtcactaacaggagagtcagtctgtcctttggggctgtgaagccaagcattgattactcctctctagctatgaaaggattagttagcatcttctaaggcttaaatctgttgtttagtgtagccatcttctatcaatgtcttaggtagatcttctggataacttgctgcagcttctacatcagcacttgctgcttccaccttttatgttatagagacagctactttctttaaacctcctgaaccaatctgtgctagcttcaagcttttctcctacaatgtcctcacttctctccccttcacaaaactgaaaacagggccttgctctggattaggctttggcttaaggaatcttgtgcttggtttgatcttttccaaaatcaaactttctccatatcagcaataaggctgttttgcttatcattcacgtgttcactggaatagcacttttaatttcattcaacaaattttctttttctttaaaaacttggttaaatggtgcaagaggcctagctttcagcctatcttggctttcaacatgcgctcctcattaggcttaatcatttctggctttcgatttaaagtgaaagacatgtgactcttcctttcacttaaaacactgcagggttattaattgtcctaattttaatattgtctctcagggactaggaagggccaaggagagggagagagatggaagaatggtcagtcactggagcaatcagaatgcacacaacacttattgccatcttatatgggtgcaatttgtgacacccccaaacaagtacaatagtaacatcaaaaatcactgatcacagatcacaacagatataataatgaagaaaaagtttgaaatactgtgagaattaccaaaatgtgacacaaaggcacaaaatgagcacatgctgttggaaaaatggcaccaacagacttgcttgacacagttgccaaaacttcaaatttgtaaaaaacacaagatctgcagagtgcaataaatcaaagcatgatatgatgaagtatgcctatattttgtaaagtgagttaaatctcaactaaaatggtcatttacccttttctcatttacaaaataatctcttcataaccacttccccaatttttcttgttctttaaaagttaaacttttattttctctctaaatagaaccacaatttgaagacagtattcaatactgtttaaataggaattctaaaatgagaaatggccaactagttttttacaaactaatcactttcttcaactaactgctttgatattaacacatagtgatgaaggagaaaacagtttcttatttctaataattgtgtaaggatgttattaaaatgataatgtagatctatttttactgacacagaagaagtccatgacatagtgtacagtgtgaaaagcatataagatatgatttcattatgacaatgtgtgtgtgaggaggtgcttacatggatatctgtgaaaatgttcatctaaatattaatagtagctatgtaagggtaatagaattgtggatgcttgtaatttccttctttatactcttctgaaatgtttaaaatatttaaaatgagtatattttatgggggaatagaagcttcaacttcaactataccaagttaaagttacttctttaaaatatgtatatatatttgaaatatcctctaatttaaaacaggaaaaatgttaaagaaaaataaaataaaactagtacatgcatagaaaaagtgaagttaataatttttaaattggttatatctggttgataatttttattttctccacacttatatttgcctaatttttcacaatgaacatattttgcttttataaaagctcttaagactaaatttattatttatttattttactgtttttggagacaaggtctcactctgtcgcccaggctagaatgcagtggtatgatcatagctcactgcagcctcaaacttctgggctcaagtgatactcacatctcagcaccccacagtagccaggactacagccgaatgcctctatatcctgctaattttttaaaaatttttttagagaaggagttttgctatgttgcccagtctggtctcaaactcttggcctcaagtgatcctccttcctcagcctttcaaaatgctgagattacaggcatgagccatcatgcctggcccaagactaaatttaaaacttggtaaacttgtgtgtgtgtgtgtcagagtttttcaggccaggcagcttttctaatcatttcaagtaagttgccaaatatcttttaaaacaagttttgacatcaggcttgatcatttctagcttttgatttaaagtgaaagacatgcaactctccctttcacttgaaccactgtaggattattaattggcctaatttcaatatttttgtgtatcagggactagggaggcccaaggagagggagagagatgaagagtggtcagtcagctgagcaatcagaacatatacatttattaagtataccatcttatatgggtgcaatttgtggtgccccaaagcaatttaaatggtaatattaacacaattttcttcttgttgtggttgttcttattgcagtttctttaatgttaaaaacacacattttaatttttttattgttctaacatttaattcttattttatataataatttgaatcctggaaaaatagtattggtatttatccaatcgcaggatggaaaagatggaggagctcatgagggagattctggcctcactatcaaggaagtgaacagccaaactaaaattacctggtccatctctgcatcatgaaaaggtctaaacaaagactccactattgctttcagcaacggccaagacctgaagatgaaactatcctcattttagctaatgaaaatgttctccactttaattaaaatccacttggtcctccataaacagaagataattaatctgtattttctttagtaaaaatgttaacatacttgaaaatggtacatttcctcttttctttacttcctttccttagagatttatttttcaatcatttttcctattaaccattgacttagaagaaacctgaaagttcacagtagcttcatttgctttctatatacctcaatagcagctccattctcaatccttatgtgaggaacttttccttctgtaaagttgccccgaccccattgttgctgagatgcttttctctctacatttgaggttcttgagggctgggaccaaaaaaaaaattaaaaaaaaaaaactttaagatgtaatattctttgttgacaaagaatcctaatttagataatctgataactctttaacgtgtgccatgtttactatgcacaagattgtttactgtctttttcaaattctaagccctatgcaattcattggctcattaggctaaaggagaccttaagaagatattcaatccaatcccctgaatccaggaaagtctacatgataaccagcatagcagattcatcaaagcttacctagtgattctctgaaatcaaagaaagcaactttatagctttctcaatcactctcctttcacaatttaacaaccattatcaaacagcttataagtaaattattggccactcaaaaatatgctttgagtgaaaataacatagtaacaactcactcagatacatccatatggcagtaactatatgataatacaaatcagaaataacagtcaagggagaacatatgaagaaggcaaaattttgaggaatgggaacctgacttttcttaggcttattgctctgtctccaaagttgtgctgtatcaaccacaatcttacacactgcctattctatataaagatgaatatggctgggcacggtggctcatgcctgtaatcccagcactttgggaggccaaggtgggtggatcacctgaggtcgggagttcaagaccagcctgaccaacatggagaaaccccctctctactaaaaatacaaaaaaattagctgggcatggtggtgcattcctgtaatctcagctactcaggaggttgagctaggaaaatcacttgaacctaggaggcagaggttgtgatgagctgagattgtgccattgcactccagccagggcaacaagagcaaaactccaattcaaaaaaaaaaaaatgatgaatacatcgaaatcagtacaattgggtagccatagattatttgtaactaatgcaaactgattttgtaaagtatagttgatattccacctagacaaccacaacttaaataacaaagccataactaccctttacttaaccacaactataaatctaattctccatcagttgaagaaaatactcaaaaattcagatttaattcaacttgaaaaccaattcatttctgtataaaccattaaaaaaagaagttggtataacgtgtttaattacctcatgtcctgagaaataattaatttgggcagtggtttgaaacatcatataacaagttactaaccaaatttactcacctcttctgtgagaaagaaatgtttaatagttatgaaggcaatgaattagctaacaagaactcatgggatatggatgaagctaggagtaccattagggaacgggatgtcaacttgtgcttagatgtggaatctttgatatttaccaaatctttcctggaggttatatctctgttgatatttttttctttttttctctccagtgaaattaaagattctgcactaccaatgcttgatgtctgtgacatttccaccaccaaaactggaggaacccttgttttgctggaacatacacaaagtacatctttctgagaagcagatgaacagtcggggcattttgtggattttttatctaagccactatcagccatttgtttaactctgcaacaaaagcaactttaaaaatgtttccactgtttgaggaagaaaaccaggccaaaaaggataaggtagttgatggtgaaaactgtaatttcgaactggtgaagtcctcaggttaaggatgcactagacacatattcacacgtgagagctgcagaaagaaaagaaataaccatttagagaaattcttaacctattaccatcctggaaatcagagaaaagctagcaactagcactagaagcatcctgtatagacatgaaaaggacaaaataggaccacaaaactggtgaaaagcatggtctaaaacagcatcttatcaaactgcgtagtgggttatgaaatccattttgtgggttgataccactttttaaaaataaagtagaatcaaagagataatatttagcatacctccttggaaatttctgtgaaacttttaattggacagacatatatgtatagagtgtgtgtgtgcgtgtgtacttgatcacagtatgaaatgtatttcttaatgtgggttgtggtttttaaaaaggcttaaaatattggtgttaaacatacattactatggtttcaaattttaaaccttaatctattgattattagagcaaattcctattacatactttacaaaggagtgaataattcgatttttagaaaactagctaatcctaaaagtttaagtatcctcataagtatcctcatttttatattgagcaaaaataaaaatgagtgggtgctatttttccctgagtctaaaataggtatggcagcattttacttaactaggaccattggcagctgcatggtggcaagttggaaagatctcagttgaggaggaagaaaaatacactctgcagtacatataaaggagtactttgagaaacttccagaagtaattgggagtacattattatggttttatgctataccatttcagacagtctttaaaagtagattctgtagtcatagattgataaacctggggatatatgcaatatactgttatcctttgaactggaataaacttgactagaataggaaattaaatatatttatttcattaaagaaatacctggttttctaatcagaaagctgtgcttttatcaaatccttatctattgtgattggcaggaaaatctgccaggctcatacgattttataaaagatattgctagtagtttacctaaaagttgtcctctcattctttcttactaacagaatcctgatcttctttggggcagcaatgtgctcattaacatcctacatttccgggcttctcttttagattaggggtagccatgtgacttatggccattaagcttaacagaatgcaggcaaagctgcacttaaaagaaaatttatattcttaaacctttattaaaatcagaggagaaaggataaaaatatactaagtgtgcagtcaaatctaaaagatagaaaaacataattaaagagtaagcttaagaaacagaaatgacaaagaaattttgttgaattttgcctatacggtcccaaataaacgtactcttcactacctctcagctttcatatctcctttctctcagatacagtagcctcttgctgctcctctaatatgccaagtatactcccttctcaaggctttgcccttctgcttcctctgcctgggatgctcttccctcaaacattcacacggtctgctcccatgcttcactgtggcttctgctcatttgaaaggctttcctaaccacctcatctaaaacaacaagcccatgccctctccccccttaccttgctttgtttttcttcatgccacttatcatttcactcaggaagtttcatagcagagtcctctcctacttttattgaacagatgattcttatataaatggtttcagagcatgcaaagccatccggttcattttattcacttaaaataaccaaaatctgaccatagtagtattccccaaaagggggatttacaggtcagtctcatttgtaaatagattttaaaatcctaaatgctgtacttacatttaccccaggtaatgtatatagtatattataagattattaaatagaatagataagtctgcccaataaatatgacctttcatcaaagtggtgggaaaaaaatttctattgtgattaaaactcataatggagagtatgaggacaggtacattaaaagtgccctccagacaggcagaggaagaaaagaatgcaactgatgccactcaaaatacacacacacacacacacacacacacacacacacacatacacatctcttataaacacttaacctggtttttcaagaatatgtagcaagacaaagaaaattcagaatgtacctgtatcactttccaaaatgatttaacttcaggcctagaagaaaatgttttgcatttcaggttaaatataaaacccataaccatcaatgactcagagcagtggagtagatctgcaaatgataggctttctgtttgggaaaaatagtgctttctctctgaggtgtagagaagtcccatgtcagatgtgtaaaacatcattttttgcatacattaagaatattgattttatggtactttttataagaaattgtaagaagtattcgtaacgtacaggtttatttaactgcagctgagttctttcatgataaacagtactcctaaaagcatacttaccatatccttcaaggtttacaaatatatatattcacaaattttcaatggaatctttaaatattaaaattttcattttaagatagattttgggggatctaaaaacagctattcttttcttagctttgttcagaaagcatttcctttaattttcatcaatttttcaataagtcattatcatatcactgacattgtcacagacttctgagtactttctcgctccagtcttctaatttatcagttgccttagaagtacttggtagctatatgcataaagcataggatttctttctattactcactgagaagtttcatttttgctctccagtctaccaagtgctatatttgccaaaataatgttctactttcttaccacagcaattctaaaacaacaggttgaatagctgcatgcaaaatttcttgacaagaattagatttcaaatttaacttctttttggctggctgaattctaattattttagtttaaacaaaaaccaagatagaacaaatgtttactcacatttatttctttctcatttacgaattgatctgaaagatttgttactaaaacaaatctactatttcacaggacaaatgatgtcactcatattttagaggcttaaaattaatcaagtattgcaaacttatgtaaacacaaagattaatagctctttttctatagaatcatggaattatgtttaaacaggactttagatataaaaatatgtattacaaaaaccaaagaatcttctaatacaataatgtttctttgtgtctccaaagattggacatacataggtactggacataatataagcaaataaaataagttcaaattatgtcagtacttaactaatacatgagccttcctttggcttaaggttttcattttatttttagaactaaggcaagtcaataaaacaattctgataatgaaaatccctgggctttaatttaatcataaaaaggtcttttacatattggccctagaagatacacttacagcaatttcctcaagaaaatgaacacaagaatggttttataagatataactagctataattttcttctccaaaagcaatttttttagttttctttgctaagactgtgtctacaagaaacctaaatagtcaattcagtcaaaatgtgttttattcaagtaaaggggaaaaaaaaaaaaacttacgaattgtctgacattctgcagaccaagccaaatgactgactgctttagtaacatgtttacaaagcctaaagaagggcccagtgagttttctagatgatattgctatattttaaggaagactagcacttgtttattcttttcattaagggcatgattaggaaaatgagtctgtattgtcttataaaaggatttacagtatatttaaaattcacattatttcagaatttttttaaatgtttgagtgatgtttactattaacttttcctttctattttaatttgcatgatgttcctcactgattaagcagtaatacggaaggacagtcttaaatgtggcccctatactgacagttaaaagcgagaacagaggccgggtgcggtggctcacgcctgtaatcccagcactttggcaggctgaggcgggtggatcacaaggtcagatcgagaccatcctggccaacatcctgaccaacctggggttttagtagagaaaccccatctctactaaaaatacaaaaattagctgggtgtggtggcatgcacctgtaatcccggctactagggaggctgaggcaggagaatcgcttgaacccagaaggcggagattgcagtgagccaagatcatgccactgcactccagcctggcaacagagctagactccgtctcaaaaaaaaaaaaaaagcgagaacagaaattgcagtttagagacagtggataaaccaggaaaccctctccctgattcttccctgttgatatcagtcttttctccctctccattataagcaaccagaagctggccaggcacagtggttcacgcctataaccccaacactttgggaggcggaggcaggccgatcacttgcagtcaggagttcgagatcagcctggccaatatggtgaaaccccgtctctacaaaaaatacaaaaattagccagtcgtggtggtgtgctcctgtagtcccagctactcaggaggctgaggttggaaaatcgtttgaacccaggaggcagaggttgcagtgagctgagatcgcaccactgcactctagcctgggtgacagagtaagactctgtctcaaaaaaaataacaaataaaaaaataagcaaccagaagccaaggacctttctccagcacaggcccttccttatacataataggcactcaatgaaaatttttgagtgttgattttgtggaaaagagccagaatcacaaatcatttagttagaaaaacaggcaggaatattggaaaagtcgtcaaagaaatgaggggatcatatggagaagagatatctcaaagggaatgtgagagctctcttcacatttctgaagaggattaggcatatgggattagacttctacgtgatttgaagagacagtgggtgccgatttccatctaatataaagggcttcctgacatttacagctgtcaaagataaaaggaaagactatctcagggactacaagtgtttgagtagaggctggagcatcaggtggaagaagggaagcaatgggggaatttaagcacagactaggacgtattgaggttccttctagccctaaaattatatgaagatgaatcactcccaacgatcatctgagatgtagcagacatttaaaggaacagaagtggcagtgttcctcacctccactgtagagatttcaatattataatggggatccagatcagaccaaaccagttacagccctaaaattcacctcagtcaacatgaactccatctggaacagagcagcattattggaatttaccctggagtggggaggggcgtagtgagatgcagggaggagatgagccagaaggccggatgtgctgagaagtagtggccctgcctagaaaagaaaaagataaaaaatagaagaaaaaatattgtaagaaaaaggaaataatcccgccttccccttcatgaaatcagagaataggtctaagagcgagcaagggggcccacatgtagctaaggcagacaaaaaattcaatagattcttgaagaagtaaaaccactctaaggatccaaacaggaaggctctgctgtgctccatccaggaagctgaaaagaaaatagtctcctcatactcaggaatcttaatccaataagcaaaagatcaataagatcaggaatttgagagtaaatctgggaagtctgctagctttgactatcaagcaccaattaaaactttttcactaataaatatattaatgtaaaattccatagtcagagtgcctgtcctctacgtcaaacattctcaagagtaccgagagagaggagctgtccaaagccagcaactttccaggaaactaggtagttagctgaggaaatgtgtgatgtaacattctgacttggatgtttcattccacatgaggaaaggcactctgatcctcaagatcactttcaagggttgaaagcacaatcgaagggtccaggcaactttccccttatagccagacctctgcaaacttgacaactccaaacagtctacaacaaaacaccaacaacagattccaaaatccctgtcttcaagttttagcagaaataatattaatttaataaaacagaaacaacaacaaaaactactctgaactgtgagcccctccagggcaggaaccatgtcctatttacattgccatttatgtccagcaaaagacgtccattaagtaaggattattgactgaaagtcattaactgattgatggaaacagtgttttggagcttacaaatacaataaacaaggcaagtacccagcataaggcagacaatgacctgacatgtaaaagaagtctgaatgtatctgtggagtctccaaggccaaaaactgcacctccaccataatgcagtcctcactccatcttgtagctttcctttcagagcaaaacttcaaaacccctacacctagcctgactccagccaggctaaatttccacctgattctgaaaggcttcctatcagacaagatgctataactgcacccccatcttatgttctagacaacatttttggttttcaggagtctagaaggatataaacacataagtatttattttggtgatggaccatattgtcaaacccaagggcttctcctggccttacctactccccaacatctataggcattggtcataataaacattattattaatatcttcatattcaacaaaatatcaatatttttgcagacagagtaactaacaataactggtttgtttttctttcataataaagcgtgtaaatcatagctaagaccaaaaagattcatgtgagacataagataactttccaggctccccagccacgtaatttcaagtaagaatgcttgttttctgggagagcctgtttcctttgatcccagtgatgagccagttatccacagcacacaaatcccagactcgtagccagaacaaaagcatttagaatgtcacagctgaggaataaatgtgccatggctgttaaattcagcaaaacaggaaagaagagaagagtgcatgtggcaccagaactacccaataagaaaaggcacttaatggcaagttttctataagtctgaccagtaagagcatctagagggcagttaggagtccagcaaagagcatcagaggtccaagagaacaggccaaatgagaatccagccatctaatagtttatgtatatatccagcacacactttaatacctgtgatatactaaggactgaattatggataaagagattatgaaggcataggtttcactcataatgattacgataatgataataaatatgaacaaagtataaaagtgatacaaaagatggagtggcccaggaagtaacatgatccagtgggacacatacaatttttagaatgagagataccagggtttgaattctactcctatcccttattagctcagttcccctgtatgtaaagcaaagataacagcagtaactatcttttttatttttattttttatttatttatttatttatttttttgagacagagtctcgatctgtcacccaggctggagtgcagtggcgtgatctcggctcactgcaagctccacctcccgggttcacgccattctcctgcctcagcctcccgagtagctgggactacaggcgcccaccaccacgcccagctaatttttttgtatttttagtagagatggggatttcaccatgttagccaggatggtttcgatctcctgacctcataatctgcctgcctcggcctcccaaagtgctgggattacagaagtgagccaacgcacccggccagcagcaactatcttatgtaattgttgtgaggactaactatataacacttgtaaagtttctagtactttgtctgacacatattattgctttaaaaatcattattactcacttgctgagggaaagtttcatggggaaggtaatactcaaactaagtcacaaggaatgagttagagttcacctgtgaacacgtcaaggaaaggttctccaagtagagacaccagcacatgcaagggcccagaacctgtggttccagatgaatggaaggaggtggtttcaatttgaaggcaagaaaaataggagagagaaagtcgagtctctctcctgggatgagaagtgagaagaagcactttcagaaaagattcgggttaaataagagtattttcactgaagaataggcacaaaagatggatggggtggagtgggacatgaggctcttgtactgaagagctgcaaaaaagaaaaggctactgtaatggaatagtcttaggtgggcacttccaaaactgaccctaatcagacacaggttttagtgaacagagagtggccaccaaattcaacactaactcttcagcaagcaattgaaactctgcaatggagggggcacagggcatcaatgtctgctgaaaatataaactgtaaagctaaagagcatcaagaataggctccagccagtacaatcaatcaaaatctactgccgaacgaacatattaaaatttagtgacaaattcactatagtcagtgtttcaacgtgacagaataaatggcttatttctaatgagtgccaaaattacaaaaaataccaaaggatgcttctcactgtaacttccacaatgaaatattaagttctttattttatacatatatacacacaaatgcccctactccaaattcagtactattgccaataaagctatatcaattttaagaaatagaacatgaatgttctaccatttgagagtctaaagaccccaagtttctaaacagttattcaacattaaaatctcaaaagtcttctgagacaattttacatctatttttcatgtacacaaacttaaaacgaaatgtttgtactcatgctaaagtagaaagaacccaagctttactgtcagaccaacactcaaattcctccctagtaacctatgttgtctcagcccccacatatgcaacatgtatagatggtgtgtatatatctgaatggcagatttgttttagggataaggtatcatgtatgtaaagtcctgatatgttttaagctcctaataaatggaggctttattactgttgtgcaactgtcaaaacccgatgcatgacagcatcaggaaattattttagcagtcataatctctcaacctaatgctccaaatattgttctacatggattctaagatacaaattgccatataattagctcacagctagcttaaaatacaaccctacgggagcttgctctagatgtttgcagctgagctgtagtgggaatgtcttgatggaatagcctacgagcaacttgtcatgctaaattctgaatgctacaaggcactcagataccacatttataagaattgtataatttaaatatgtaaatgctgaatagcaaagagaacattttaatttagccaagaccaaagtctatcaaataaaaattatttgactatattataccttaacaactgattgagaaggaatagtatatatatgattaggttttcagagaaaggaggcatctgtatccacagatttatttggtgagtttttgaaaccttgcaatggaactataaaaacagtgtgattaaaatcgatagagcacatcaattggtgattctgttgcccaagaaaaggcaataagccttaggcatgttattagtagattatacaatttcactgacaggttcaagattttaaaggcaactgagaagagagaggatttctcttttggagccaagggatttttctcttctaaaaggaaatcatcatgtccctttaaaaatgaagattaaaaatgtcttctgtaacatttgaaaaaataatattgttttcctttatttcctaaaataaaaatacattgatgattctgattaaaattaaactgaaagctacttttgttgaacaatactgtatccaaccacatagccatttaacaaataccagaataatttgggaagtagaggttataagtttataatttccaaaaagtccatgcagaagaatataaagtctaaaaatatgagtttccagacctcttctgcaaaaattgtaagtgattctcttttcatgtattagtgataaaattatatacttttacacaggccttcaaattcaaagaacgttgtttcaaagcacactttttaaccagataacaaaagtcatgtagacataaatttgtcttattaaaaagtgaccaagtcaaactgaacctaaaatcagcaggactttagtcagatattccactatactacaaacagaaaattgcaaaaatgttctattggttgctttattgtgaaaagtccagagtagaaacatctttgtgtagccttggaaaactaacagcaacaatttcatgtagctttatgcttataacagaaaagaaaaagttgactataaagttgaccagtttaatcactgaatctcaataggaaatacaaggctaggctcacagaaataaataagttgactcagtcattggctgtatagcttttgccaaatgaacagtaaactctacttagtggagcttaagtcattagacttacatcaggcataatttttcaaagaaaactacaaaacactactttctcgtcagtaatatatgtacatacttgaaaacatataatagctttatgttctaaatagctattgaaatagatagctttattaactaaataatgcaaacaattttgtttagcttctccctctccctcagtctccacattcaacattgacaagtccattctatttctaaaacacttctcaaatccatcagttttctctattccaaatatcacaatcctagtccacaccactatcatctcttgcctggattactgcaagagtttcctaactggtcaacctgactccaactaagccatctgatctccatactctcaaagctttctccatactctagccagaatactctttctaatatgcaaatctgatcatatttcttcccaacaaaaaccacttcagtggctcccaaaagcactgagattaaagtgatcccttaacatgacatacaggagcctgtgtgatatggtctcagcttacttcttcaggcttaactcatactacttccttaacaaaatttgccaacatacagaacttctttcatttcctggaatccagtgctttctctaggccttcttatgtgtactctcagcctggaacactctttcccattcctctcttcatctgtataattcctactcttcctgcaaatcttagcttagacatcatctcccctgaaattctcttaaaatcttgagtcttggttgagtctctgcctctcctatgtacacttactatatcatactctgaattgtacttggtcacctccttgtctgtatccttcactatacccaaagctccctgaaggcagagatggtgtttatgttgttagtcactgtttatcaggtgagagaatgacataataagatgtgctttttggaaagcacattctaccttcagtatagagaatgtatagaaggcaggacaaggcaggagatgtaaagcagcaaatcattacaattgttttaagcaagatgaaattgtggccttaactaggaaagcagaatcagggatgggaaaagtagacaaattctagaggtatttaagatgtatagtgatagaacttggtaactaatcagttatgacctgatgagggaaagagaaaagtcaatacattgaaaactgagatagatagcagccatttactgagacagtaaagacaggaggaagaacagatctggagtaaaataaccagttcagtttgggatgtgccaagtttgctttgtcttaattacaccaaaatggagttgtaagaggtagtggatatttaggaccagagacaaggagaaatctaggtagaaaacatgaatttaagagttatttcacagaggccgggcacagtggctcatgactgtaatcctagcactttgggaggcagaggctggtggactgcttgcgcccaagagtttgagaccagtcagggcactatggcaagaccccgtctctacaaaaagtacaaaaattagctaggcgtggtgacacacctgtagtcccagctactcaggaggctgacataggaggatcacctgagcccaggaggtcaagcctgcagtgagttgtgatcatgccactggactccagcctgagtgacacagtgagacccagtctcaaaaaaaaaaaaaaaaaaaaagagagagagagagaaagagagttacttcatagaaaaggcacctgaagtcatgcatataggtgagatcatccaggaaggatatgtagaatggaaacaagagaaccaagaaaagaattctgaataacattaacttctaaaggataatcagaggaagtcttcagtggactgaagaatggaaacggtgtccataaaggcagcaaggaggtcatttcttgaagggaagattggtcaaaagccaaatggctcaaaattttcaaataagatgaagactaaaaaattatatttaaaagttgagctgtggaataccatcagcaaaaatggcagattaaggatctccaaaatttttctcatccacaaaagcaatgaaaaaatggcaaaaaaaatcagaataaactttttcataactctagatattaactaaaggcttgcagtaacccaaaaagcatgcatgtgtgaatgaatgaatatcagtaagaacaacaagcttcgtggcattttaacttgccttagtcccatctctgactcccttatctccacaataaaaataatcgtgaaaagtaataacccacaatcctggtgcagcttaacagctactggagaaaggaaaatggagctagggctctttcaaatgttcattcccaagaactgtcattattttaccatctagtggttccctggaataacccacttataagtcagtctgtatttggcctaactcagggcttgccagtacaaaatgcctccttcccagggatttgtaattgttgaaaataattacaagcaggtgttttaacttcacagttgcccaaggcagttgataacacttggagcaacaacagactaaccaaaaagtttaaaagaaaaagctggaaaattagatctctgtaggggctttgaaaaactccaacatattcctaggaatctaggaagctacacacacacatagggctatatgcatgcacaggaaagacttgagaagctcctaaactctaatctctggctgacctggaagctctgcacaagcaggaagtgaaggctaaggtaagttgtcaaccaccttgcttagtgttgcaagtgtagcccaacatgcacgtagagttccttggcaaagaatgggtgatttattgcttctaggcattggaggaaatcttttccaatcattagctgaccaccaagataaacaagtagacacttcaatggtcacaaacaatatagattatagtcttcagacaagtagttcagaaaggtcaccaaactactaccactacaaccagcagcaacaaaacaccctggggaggggagagtatcttatttccagagttgccacatataaaatgtccaattttcaacaaaaaattatgagatatgggaaagaaaacaagcaaacatggcccatacagaaggaaaacaaagtaatcagtggaaactgccctaaggaggcccaaatgttgaacttactagacaaagactttaaatgaaccgttttaaatatgttcaaagtgctgaaagaaaccatgtctaaagaactaaaagaggctgggcatggtggctcacgcctataaacccagcactttgggaagctgagggggaagaactgcttgatcccaggagttcaagaccagccttggcaacagagctagaccctatctctagtaatgtaaagaatcagccaggcatggtggcatgcacatatggtctgagctacttgggagactaaggtgggaggattacttgagctcaggagtttgaggcttcagtgagctatgatcacactactacactccagcttgggtgacaaagcaagaagctatctccaaaaaaaaaaaaaagaaaaaaaaaaagaaagaaaagaaaagaactaaaagaaagtataaaggtataaatatattatattacaccaaatatagatgatcaataaatatatatgttttagtccattttctgctgctataacagaataccacaggctgaataatttctaaagaacagaagcttatttggctcatggttctagagactaggaagtcgaagagcatggcactagcacctggtgaatatcatctcatggtggaaggcatcacatggtaagcaagcatgcaagagagagtgaggaaaccaggccaaactcatcattttatcaggagccccaaggctgtaataactaaaccatgataatagcattaatatattcatgagggcagagctcttatgacctaatcacctcttaaaggtcctaactcttaatactgttacaatgacaattaactttccagcacataaacttttgggagacacattcaaaccttagtgatacataaattatttttttaaattaaatagcaattctggagttaaaaagcataataactaaaatgaaaacttcactacagcggctcaactgcagttttgagcaggcagaagaaatagtaaacctgaagattgattgagattagctagtttgagggacaaaaagtaaacaattaaaaaaaaacaacacaggatcccattccaagatggccgaataggaacagctctggtctacagctcccactgtgatcaacgcagaagatgggtgatttctgcatttccaactgaggtacctggttcatctcattgggatgggttggacagtgggtgcagcccatggagggcgagccgaagcagggcgaggcgttgcctcacccaggaagtgcaggggtcgagggatttccctttcctagccaagggaaactgtgacagaccatacctggaaaaacaggacactcctgcctaaatactgtacttttccaatggtcttagcaaacggcacaccaggagattatatcccctgcatggctggataggtcctacgcctatggagccttgctcactgccagcacagcagtctgagaaggatctgtgaggcagcaacctggcagggggaggggcgtccaccattgctgaggcttgagtaggtaaacaaagcagtcagggaagcttgaactgggcagagcgcaccacagctcaccaaggcctgctgcctctgtagactccacgtctgggggcagggcataactgaagaaaaggcagcagaaacttctgcagacttaaacgtccccgtctcacagctgtgaagagagcagtggttctcccagcatggtgtttgagctctgagaacggacagactacctcctcaagtgggtccctgacccctgtgtagcctaactggagacaccttccagtagggggctgattgacacctcatacaggcaggtgcccctctggaacaaagcttccagaaggatcaggcagaaatatttgctgttctgcaatctttgttgttctgcagcctctgctggtgatccccagggaaacacggtctggagtagacctccagcaaactccaacacacctgcagctaagggatctgactgttaaaaggaaaaccaacaaacggaaaggaataggatcaacatcaacaaaaaggatatccacaccaaaaccccatctgtaggtcaccaacatcaaagaccaaaggtagataaaaaccacaaagatggggagaaaccagaatagaaaagctgaaaattctaaaaaccagagcacctcttctcctccaaaggattgcagctcctcgccagtaacagaacaaagctggacagacaatgattttgacaagttgacagaagtaggcttcagaaggtcaggaataagaaacttctccaagctaaatgaggatgtttgaacctatcgcaaggaagctaaaaaccttgaaaaaagattagacgaatagctaactagaataaacagtgtagaaaagaacttaaatgacctgatggagctgaaaaccatggcgcaagaactacatgatgcatgtacaagcttcagtagccgatttgatcaagtggaagaaagggtatcagtgactgaagatcaaatgaatgaaataaagcaagaggagaagtttagagaaaaaagagtaaacagaaatgaacaaagcctccaagaaatatgggactaggtgaaaagaccaaatctacgtttgattggtgaaactgaaagtgacagggagaatggaaccaagttggaaaacactcttcaggatattatccaggagaatttccccaacctagcaaggcaggccaacattcaaattcaggaaatacagagaacaccataaagatattccttgagaagagcaaccccaagacacataattgtcagatttaccaagattgaattgaaggaaaacaatgttaagggcagccagagagaaaggtcaggttactcacaaagggaagcccatcagactaacagcagatctctcagcagaaactctacaagccagaagagagtgagagccaatattcaacattcttaaagaaaagaattttcaacccagaatttcatatccagccaactaagcttcacaagtgaagaggaaataaaatcctttctagacaagcaaatgctgagagattttgtcaccaccaggcctgccctaaaagagctcctgaaggaagcaccaaacacggaaaggaacaaccagtaccagccactgcaaaaacacgccaaattgtaaagaccatcaatgctaggaagaaactgcatcaactaacaggcaaaataaccagctaacatcataatgacaggatctaattcacacataacaatattaaccttaaatgtaaatgggctaaatgccccaattaaaagacacagactggccaatgagataaagagtcaagacccatcagtgtgctgtattcaggaaacccatctcacgtgcagagacacacataggctcaaaataaagggatggaggaagatctaccaagcaaatggaaaacaaaaaaaaaagcaggggttgcaatcctagtctctgataaaacagactttaaaccaacaaagatcaaaagagacaaagaaggccactacataatggtaaagggatcaattcaacaagaagagctaactatcctaattatatatgtacccaataccagagcacccagattcataaagcaagtcattagagaactacaaagagacttagactcccacacaataataacagaagactataacaccccactgtcaatattagacagatcaacgagacagaaagttaacaaggatatccaggacttgaactcagctgtgcaccaagccaactaaatagtcatctacagaactctccaccccaaatcaacagaatatacattcttctcagcaccacatcacacttattccaaaattgaccacatagttggaagcaaagctctcctcagcaaatgtaaaagaacagaaatcacaacaaactgtctctcatatgacagtgcaatcaaattagaactcaggattaagaaactcactcaaatcctgaaaagtgcatggaaactgaacaacttacttctgaatgactactgggtaaataacgaaatgaaggcagaaataaagatgttctttgaaaccaatgagaacgaagacaaaacgtaccagaatctctgggacacatttaaagcagtgtatagagggaaacttatagcactaaatgcccacaagagaaagcaggaaagatctaaaattgacaccctaacattacaattaaaagaactagagaagcaagagcaaacaaattcaataactagcagaaggcaagaaataactaagatcagagcagaactgaaggagatagagacacaaaaaacccttcaaaaaatcaatgaatctgggagctggttttttgaaaagatcaacacaattgatggaccgctagcaagactaataaagaagaaaacagagaagaatcaaatagacacaataaagatgataaaggggatagcaccaccgatgacacagaaatacaaactaccatcagagaatactgtaaacatctctatgcaaataaaatagaaaatctagaaaaaattgataaattcctggacacatacaccctcccaagactaaacaaggaagaagttcaatctctgaatagaccaataacaggctctgaaattgaggcaataataaacagcctaccaaccaaaaaatgtccaggaccagacggattcacagtggaattctaccagaggtatgaacaggagctggtaccattccttctgaaacgatttcaatcaatagaaaaagagaaaatcctccctaactcattttatgaggccagcatcatcctgataccaaagcctggcagagacacaacaaaaaaagagaattttagaacaatatccctgatgaacatcaatgctaaaatcctcaataaaatactggcaaactgaatccagcagcacatcaaaaagtttatccaccacgatcaagttggcttcatccctgggatgcaagactggttcaacatacccaaatcactatatgtaatccatcacataaacagaaccaatgacaaaaaccacatgactatcttaatagatgcagaaaaggactttgacaaaattcaacagcccttcatgctaaagactctcaaaaaactacgcactgatggaatgtatctcaaaataataagagctatttatgacaaacccacagccactatcatactgaatgggcaaaaactggaagcattccctttgaaaacctgcacaagacagggatgccctctctcaccattcctattcaacaaagtattggaagttctggccagagcaagcaggcaatagaaagaaatgaagggtactcaattaggaaaagagaaagtcaaattgtccctgtttgcagatgacatgattgtatatttagaaaaccccatcgtctcagcccaaaatctccttaagctgataagcaacttcagcaaagtctcaggatacaaaatcaatgtgcaaaaatcacaaacattcctatacaccaataacagacaaacagccaaatcatgagtgaactcccattcacaattgctacaaagagaataaaatacctaggaatccaacttacaagggatgtgaaggacctcttcaaggagaactacaaaccactgctcaacgaaataaaggaggacacaaacaaatggaagaacatttcatgctcatggataggaagaatcaatattgtgaaaatggccatactgcccaaggtaattttatagattcaatgccatccccatgaagctaccaatgactttcttcacagaattggaaaaaactactttaaagttcatacggaaccaaaaaagagcccacattgccaagacaatcctaagcaaaaagaacaaagctggaggcatcacactacctgacttcaaactatatacaaggctacagtaaccaaaacagcctggtactggtaccaaaacagagatatagatcaatggaacagaacagaggcctcagaaataacaccacacatctacaaccatctgatctttgacaaacctgacaaaaacaagaaatggggaaaggattccctatttaataaatggtgctgggaaaactggttagccatatgtagaaagctgaaactgcatcccttccttacaccttacacaaaaattaactcaagatggattaaaggcttaaatgttagacctaaaaccataaaaaccctagaagaaaacctagccaataccattcaggacataggcatgggcaaagaattcatgactaaaacaccaacagcaatggcaacaaaagccgaaattgacaaatgggatctaattaaactgaagagcttctgcacagcaaaagaaactaccctcagagtgaacaggcaacctacagaatgggagaaaatttttacaatctacccatctgacaaagggctaatatccagaatctacaaagaacttaaacaaatttacaagaaaaaaaacaaacaaccccatcaaaaagtgggcaaaggatatgaacagacacttctcaaaagaagacatttttgcagccaacaaacatatgaaaaaaaatctcatcatcactggtcattagagaaatgcaaatcaaaaccacaatgagataccatctcatgccagttagaatggtgatcattaaaaagtcaggaaacaacagatactggagaggatgtggagaaacaggaacgctgttacactgttggtgggagtgtaaactagttcaaccattgtggaagacagtgtggtgattcctcaaggatctagaactagaaataacatttgacccagcgatcccattactgggtatatacccaaaggattatacatcatgctactataaagagacacgcacatgtatatttattgtggcactattcacaataggaaagacttggaaccaagccaaatgtccatcaatgatagactggattaagaaaatgtggcacataaacaccatagaatactgtgcaaccataaaaaaggatgagttgatgtcctttgcaggcacatggatgaagctgaaaaccatcattctcagcaaactatcataaggacagaaaaccaaacaccaaatgttctcactcatggatgggaagtgaacaatgagaacacttgaacacagggcggggaatatcacacactggggcctgtcatggggtggggggctgggagagggatagcattaggagaaatacctaatgtaaatgacaagttagtgggtgcagcaaaccaacatggttcacgcatacctatgtaacaaacctacatgttgtgcacatgtaccctagaacttaaagtataataaaaaattttttttgaaaaagaaaagaaaaagaaaaaggaaggacaaaaaaaaagaagtgaacttgattttccaggagattgctgaaataaatcccatgtatatgatcatatgcaaattacagagggaaggaacactcaggaacaactgcagttatcctctaatttaactttgccatacactttgtctttcttataattctaatgctgtgtattgtgtgcaaaaaatgaatttatgcagtacatgtatttgtaaattatttgaaaacaattttaattgctggtgcttctatgattagacttgaatttagtttattctccgtctgttttgtataatagcagataatgtcacccagaaggtactttacaaaatttaatgtgtttaaggaatctctactgatgttaattaagtttgatcttgcctctaggattggacaatcatgtaaaaattatttttttaaaataagcctgtgtgatatttcattttttttttttttgagatggagtctcactctgtcacccaggctggagtgcagtggcgtgatctcggctcactgcaagctccgcctcccaggttcacgccattctcctgcctcagcctcccgagtagctgggactacaggtgcccaccaccacgcccggctaattttttatatttttagtagacacaggatttcaccgtgttagccaggatggtctcgatctcctcaccttgtgatccacctgcctcggcctcccaaagtgctaggattacaggcatgagccactgcgcccggctgatatttcattttttttatgttaggtagcatcccccaaattaaaaaaacaagtaattatttttaccatatcagtttttagaggaagcattgatttatcttcatgtatgaatagttttgcatagcatacaaaattatcaatatttcttatttttgtatattattgatactcattataataaattaattccacatattacaaacaaaaaataaaaaataacatagattcagagacacctgtgggataccatcaatgtatcaacatatgcataacccaagggagagaagaaacataaaggggaagaaataatatttgaagaaataatggccaaaaatttctacatttagtgaaaaacattagtctgcacatccaagaagctcaaaaaaactctgagtggcataaactcaaaaagatcatacatagacacatattattcaaactgtcaaaaaacaaaatcaaagagaaccttgaaagcagtgagagagaagcaacttatcacatacaaaggatcctcaatatcctccaaaagattaacaactaaattgtcaacagaaaccatggaggccagaaggaaattcgatgacatgttcaaagttctttctttttctttttcttgagacagggtctcactatgtcacccaggctggagtgtagtagcatgatcacagctcactgcagccttgacctctctgggctcaagtgatcctcccacctcagcctcctgagtagctgggactacaggcacatgccaccatgcccagctaatttttgtagagatggggtctcaccgtattgcccaggctggtctcgaactcctgggctcaagtgatctgcctgcctttgcctcccaaagtactgggattacaggcatgagccaccacacatggccaatatattcaaagttctgaaaggaaaaaacaaataacctatcaaccaagaattctaaatccagcaaaactaactttcaaaaataaagtgattagactgaggtcagtactacagtgataccaaaaccagtcaaagacatctcacacacacacacaacttttgtagaccaatttcccttatgagtataaatgcaaaagtctcaacaaaatactagccaactgaattcagcagcatataaaaaggatacacactaagaccaagtggaactgatctcagaaatacaaggtaggttcaacaaataaaaatcaatgtagtatactatattaatgcaataatccaacacattattaatacaataaatggtaaaataaacatatcattttgatatatgcagaaaaaaaacatttgacaaaaaccaataacctattgtaattttaaaagaaaaaagcactcagcaaacaagtaatagtggggaacttcctcaaactgataaaagtcatctattaaaaacccaagcattcctatacaccaataacagacaaacagagagccaaatcatgagtgagctcccattcacaattgctacaaagagaataaaatacctaagaaaacaacttacaggggatgtgaaggacctcttcaaggggaactacaaaccctgctcgaggaaataagagaggacacaaataaatgaaaaaacattccatgctcatggataggaagaatcaatatcatgaaagagccatactgcccaaagtaatttatagattcagtgctatccccatcaagctaccattgattttcttcccagaactggaaaaaaaataaatttcatatggaaccaaaaaagagcccacattgccaagacaatcctaagcaaaaagaacaaagctggaggcatcacactacctaacttcaaactatatacaaggctacagtaaccaaaacagcctggtactggtaccaaaacagatatatagaccaatggaacagaacagaggcctcagaaataacaccacacatctacaatcatctgatctttgacaaacctgacacaaacagcaatggggaaaggattccctatttaataaatggtgttgggcaaactggctagccatatgcagaaaactgaaactggaccccttccttataccttatacaaaaattaactcaagatgaattaaagacttaaacgtaagacctaaaaccataaaacccctagaagaaaacctagccaataccattcaggacataggcacgggcaaagaattcatgactaaaacaccaaaagcaatggcaacaaaagccgaaattgacaaatgggatctaattaaactgaagagcttctgcacagcaaaagaaactatcctcagagtgaacaggcaacctacagaatgggagaaaatttttgcaatctacctatctgacaaagggctaatatctagaatctacaaagaacttaaatttacaagaaaaaacaaccccatcaaaaagtgggcaagggatatgaacagacacttctcaaaagaagacatttatgcagccaacaaacatgaaaaaatctcatcatcactggtcattagagaaacgcaaatcaaaaccacaatgagataccatctcatgccagttagaatagcgatcattaaaaagtcaggaaacaacagatactagagaggatgtggagaaataggagcgctgttacactgttggtgggactgtaaattagttcaaccattgtggaagacagagtggcaattcctcaaggatctagaactaggaataccatttgacccagcaatcccattactgggtatatacccaaaggattataaatcacgctactataaagacacatgcacacgtaggtttattgtggcactattcacaatagcaaagacttggaaccaagccaaatatccatcaatgacaaactggataaagaaatgtggcacatatacaccatggaatactatgcagccataaaaaaggatgagttcatgtcctttgcagggacatggatgaagctggaaaccatcattctcaccaaactaacacaggaacagaaaaccaaacaccacatgttctcactcataagtgggagttgaacaatgagaacacatggacacagggaggggaacatcacacaccagggcctgtcgtggggtggggggctaggggagggatagcattaggagaaatacctaatgtagatgatgggttgatgggtgcagtaaaccaccatggcacgtgtatacctatgtaacaaacctacacgttctgcacatgtaccccagaacttaaaatataattttaaaaaaacataagtaacatcatacttaacggtgaaagattgaaagctttcctctaaaatcaggaataagacaagaatatctactttcaccatttctatttaagattgtactggaggtcctacactacagcacaattaaacaagaaagtaaaataaactgcatccagattatgatggcagaagaaaaaattatctctatttgcaaagtgacatgatcctgtatggaaaaaatcctaaggaatacatacatacacagaaacaccccccaacacacacacacacacacaccagctaataagtgagtttagcaaggttatagaagatcaatatataaaaaatcagttgtagttctacacattcacaatgaacaatctgaaaatgaaatgaagtaaacaattcaatccaatagtataaaaagaataaattaacagaataagtgcaagacttgtacacatgaaactataaaacttcattgaaaggaattaaagaaacaaatggaaatacattttgtcttcatgtattggaagaatcaatactccccaaactgatctaccaattcagtgtaatccctattgaaattccatctacctatttgtagaaattgacaagataattgtaaagttcatatgaaaatgaaaggatttacgatagcaaaaacaatcttgaaaaagaacaaagttacagcactcatacttaatgattttaaagcttacttcaaaactatagtaatccaaacactgtggtactggcctacaacagacatatagatcataggacagaattgagagtccagaaatgagactatatacatgtaaaaaacaagtgactaattgaattttgacaagggtaggtaccaagacaattcagtgagcaaagaacagtcttttcagcaaatggtgctgggataactggatatctacacacaaaagaataaatgtagacccatatctcacaccatatacaaaacttaactcaaaatagatcaaagacctaattgtaagggctaaaactataaaacttctagaagaaaacatagaggtaaatctttgcgatgttagattaggcaacagtttcttagatatgacacctaaagcatgagcaaccaaaggaaaaatagatacatggactttaaaataagaaacatttgtgctttaaaggacactatccagaaagtgaaaaataacccacagacttggagaaaatatttgcaaatcatatagttaatgagggcctactatcaagaacatgtaaagaattcttacaactcaagaataaagagacaacccaattttaaaatgggcaaagaatttgaataaattttcccaaagaaaatatacaaatggccaataagcacatgaaaagatgttcagcatcattagttatcaagaaaatacaaatcaaaagcatgagatatcacttcacattcactaggacagctatagtaaaaaacaaataaaataaaataacaagtgctggagagtgtataaagagatgtggagaaactagaacctccatatactgctggtgggaatgtaaaatggtatagccagaaatcagttcgggatttcctcaaaaagtaaaacacatctaccatatgatccagcaattctactcttagatccaagataattgaaaacatgttcacacaaaaatgtacacaaatgttcacagcagcattattcataatagccaaaaagttgcaaacaacccatcagctgatgaataagttgcaaaaatgcccatcagctgatgaataaagaaaacatggtatatacatacaatagagtattatttggccactgatatatattcaacatggatgaaccttgaaaatattctgctaagtaaaagaagctagatacaaagcccatatattatatgagtctatttatatgaaatgtccagaataggcaaatcataagagacagaaagcagattagtgtatttcagggcttgggaagtgactaataggtatgaggtttcttcgtggggagatgaaaatgttctcaattacatagtgtgatgattgtacaaccatgaaaatatatgttttaaaatggtagattttatggtctataaattatatttaaatttttaaaaattaagtcgtccctaaaaatttgccaaaattaatttaagtgaagtctgttacccaacttcaaactatactacggggctacagtaaccaaaaaagcatggtgctagaacaaatacagacacacaccaatggaacagaatagagggcccagaaataatgctgtgcacctaccagcatcaaatctttgacaaagctgacaaaagcaatgggaaaaggactccctattcaatcagtggtgctgggataactggctagccatatgcagaagattaaaactggatcccttccttataccatatacaaaaatcaactcaagatggattaaagacttaaatgtaaaacccaaaacataaaagctttggaagatcacctaggcaataccattctatacataggaactggcaaagatttcatgataaagatgccaaaagcaactgcaacaaaaacaaaaattgacaaatgggacctaattagactaaagagcttctgcacagaggaaaaaaagaaactaatcaacagaacagacaatccacagaatgggagaaaatacttgcaaactatgcaactgacaagggtcaaatatccagaatctataaggaacttaaattaacaagcaaaaaataaacaaccccattaaaaagtgggcaaaggacatgaacacttttcaaaatatgacatacatgcagccaataagcatatgaaaaaatactcaacatcactaatcattagagaaatgcaaatcaaaaccacaatgagataccatttcataccagtcagaatggctatttttgaaaagtaaaaaaataacagatagtggtgaggttgcagagaaaagggaatgcttatacactgctggtggaaatgtaaattagttcaaccactgcagaaagcagtttgacgacttctcaaagaactaccatttgacccagcaatcccattattaggtatacacccaaaggaatataaatcattctactataaagacacatgtatgcatatgttcattgcaccaacactgtttacaatagcaaagacatggaatcaacctaaatgtccatccacggtagactggataaagaaaatgtggtacacatacaccatggaatactacacagccataaaaaagaataagatcatgtcttttgtagcaacatagatggattggaggccattatcctaagcagactaatgcaggaacagaaaaccaaacacggcatgttctcacttataagtgggagctaaacactgagtacacatggacacaaagaagggaacaatagacactggggcctgcttgagaatggagggtgagaggagtgtgaggattcaaaaaactactgattgggtactatgctcaaacctgagtgacaaaacaacatagacaccaaacccttgcaacatgcaacttatttatgtaacaaacctgcacatggacccctgaaactaaaagttaaaaagtctccatcttgaaactattaatcctaaatgctttcccagctcaaaggatctatgtctttgactagcattttagtcagttcgacttaaaattcactactctttcttccttgggtgggaagcccttcttcatttctcccagtctacaccttccagcctcttattatgatgatttagcccactaggtctcattctttttatctgacttgtcaccaatctccttatctatataataaagggactccctcccctttctaacacttctcctgtacttgaacttgacttctgtgttttaaataggtaggactctttttccttcagcaattaacaaacatcaaatggaacacaatagctttaaaaggaattacatagaaattgtttcacaatggactttaaaactgtactccttaagttcccagtggctaaaaatagtcatttgtttgctctgccaggaactcatacaaaataggaaaattttccccgctccatgttttatctcctctacacaataacaaaataagtgcaacagactattttagccagacataagcctgtcaaagctgaaaaacaggattcagaggaaagggtagataggagcttttctactccactcccatgaaactgacagctactgctgttatgaaccaatacatcattatttacattgggtgtgggaatatgtaagctttgtaagaagcacagagagccctttgacaactaggtcaattctcacaatggcaacaccctaagcagcatttccaggggtagcggttgtaatgtgctaaagctggcctgtatcaacttgcaagagccaattgttaaattttcaggaattttgagatatagttgtcaaatacaattactattaaaaattaaattataggccaggtgccatggctcacgtctataatcccagcactttgggagaccaaggtgggaggatcacttgaggccaggagttcaagatcagcctagcaacacagggagacctcatctccagaaaaataaaaaataaaaataaaaaataattatccaggcatggtggtgtgtgcctgtagtcctagctacttgggaggctcaggaggatcacttgagcccaggagttcgaggcttcagtgagctacgatcacgccactgtattccagcgtgggtgacagagcaagaccctgtccctaaaaaaaaggaaaataaataaattatataaacttataataaatgatataggaacaaaagtaataaatactcaaaattcatcacttcctaatcatttcatcacagtttatgctgcaatcttgcggttctttgtgcctactgcatttgtatgctgaaaatactacacaatggtgtgttcatgcacatctcttcccaactccacagcagtgatggcagcttaaaattagccatggtgggtgtgcttataccatggaattggcaaatgccataaatcagagcttatttttctggaaaggtgattgctaaatatttaccaacacaccactggacagccataaactgtagtctgtttttcctctggaatagcctattggttccacttcgaaactcttattcagtgcttagcatcctgatttgcatctacatatgcctgatatataagctaatgataaaagttcaccaaatgaagccacgcagtctgttacctatttaaaaattgatatttttcatagatttattgaatgttaaagttggaaggagccttagaaggcatgtatcgaaactgttcactagtggaaggactctcccctctgacattctcggacagatgtcaatttagtttctctcctctctgtgctgccacgtgtgctattccctccacgtgggacattcttcctaccatcctgcccttgcccaggttcatctttttctggatcactctttgtcactcttaaacaccacctcttccaagaaggcttccctaacctctaaggctgacctggtagcccttccacgtgttcttggatcacacactacttcctcctacacagcgttagtcacactctgtgaaattcccagtttctccttcctcagaccgtaagcgctaaggacaggcaacacacttacttcgttcattactttactcctgttgccctatccaggtgtttgtcaaaagaagcactctataaatgtgaacaaatgaatgaaggaaggaatgaatgaattaggcagtaggaaaggcactgaacttcaactcctaaaacaacactcaactcccaactctgcccttactaactagctgtgagccctctgttaagttacgttaagctctgttagccttcgtttacttacacataaaatgaaaaaagtaggactaactcaccacactgttgaggattaaatgggatgatttatgaacataaagcttttggtaaactgcaaaatggctttaaaatgccatatactgtattattatttctgggcacttccagagaaggggagcttacattttgcaatgccacccagtccaattttgatagctataattgtcacaatctccgtaaattcaactcttgtcctaaaattcttccaactcaacataataatctaatcttttttccatatgataaccttttaaatagtgaagatcagagctaagttacccttactaactttgtcttctcaaggctaaacagtttcagcttctttgaggaggtggaaggaaacttaccttcagagaaactctctttttgataatttgggcagtactaaagagccctatattcattttctattgctgctgtaacaaatcagcacaaactcagtggcttaaacaatacaaattcagtatcttacagttctgtaagttagaaatctaacagcctccctgggctaaaatcaaggtgtcagcggggctgcattcctttctggaggctttaggagagaatctgtttccatgctgattctccacagctgggaaaggttctccgatttttttaaggactcgtgtgattagattgggcccacctggataatccagcaaaaaaatcccctcatttgaagatccttaaccttaattaattctgcaatgtctcttttgccatttagggtaacatttttacaggttccaggaattaggacgtggacacctttggggggccgttattctgcctaccacaagctcctttatggccattttccctcttatatttgtcaacatcatttacccacatacacacttttacctttttaatttgatataaatacacacacatacatatgcacatacatatgtgtgtgcttataaataaattatccctttctcccctgcttactctgagtgtctattcacatgctagccatggggcatcctatacagtagattatacttcagatttccaattctgatcattgcttttcaaactaaatatggatttatcttaagtgacatgtggtcacttatctcaggctttgtccacacagcatcaaaatattaagtaaaaatgaaaattcagtccattttccagatttacctaatttcagggatctgaaatacaaaaaaagatgacgcaaggccttctagcagccttgcccccaaaaagagccttggttgagcaaaactccctgagccaaccagccctctagcctagctcactgctcttgataagtgctgtgttctttctacgatacccaaagattgcctaggttcaaattctggccacttactaagcctgtgatcttaatccacttaatctatttgtgttttagtttactcatcagtaaattggagataacagagcaccttctagaggcttatgatgaggagtgaatgagttaatacatataaaatacttatactgctgcctgataaattataaacactcaatgcacattgtaagggggtatgagacagggaataagtctaaatcactacccagcgaagagtctttgatgactcctgtggtaaaggtgaaggaggaaggaggaaatatagagcatgtctatgtcttaaaacccatttatcttaaagaagactaaataagggggatgggggggtacacttaaaggcacccctgatgaaaaacctctgtctccacataagtccaatcagaaattgattgggtaaacaagcccctactttttaatacaaactgacaactgaggcaaatataataattccacaagcatttaatgagcacctataatacgactcctatcacaaggatcgtgcagtctagttgagtatttctcaaaagcttttgacctgatctacaataacaaataccttgtttttactttgttttgttttgttgttgtagttgttgttgttttgagatggagtctcactctgtcgcccatgttgcagtgcaatggcacgatctcggctcactgcaacttctgcctcccaggttcaagcgattcttccatctcagcttcccaagtagctgggattacaggcaccctccatcatgcccagctaatttttgtatttttagtagagacgggttttcaccatgttagccaggctggtcttaaactcctgacctcaggtgatctgcccaccttggcctcctagagtgctgggattacaggtgtgaaccaccacgcccagccaacaaataggtttttacattatgacccaacacacacatacatgtatatactgaaacaaatactctaccttctattcttttttttttttttttttttgagacagggtctcactctttcacccaggctggagtgtagctgcacaatcatagttcactgcagcctcgaactcctaggctgaagtgatccaactacctgagcctccccagtagctagaactacaggtgcccaccaccaccacagccagcgaattttttaatttattgcagtgatggagtctccctatgttgcccaggctattctcaaactcctgggctctagcaatcctcccaccttggcctcccaaagcattggattataggcatgagctattgtgcctggccttaccttttcttcttgtctattctattcctcttttaaaaaactcttgtcacaacacccctcatcccactaaattgatttcactacccattaatggtcatgatccaaagtttgaccaaactggtattgaaaaacctcaatcgggacatgtgaggaattaactttaacacaatggagaatggaaatgtggagaatgggtttctccctaaataggagcttgaaatgaataaccatcaaggtctcagtcaattctaaaggccactcatggccgggctcagtggctcaagcctataatcccagcactttgggaggccgaggtgagcagatcacctgagatcgagagttcgagaccagcctgaccaacatagaggaaccccgtctctactagaaatacaaaattagctgtgtgtggtggcacacacctgtaatcccagctactcaggaggctgggacaggagaatcacttgagcccaggaggcggaggttttggtgagccaaggtcgtgccattgcactccagcctgggcaacaagagcaaaactctgtctcaaaaaaaaaaaaaaaaaaaaaaagccactcattacaatatgttcagacattaaatggcatagtctgatctatattaagtacacttctcatataaaggataagagttcaacgattaaatcctatctttttggggtaaatctacaggaagagacattttaatgaaaaccttccatgtgactatagtcgactcccattctataactttgtatgtgtagaaatggttcttttcaaaattcccaatgaaatcagcacttcaaacataatacttgggccatgaaaatacacccaaataaaatacgggtagggtttaaataacttattaaacgttttccagcagatcctgaatctaatgatgaatatgttttaatgaccccatcatatttgttacaaaatagtacattttttatttcaatagttttgggggtacaggtggtttctggttacatgaataagttccttagtggtgatttctgagattgtgatgcacccaccaccctagcagagtacactgtacctaatatgtagtcttttatccctcacccccatccatccttccccttgagtccccaaagtcctttatatcattcttatgcctttgcatcctcatagtttagctcccacttataagtgagaacatatgatagttggttttcctttcctgagttacttcagttagaataatggcctctagatccatccaagttgctacaagggccattatttcattccactttatggctgaatagtattccatgctgtgtacatacattttctttatccactccttgactgatgggcatttaggttggttccatatttttgcaattaagaattatgctgctataaacgtgtgtgcatgtgtcttttttatataatgacttcctttcctttgggtagatactcagcagtgggattgccagatcaaatggtagttctacttttggttctttaagaaatctctatcttgttttccatagtagttgtactagtttacattcccactagcagtgtaaaagtgttcccttttcaccacatccacaccagcacctattattttttggctttttaattatgggcattcttgcaggagtaaggtatctcattgtggttttaatttgcgtttccctgataattagtgatgttgagcatttttcataagtttgttggctgtctgtatatcttctgttgagaattgtctattcatgtcctttgcctacttttggatgggattatttgtttttttcttgttgacttgcttaagttccttgtagattctggatattagtcctttgtcagatatgtagttggagaatattttctcccactctgtgggttgtctgtttactctgttgattatttttttggtagtgtggaagctttttaatttagttaggtcccatttatttatttttgttctcgttgcgtttgcttttgggttctcagtcatgaattatttgcctaagccaatgtctagaagagtctttccaatgttatcttccagaatttttatagtttcaagtcttagatttgagtctttgattcatcttgagttgatttttgtataaggtgagagatgaggatccattttcattcttctacatgtggcttgccaattttcccagtaccattcattgaatatggtgtccttttcccaactttatgtttttgtatgctttgttgaaggtcagttggctataagtgtttgactttatttctgtgctctccattctgttccatcggtctacatgcccatttttataccagtgccatgctgctttggtaactatagccttgcagtatataatgtgatgcctccagatttgttctttttgcttagtcttgctttggctatggaagctctttcttggttctgtatgaattttggtattgtttttctagttctgtgaagaatgacaatagtattttaacgggaattgcactgaatctgtagattgcttttggcagtatggtcattttcacaatattgattctacccatccatgaagttgggatgtgttttcatttgtttttgtcacctatgatttctttcagcagtgttttgtagttctccttgtaaagatcttccacctccttggttaagcatattcctaattattttattattttttgcagctattttaaaagggactgagttcttgatttcttagcttcatcattgttggtgtatagcagtcctactgatttgtgtacattgattttgtatcctgagactttactggattcacttatcagatctagaaggtttttggtagggctttctaggtatatgatcacatcattgatgaacagtgacagtttgactttctcttttccaatctgggtgccctttatttatttctcttgtctgattgctgtggctaggatttccagtactatgttaaacagaagtggtgaaagtgggcatccttgtcttgttccaattctcaagggaaatgctttcaacttttccccattcaatatgatggtggctgtggttttgtcatagttggcttttattactttgaggtatgtcccttctatgccaatcttgttgagagtttttatcataaagagatgctggattttatcaaatgcttttgctgtgtctattcaaatgacgatatgatttttgtttttaattctgtttatgtgatatatcacatttactgacttgtattaaaccatccctgcatccctagtatgaaacccacttgatctgatgtattatctttttggtatgctgtttgattccgttagctagtattttgttgaagatttttgcatctatcaaaacagtaatattttaaagtattgcccttaatatgtcataactctaagatataaaaatggaaattctacaaaatgatcaaagaaagctacttataaaggattaaatgtgcaaatgattccttctgcgccaactattattacaaataaagctccagatcaaagggtagatcttctttaagtagattatgctcatagataaaacagactaatgaattttacagtagttttctgttgggtcaataatctatagattaattctcctttatttctagtgactaagttttccttgctacttatgcttttctctataactgacaaaaatttacataatgatatacaatttctttttttcatagtttgtatttattgggcacctaatttatataagatctcgttcttggtcttgtggaaatagagggtagatatacaaaaaaaatatcaaccagagtctctaaaaaatacaatctaacataaaatgtgacacagataaacgaagtatacaaagtgctactggctcaaagaagggagagatgatctccagcaaggtaaaaaatgaagagtccataaagggatttcacttaaaattggcagaagctggaaggaaaagcattcctgtaacagctatggtcctaaggcaagagtgtttgtggaggcaggaggtcaaaatgttcagaattttattgtaagctcatttcttatgagcttcttaagcttatattttttatttttaagtctaatacataaaatactaaaagcctagttctttcaccttactgtactgtccttcttaggttctcgcctgtactgtgctgactcagatttcttcttgcacaagcttgttccccatctcatagagtcagcatgactttgctagggaagtgacaaactactttcactctgatcaaattttgaccttggccttcctcaggtacacaattacctagttccctgctcttctttcttcctattgtgccttataacttcccattatatttagcatatttagcgcccctaggtttagcactgagttgcttttcacattagatttctcaaggacttactattgtagcccaaatagagaaaaaattaaacaaattatgaaattcctatttatatattccttcattctacaaatgacaattgattctttggttataagcggcactcttatgaataatgatgcatataagttgctaatgtataccatcacttttttgccacttagtcaaaactatttactaaagcaagcaaggagtcctgtgccatcatggagagcgtgtggagctaaccaccctacagcttgcttctgctcatcaaggaaatcaagaacctgctggttttgtccctgctcacctaacatctcacttctttttcctcatcacaatactgctaattccacctaatagaatcccttatgcttgtgtgtagcccgttcctaccaccttgctttcaaatgctgacccatacctcaagaagctctccctctctatatgtttcatttgcagtgtaaataaggcactattcatgaatgctggttttgtctatagtgctactgatattactgtatcaaccaaaaacagaactataagtctgattgtaaaaattacagtccatatagaatcatgctatccacctctacactgctcgtagatccaaaccatcccctcacaatccttgcaactttttcatccccctgaaattgaggctgcttttttaaatcaaaagtactcaagactttaaaacattacttcaatcacggtaactttttttttaatttttgggggtatatagtaggtgtatatatttatgggatacatgagatattttgatgcaggcatgcaatgtgtaataaccacatcaggataaatggggtatccatcacctcaaacatttatcctttgtgttataaacaattcaattatactcttttagttatttttaaatgtacaattacatgattattgactactgtcaccctgcagtgctatcaaatacgagttcttattcattctattttttgtaccaattaaccacccccacttccccaccccaccccacaccactacgctttccagctctggtaaccatccttctaccctctatctccatgagtttacttgtcttagtattttagctcccagaaataagtgagaacatactaagtctgtctttctgtgcctggcttatttcacttaacataatgatttcaggttctaactatgttgttgcaaatgacaggatctcattcttctatatggctgaatagtactccattgtatatatgtgtcacattttctttatccattcatgtgttgacagacacttaggttgcttccaaatttatggtaacttctattttttgataaatgactataattattattaacacattttctacaaattttctatttcattttaacacaataacagattaaacctttgtgggttagcctggaaacttagccatcgtgaataaaaccactctatgggggaaaaaaatctgagctgtaaaaaattaaactaaaactaatttatagattctatttggagatgcttgccaattcctgaggaaacaacagatagactgagtgggatgttactgatagcctccagggatcatgcggataagaaatacagtctaaagtccaccaaggttgagtacctcaggagccttattacattgaggtagaactctgaaggacttccaacctacagcaataggcatcaaatcatctcattctctaaaattgagttgacgtgatcctggactggttatacccacaggcgctagcaggaacaaacataatccttctctgaatgttgatgacaccatcctggacctcagattatctctgcaaacaatgtttcaaatataatgtctggcaaacaatttaatttttttaaaacagccacatgactagacaagcaaacatgaataaaaccaggaatataaactcaccaactgaggctccaaacattaaagttatcagatagagactctaactatcaaagaaatacagacaagaaaattataataaatgagaaaacacaaaaaatgaacaaaaggacattaaagacctgaaaaatgcaattgcaaaaattagaaactcaaaggatggtcataatagcagattaaactcagctgaactggaagagaagtcagaaaaatgaacaattaaaatgcatccagattaaatcaaggagaaaatacaaaatattgaaaagaatacaagagacatatggaataaacaaaattgacaaactcttagctatactaagaaaaaaagagaatactcaaataaaatcagaaatgaaagaagagatattacagctcatgctacagaaataaaaagaatcataagagactactacgaacaattatacgccaacaaactggataacctagaagaaacagaaaaattcttagaaacatagaacctaccaagataaattcaagaaacagaaagtctaaacagatctataactagtatggcaattgaatcattaatcaaaaacctcccaacaatgaaaagcccaggattatagacttcactggtgaattccaaattcattttataagagctgcattagcccgataccaaagccagataaagataccacgaaaaaggaaaactacatgacaatatctctgatgaatacagatgtaaaaattctcaacaaaacactagcaaactgaattcaacagcacattaaaaggatcacaaaccatgaccaagtaagacttatctctgagatgcaaggatagttcaacacatgaaaaccaatcaatgtgatacaccatattaacagaattgaaaataaaatcacatctttgtctcaatagatgcagagaagcatttggataaaattcaacactttttcatgataaaaaacaaaaaaactctcaacaaaccaggaatagaagaaaacaatcccaacgtaataaagaccatatatgaaaagcccatagttaacatcacactcaaaggcgtaaaactgaaagctttataagatctggggcaagaaagacatcctatgttcatggattggaataattaatattgtcaaaatgcccacactgcccaaagcaatctacagattaaacgcaatccttaccaatatcccaacagcattttttacaaaaagaaagcaatcctaaaattcacatgcaaccacaaaagaccacaaattgctaaagcaatcttaagaaagaacaaagccagaagcatcacacttcctgatttggaaatatattacaaagctacagtaatcaagaatataatactgccataaagataaacatattgactaatggaacagaatagagatcccagaaataaacccatgcatatatagtcaactgaccttcaacaaagatgctaagaatacacaatggagaaagaacagtctcttcaacaaatggcactgggaaaactggatatccacatataaaagaatgaaactgggggcagattcctagatggccgaataggcacagctccagtctgcagctcccagcgtgagcgacaaagaagatgggtgatttctgcatttccaactgaggtactgggttcatctcactggggcttgtcagacagagggtgcagcccacggagcaggatggggcatcacctcacccgggaagtgcaaggggcgggggaattccctttcctggcaaagggaagccgtgatagatggtacctggaaaatcggggcactcccaccctaatagtgcacttttccaaatgaccttagcaaatggcataccaggagattatatcccgtgcctggcttggcgggtctcacacccacgaagcctcactcactgctagcacagtggtctgagattgaactgcaaggtggcagcaaggctgggggaggggcgtccgccattgctgaggcttgagtaggtaaacaaagcgccctggaaactcaaactggatggagcccaccacagctcaaggaggcctgcctgcctctgtagactccacatctggggcagggcatagctgaaaaaaaggcagcagaaacttctgcagacttaaacgtccctgtgtgatggctttgaagacagtagcggttctctcagcacagagtttgagatctaagaacgaacagactgcctcctcaagtgggtccctgacccctgagtagcctaactgggaaacgcctcccagtaggggccaactgatacctcatacagccgggtgcccctctgagacaaagcttccagagaaagggtcaggcagcaacatctgccattctgcaacatttgctgttctgcagcctccgctggtgatacccaagcaaacagggtctagagtacgcctccagcaaactccaacagacctgcaggtgagggtcctgactgttagaaggaaaactaacaaacagaaaggacatccacaccaaaactccatctgtacgtcaccatcaccaaagaccaaaggtagataaaaacacaaagatggggagaaaccagagcagaaaagctgaaaattctaaaaatcagagtgcctcttctcctccaaagcaatgcagctcctcgccagcaacggaacaaagctggacggagaatgactttgacaagttgagagaagaaggcttcagacgatcggtaataacaaacttctccaaactaaaggaggatgttcaaacccattgcaaagaagctaaaaaccttgaaaaaagattagacgaatggctaactagaataaacagtgcagagaagtccttaaatgacctgatggagctgaaaatcacagcatgagaactacgtgacgcatgcacaagcttcagtagccaatttgataaagaggaggaaagggtatcagtgattgaacatgaaattaatgaaatgaagcgagaagagaagtttagagaaaaaagagtaaaaagaaacgaatgaagcctccaagaaatatgggactaggtgaaaagaccaaatctatgattgattggtgtacctgaaagtgaagggaagaatggaaccaagttggaaaaccactctccaggatattatccaggagaacttccccaacctagcaaggcaggccaacattcaaattcaggaaatacagagaacaccataaagatactccttgagaagagcaaccccaagacacataattgtcagattcaccaaagttgaaatgaaggaaaaaatgttaagggcagccagagagaaaggtcgggttacccacaaagggaagcccatcagactaacagaggatctcttggcagaaactctacaagccagaagagagtgggggcaaatattcaacattcttaaagaaaagaattttcaacccagaatttcatatccagccaaactaagcttcataagtgaaggagaaataaaatccttcagagacaagcaaatgctgagagattttgtcaccaccaggcctgccttacaagagctcccgaaggaagtactaaacatggaaaggaacaaccggtaccagccactgcaaaaaacatgccaaattgtaaagaccatcaatgcagggaagaaactgcatcaactaacaagcaaaataaccagctaacatcataatgacaggatcaaattcacacataacaatattaaccttaaatgtaaatgggctaaatgccccaattgaaagacacagactggcaaattggatagagtcaagatccatcagtgtgctgtattcaggagacccatctcacatgcagagacacacataggctcaaaataaagggatggaggaagatctaccaagcaagtggaaaacaaaaacaaagcaggggttgcaatcctagtctctgataaaacagactttaaaccaacaaagatcaaaagagacaaagaaggccattacttaatggtaaagagatcaattcaaaaagaagagctaacttcctaaatatatatgcacctaatacaggagcacccagattcataaagcaagtccttagagacctatgaagagacttagactcccacacagtaataatgggagactttaacaccccactgtcaacattagtcagatcaacaagacagaaagttaacaaggatatccaggaattgaactcagctctgcaccaagcggacctaatagacatctacagaactctccaccccaaatcaatggaatatacattcttctcagcaccacatcacaattattccaaaattgaccacatagttggaagtaaagcactccttagcaaatgtaaaagaacagaaattataacaaactgtctctcagaccacagtgcaaacaaactagaactcaggattaagaaactcactcaaaaccgctcaactacatggaaactgaacaacctgctccggaatgactactgggtacataacgaaatgaaggcagaaataaagatgttctctgaaaccaatgagaacaaagacacaacacaccagaatctctgggacacatttaaagcagtgtatagagggaaatttatagcactaaatgcccacaagagaaagcaggaaggatctaaaattgacaccctaacatcacaattaaaagaactaaagaagcaagagcaaacacattcaaaagctagcagaaggcaagaagtaactaagatcagagcagaactgaaggagacagagacacaaaaaacccttcaaaaaaatcaatgaatccaggagctagattttggaaatgataaacaaaattgatagactgctagcaagactaataaagaagaaaacagagaagaatcaaatagacacaataaaaaatgataaaggggatatcaccaccgatcccacagaaatacaaactaccatcagagaatactataaacacctctacgcaaataaactagaaaatctagacgaaatggataaattcctggacacatacaccctcccaagactaaaccagaaagaggttgaatccctgaatagaccaataacaggttctgaaattgaggcaataattaatagcctaccaaccaaaaaaagtccaggaccagacggattcacagccgaattctaccagaggtacaaagaggagctggtaccattccttctgaagctatttcaatcaatagaaaaagagaaaatcctccctagctcattttatgaggccagcatcatcctgataccaaagcctggcagagacacaacaaaaaaagagaattttagaccaatatccctcatgaacatcgatgctaaaatcctcaataaaatactggcaaaacgaatccagcagcacatcaaaaagcttatccaccatgatcaagtcagcttcatccctgggatgcaaggctggttcaacatatgcaaatcaataaatgtaatccagcatataaacagagccaaagacaaaaaccacatgattatctcaaaagatgcagaaaaggcctttgacaaaattcagcagcccttcatgctaaaaactctcaataaactaggtattgatgggacatatctcaaaataataagagctatttatgacaaacccacagccaatatcatactgaatgggcaaaaactggaagcattccctttgaaaactggcacaagacagggatgccctctctcaccactcctatttaacatagtgttggaagttctggccagggcaatcaggcaggagaaggaaataaagggtattcaattaggaaaagaggaagtcaaactgtccctgtttgcagatgacatgattgtatatttagaaaaccccatcgtctcggcccaaaatctccttaagctgatatgcaacttcagcaaagtctcagtatacaaaatcaacgggcaaaaatcacaaggattcctatataccaataacagacaaacagacagccaaatcatgagtgaactcacgttcacaattgcttcaaagagaataaaaaacctaggaatccaacctacaagggatgtgaaggacctcttcaaggagaactacaaaccactgctcaatgaaataaaagagatcacaaacaaatggaagaacattctatgctcatggataggaagaatcaatattgtgaaaaaggccatactgcacaaggtaatttataacgataataaatgaaatgatttctaatgataatgaatgaaattggatctttatctaaatttataatttataaggtaatttataatttattatatttatttataaataaataaaaattatttataatttataatttgttcaatgccatctccatcaagctaccaatgactttcttcacagaattggaaaaaactactttaaagttcatatggaaacaaaaaagagcccccattgccaagacaatcctaagccaaaagaacaaagctggaggcatcacactacctgacttcaaactatataaggctacagtaaccaaaacagcatggtactggtaccaaaacagagatatagaccaatggaacagaacagagcccttggaaataataccacacatctacaaccatctgatctttgacaaaccttacacaaacaagaaatggggaaaggattccctatttaataaatggtgctgggaaaactggtcagccatatgtagaaagctgaaactggatcccttccttacaccttacacaaaaattaattcaagatggagtaaagacttaaatgttagacctaaaaccataaaaaccctagaagaaaacctagccaataccattaaggatataggtgtgggcaaagacttcatgactaagacaccaaaagcaatggcaacaaaagccaaaattgacaaatgggatctaattaaactaaagagcttctgcacagcaaaagaaactaccctcagagtgaacaggcaacctacagaatgggagaaaatttttacaatctacccatctgaaagggctaatatccagaatctacaaagaacttaaacaaatttacaagaaaaaaaatcaaacaaccccatcaaaaagtgggtgaaggacatgaacagacacttctcaaaagaagacatttatgcagccaatagacacatgaaaaaaatctcatcaccactggccatcagagaaatgcaaaccaaaaccacaatgagataccatctcatgccagttagaatggtgatcattagaaagtcaggaaacaacagatactggagaggatgtggagaaaaaaaacacttttacactgttggtgggactgcacactagctcaaccaatgtggaagacagtgtggcaattcctcaagtatctagaactaggaataccatttgacccagccatctcattactgggcatatacccaaaggattataaatcatgctgctataaagacacatgcacatgatgtttactgtggcactattcacaatagcaaagacttggaaccaacccaaatgtccatcaatgattgactggattaagaaaatgtggcacatatacaccatggaatactatgcagccataaaaaggatgagttcatgtcctttgcagggacatgggtgaagctagaaaccatgattctgagcaaactatcccaaggacagaaaaccaaacaccgcatgttctccctcataggtggaaactgaacaatgagaacagttggacacagggtggggaacatcacacactggggccaaaaaaaaaaaaagaatgaaattggatctttatctaacaccacacacaaaaactcaaaatacttaaactcaagaaatgaaagtgtaacattcctggaagaaaatctggaggaaaatcttttgatattgtctttggccatgatttactggatatgacaccaaaagcacatgcaataaaagcaaaaatagaaaagcaagattacatcaaactaaaaatctgcaccacaatgaaagcagtcagcaaaacaaaaaaaggcaatctataaaacgggaaaaagccctccctctccctctccctttccctctttcctctttcctttctacggtctccctctccctcgtctcccctttccacggtctccctctgatgcccagccgaggctggactgtactgccgccatctcggctcactgcaacctccctgcctgattctcctgcctcagcctgccgagtgcctgggattgcaggcgcgcgccaccacgcctgactggttttcgtatttttttggtggagacggggtttcgccgtgttggccgggctggtctccagctcctgaccgcgagtgatctgccagcctcggcctcctgagctgccgggattgcagacggagtctcgctcactcagtgctcaatgttgcccaggctggagggcagtggcgtgatctcggctggctacaacctccacctcccagctgcctgcgatggcctcccaaagtgccgagattgcagcctctgcccagccgccaccccgtctgggaagtgaggagcgtctctgcctggccgcccatcatctgggatgtgaggagcccctctgcccagccgcccagtctgggaagtgaggagtgcctcttcccagccgccatcccatctaggaagtgaggagcgtctctgcccggccgcccatcgtctgggatgtgggaagcgcctctgcccagccgcaaccccgtctgggaggtgaggagcgtctctgcccggccgccccgtctgagaagtgaggagcccctccacccggcggccgccctgtctgagaagcgaggagcccctccgctgggcagccgccccgtctgggaagcgaggagcccctccacccggcagccgccccatctgggaagcgaagagcccctctgcccggcagcctccccgtctgggaagtgaggagcatctccgcccggcagctgcccagtccgggaggtggggggcagcccccgccaggcagccgccacttccgggaggtggggggtgcctccgcccagccaccgccccgtctgggaggtggggggcgcctctgcccggccgccgcgtctgggaagtgaggagcccctctgcccggccgccaccctgtctgggaggtgtacccaacagctcattgagaatgggccatgatgacgatggcggttttgtcgaatagaaaagggggaaatgtgggaaaaagaaagagatcggattgttactgtgtctgtgtggaaagaagcagacatgggagactccatcttgttctgtactaagaaaaattcttctgccttgggatgctgttaatctataaccttacccccaacccagtgctctctgaaacatgtgctgtgtccactcagggttaaatggattaagggcggtgcaagatgtgctttgttaaacagatgcttgaaggcagcatgctccttaagagtcatcaccgctccctaatctcaagtacccagggacacaaacacggcagaaggccgcagggtcctctgcctaggaaaatcagagacccttattcacatgtttatctgctgaccttccctccactattgtcctatgaccctgccaaatccccctctccgagaaacacccaagaacgatcaataaatactataaaataaataaataaataaaaaacgggaaaaaatatttgcagaccatatatttgataacatattaacatctaaattatataaggaactctaacaagtcagtagaaaaaataaaataatctgatttttaaacaggtaaaggaattaaataggcttttatcaaaagaagacatacaaatagcctacaatatatgaaaatgtgctcaacatcactaattatccaggaaatgcaaatcaaaaccatgatgaactatcttaacacaatgtttaaggttagaagtggtttgagtttttattcagaagtttgataatgtttttgtgaccagaaatatgccataataccataaatatgccatatttcactcttatttaaatcaattcacctattttggtaaaattggttttgttttacttcattcacttaaagtcaaagtttccaagaacctatcaatgacattaagtaaggacttactgtacttaaaaatttgccaatatggtagatcttatgttaaatatttgcatcacaaaaataataataatagtaataataaagatgccaagaggaaactttttgaggggatagatatgtttatagcatacactgcagtgatggtttcacagctgtacacttatctccaaatttattaagttgtacatattaaatatgtacagctgtttgtatgtcaactatacctaaaaaaactggttttttaatgtgaaagaataaatctaacaaaaagatagaactttaagcagaaaactgtaaagcgttttgaataatataaaagaatatgtaaacaaatggaaggacatactatgttcatagattgaaagattcagtattttttaaatgaagctccccctaagctgatctagggattctataagatcccaatcaaaactccaataggtgtgtatatgcatatgtgttgaacaagctaattacaaaatgtatatggtaatgcaaactgtcaaggatagccaaagacaatcttaaagaagaaaaagtgggaggactttctcaatcagctatcagcacttacttagctgtattagcacatatagtattggtttaagaacagccaaacagatgaaatatatagaacagtgacacagaaacagactcatgtatatagtcacttgatttaaaacaaagatgacattgcaaagcagtgaaaaaattatagcctcttgaataaatggtggtgagaaaattacatattcatatgaaaggaaacccgaattctattctacaccatacattaatattaatttcaggcggattataaatgtaaacctgaaaggcaaaacaataaagcttccaaaagaaaacactagaagatgctttatgaccctggggtacaaaaagatttcttaaataaaatgcaaagacgataaagccttaagaatttctgttcatcaaagataccattaagagagtgaaaggaaaagccaaaatgggaaatgacatttgcaacacgtgataaagagcttatatttagaatgtataaaaacttcctacaaattaatttcaaaagataggcaacataacagaaaactggaagaaataaaaaactgcaagggggccttcacaaaagaggatacccaaatgccaataaacataataaaaagtgctaatctcattagcagtcagggaaaagcatgttaaaatcaccataggataccactacacacccactcacacaactaaagttataaaggctagcaaaagcaaatgttggcaaagaagcagaaaaaagagaactcgcatacactactacttaagaaagttatttaggccaggcatggtggctcacgcctgtaatcccagtactttgggaggccgagggaggaagttcatgaagtcaagagattgagaccattctggccaacgtggtaaaaccccgtctctaaaaatacaaaaattagctggtcatggtgtcaagcctgtaatcccagctactcgggaggctgaggcaggagaatcgcttgaacccaggaggcagaggttgcaatgagccgagatcgcaccactgtactccagcctgggcaacagagggaaactcgatctcaaaaaaaaaaaagaaagttatttggtacaactgctttggaagactatttagcattatctattatctattaaagttaaatatacgcatatcttataactcaaaaatttctctcttaagtatgttcccaacttaaaagtctgcagatgtgctccaaaatacatgtacctgaatgttcagagcaggataattcatagcaataaaaacctggagacaacccaaatggccatcaacagctggatgaatacgatggtatattcattcaatggcttattattctgcatgtttgaaaacaactagttatcaaaattatcaaatacctaggtataaatctaatgcaagatgtgtaagatatatacactaaaaacacacacacacacaaaaagaaaataactagttatatgtgacatcattgatgaatattacaaatgatactgagcaaaaaaaaaaaacccagacaaaaatatagatactgtaagattctgtttatatgttaaaaaaaaaaggtaaaactagagacacatacctagatggaaaaaagaaaacaggtaattattgtaaaagtaaagacagagatttcctctttttttttttttttttgagattgagtctcactcttgttgcccaggctggcgtgcaatgacataatctcggctcactgcaaactccgcctccggggttcatgcaattctcctgcctcagcctgggattacaggtgcccgccacaatgcccagctaacatatatatatatatagtatttttcataggaacggacgggttttcaccatcttggccaggctggtctagaagtcctgacctcaaatgatccgcccaccttgacctcccaaagtgctgggcttacaggcatgagcaattgtgcccagccaaattctaaaagatagagggaaagaaagctatacaaactggctgggccctgaggcagggcttctggcatgttgacaatgttctattattgatctgagtgatgggttacatgagtgttcgctttgtgataaatcaccaacctgtacatttttgctttgtacatttctctgtttgctgttatgtttcacaagaagtgagtttttgtttttttttttaacagtatcccaaggtatttccccaggaagaaaagagggttggggtggaagacataagtaggcacagttcacaagtaagctgttcccatggcaagaacttggaattaaacaaaatactgtgcttttctgagggtttatttatacaaaacaatacatagtaaacagatggtggctcttagaccagagcaagataaccagaaaaattattatatctaagaagaagtttccatagacatgaggcatagagaagaaacagtaaaatcacagaagcaaccacaatagcaatgactatatgagtattttccagaggaaacagcccatttaccaaaacacttccactactacatttcctctgacaaggtaatccctatggtgctatcatagaaatagatgcaaaaggcaactatagattatctaattaaatatttgaattatataaattatccccattcttatttcatattccatacacaaccttctagttgtaatgtgttttttcatgatgtttacctacagggagagaatctactagtcaggtccatgtaagtataatatgcattgggtagtgttatacatggatttctcacgagctttgttagtattgagaaagaaaagtggctcagagcagtctgaggaatgcgagttatgcaaaaggtatcaagcccagagagtcaggagcatgagacttccctcaggttccctgtacccatgcctgcaagtaattgtttaaaggcattttgttttttctttcctttcctatagtttccagactagctgataaagtatctaaaaagttaccgtaagttgtacaattgtccttcaccattatcctcatattcctggaacttgtgatacaaaaaacaatgtatagccaaacaacttatgttattttaatgaaccaatgtaaatgattggtaaacaatttaggaactgctccctaacttcttgttttcccactggtaactgctgctaatccaagcatatactcagggcaacttcaatctatagctcctgagcttcagttttcaaccatggcccaaatatattaattttgcctcagtttcttcccttaggtcaatgatatctatcagtaatcttgaacccaaatattctgagataaagacaagataatatttatattcctttaagactaaagaccaaaacctggaacattagtcaattcacgacagttatgaaaaagacctcttggccttctgtggccatatccctttgtatcatgtgcacacgcttttcacctcaaagcttttacggtgaattctgtggtatggctggagtatacagtgccagtaggtgagtccaaaaaaggcgcatggaagacaaaccaaaatgtttgcatatgagcctattttagtttatttaaggaaataacatgtgccaggtagtgtactgaacacttgctataaattacaatatcatttaatctttacaataccactatgtgagtattactagtgttatcattatccctgttttttataatagcatcattatccatttttcagatgaggaaactaagtcagtatggctatatggcttgcccaaggtcacatacgtagtaaacagcgaaactagggtttgaatcccaacagtctgattccgtcttgttcttaaccattaaactgttttctctgctacagtctaaaactatttagtataagaggccatctattcatcaataatatttacagtgtagagacaaagattctaggaacatggcagcctgaaaacataattgctgatgcttctcctaactccaaactaactcttttacttcctgggccagaggcaggtagggcctagagagtgtgagtagaacctctgctcttatggggtcacagagaaagctagtgtaagacaaatttttctctgctaagtcaaaagatatactgaggtctagtggcaaagagccataggacaagattcagaattcaaggttcctaggaaaagcctggtcttgagagatttatgggcccctctggtagacataataatgcctccctccccctaagatatccaaaaagctcaccctctgaccctgggaatatgtttccttacatggcaaaaagctgttgttgatgtgattatctggtgggccctaagtaatcacaaggatccctataaggagggaaaaaaagggcaaaggtaatagtaggagatgttataataggagtctcagagtgatacagtatgagaaagactcgttaaagatgaaaaaaagggaccataagccatggatcgcaggtggcttctagaagctgagaaaggcaaggcaatgcattttcttcaaaagccccgaggaagaacacaggcatgctgacaccttcattttggcccagtgaaactgatttcagacttctgacctccaaaacaataagataatacattcatattgttttaagccactaagtttgtggtaattagttacgtgagcaagagaaaactagtatattcccccaaaaaacagacagagctggatgtttttaaatgaacatgctggtcttcctggcccagatgagctggtgcgagagggggcggaaaaggtgtatgaagtcctgcctgctccttaggatggaagagaggctttgcatctacaaagatgagaatgtggagagcatcacacagtgtcctgaaatcgaataagaatgtgtagtatcagtgcaaaataagtaataaaaacctaataatagtctgaggcaaaaattaccacactggttttttttacacttaggtattaaggaaggaggtattaagcattaaggtcagacatggggagatagcggacaaaagagcatttaaatgtctctggtggggaaacaggaagtaaaagcactctaaaataaaaggaaatttactggtaagggaagaagagagggtcctggtgggggaaatagttgaaattttattttcttgtaccagtggagaaatgtgtatttattacacatgttggaaaaatagggggaaaaaaatctaccaccaccaccaccaagaataaaaaagaaaaaattatttggaaatttagaaacactttcaaaatgctgtgataaaaagaatataaaaactgaaattacaaacagaagacaaggaagaggaaaatgtttcatagcaaacttaataggatgccgtgaaagccaaacttaaaggaaaccttatagcttcaagcttcaaaagcatttctcttttattttattttattttttgagacagactcttgctctgtcgcccaggctggagggcagtggtgcaatctcggctcactgcaacctctgccgcccaggttcaagcaattctcgtgcctcagcctctctgagttgctgggaccacaggcgcctgccaccaagcccagctaatttttctatttttagtagagacagggttttgccatgttggccaggctcgtcttgagctcctgacctcagatgatccgcccacctcagtctcccaaagtgttaggattacaggcgcgagccaccacacccagcctcaaaagcattttttatgaggcaagaaagatgaaaaagaaaattagtgctcacttttagcaactaggataggaacaattaaatacatagaaagtaggaagaaaaaaatgaataaaggtaaagcttcaattaataaaacttaaacatctcaaattgtaaaatgaagaaatctaaaaattgatctttgaaatgattaataaaataaataccccccaacttcgcttaaaggaaactgagagaaaaatatataaatgattaggagtataaaaaattcataaatacaggtaagaaagatactaaggcaattataagacaatagtacttgcaattttgcgtgctatttacaaatgctgcataacaaactaccctaaaacttagtggtttaaaacaattattttattatgctcacagatgctttaggtcaagaattcagacagggctcagctaggctgggtttgtcatgtgattacgttgagatgacagctgggttggagctctgtgaaagctcaaattacactgtttatccaagatgccaaccagctgtcaacagatgctggcggatggcaggagctgagctgggagcttagcttggcctatcaatggggatgctcacatatgggctctccagcatggaagacccagacttcttacatggcagttgagttccccagagtgagcctcccacagaaccgggaaaaagctgcatagccttttctgaaccagccttggaagtcagcatcacttctgccatcttccagtggttgaagcagtcataagcctgcctagacccaaggaaagtaggcataaactcacatcttgataggaatgtcaaaaattttgcagaaatgttttaaaaccgccacagcaacaaatatgaagcctagaggaaataattttctagcaaaatgtaaattcccaattatgacccaagaagtaaaaaacttggatagatcaaatgccacagaagagataagaaaagtgattaaagatcagccattaaaataaatgcatcaggcagtttcacagctggggtatatgaaacttttaaagaagagaagtgtaatattatttaaaccagggactttccaattttagtgagcctcaaaataacctcaccagctaataaacacacattcctgggccccatcccagactgattctgtaagttcggagtacagaacagggatctacatttgtaacatgcacacatgtgatgttaccatcacttattcacacaattcactttgagtagcactgatttaaaccaggagttagcaaactatggcccagtggccaaatctggcctgtcgcttgcttttataaataaagttttattggaatacatacaggtttattcattcacttattatctatctttgcttttgcactacaatggcagggttgagtaggtatgacagagaccatatggcccacagaacctaaaatacttgccatctggccctttgcccaaaaagtttaccgtgccctgtctaaaccactaccttattctacctcaattatacctcattatattttcccttttccaaacttaagcagactttttggatattctgctgacatattcgctccattggttaaggtgcaaaactaatatgacaaatagttttcatggcacaggctatctgcactaagcaacaaccaaatcactatgttgaagaggatgtgagactgcccaagctcagcaggaaacaacgttgcaattgattagagatgtcttctacacacattgaaagggtaacttgcagcatgcatgctgtgtgtttgctaaccctgattataaaatatataaggtttaagattattttcaaaatctgttggataactgcaacaaaatatgaatgtaatgcacccatttttaactgcaccataaacaatatatcagattttgctccaaaggctatggaagttattgcaataatatgcaaatgtttcacactcataaaaaagtagaaaaataaaaccattttgtgatttttatcagagtataatacagaccaattctgtcatgtttgtacacaagacttctgagattgatgtctgctcttgaaagaatatgaataatgtttcaaatgctataaaccaacattttatcagttgaaaatgtccttattgtcaaaacatctttcaaagatgctaactctaaactttgaggtaatttttgcacattaacacccttttcccatgatgttagttccaaaatagtggcccagagtatatcaacagcagaaattacatttcaagatttgcatatttacattattacttaaaagaaaaaaaagtctgttgttctaggcaaaagaaaaatggcacaagaaaatatgtgtacatgtttgttaccttaggcagaagaaaaactgcaggtgaaaatttccagtgtgcgtaagcaacagttaaataccaaaacccagtaaagccagaagtgagcagcagagctgccacacagatcactgaaggtggcaccagagaactaaccccagaggaaggtcctagaagaaagaggtgaagatcagccaggcgtgcccagacatggagtttttctcaccactacagttccgcacgaacaaagcctggcacacagaaaaaacaccattaatatttaagaaaggaaagagaaagcatgaaaagtaaaagggagggaaggcagaagttcacaacaaaaagccagtcttccaaaacattcctacagagctgtggctccaattctaaaataaagacccccaagaatttgatatgtaaaataaagttttatttgttacatggttttgtttgtggttttatttattacatggtttctctggtaaccctgtattaataatacatagcaaaaggaaagaagggcagaatatctgctgtacagttgataatatttgtccagtcatgctgggtgaaatgtatcaacaaagcaaggtaacttcaaattgtatctagcatggaagcattcagaactacagagtccatgtttatgccctcaaactgtatatgtgccggagccagtggctcacacctgtaattccagcactttgggaggctgaggagggcggatcacctgaggtcaggagttcaagaccagcctggccaacatggtgaaaacccgtctctactaaaagtacaaaaattagccgggcgtggtggcaggcgcctgtaatcccagctactcaggaggctgaggcaggagaatcgcttgaacccgggaggcagagtttgcagtgagccaagatcgcaccactgcactccagcctgggcaacaagagcaagactgcatctcaaaaaaaaaaaaaattgtttatacgtgcatttttctgaggaaagattccagtacattcatcagagtcccaaaacagtccacagcctaacccactctactccccaaaaataggaagaaccacactgcaatgttttacaaactataggtcattttggtgggcacacatttttaaattaaatagaatagaaagtataagagtataacattgatcataagggtattatttcttcaaacttgttccagcaagtatatatatttctctctctctctctctctctctctctctctctctctgtgtgtgtgtgtgtgtgtgtgtgtgtgtgtgtcaaggtaaattttttcatactgaggtggtctgggtcaatttggaactcattgttctaaggcataaaaaaatggctagattcaactttgtaacatattaaatcatcatccattgaaaacaaatctgtggttccagtgggcattatactgttttgagtggcataagacacaccaaaatgaaattgttataattagagaactgcaatctataatactcataaatgaaagtgtatccctataaagtcctatagatcttaaggagatcaaaggctgccattgaaaggacttcacactgtctctgggaaaatgttaaattctaagtaaaatgtttaggaataaaaagagttaaaatattcccctgggatgataacgtcctctaagcaccttagaaagacgtcagagaaggggagagagagtatggaaagtcatccctaagcctggtacagagatgagtcttaggaaaaaatatttcctttatacaaaatagacgagagaacatggatattctgccatgactgcttgggtatgaacgtgtcaccacagtgtctggtactgtcttccgattttttctaagcctcagtatgagaagcattaatggtccatatactgagttattgggcttatttctaaaatgttactaatgcactttacaggtttaagttctcccaatcaatgcaaaaatttcaaaagtatcactgggttctacacagccagaccattacctctccccatactattcattcaacaggggactaatatccagaatatacaaggaactcaaacaactcaacaggaaaaaagacagtcccactaaaaggtgggcaaaggacataaataaacatttctcaaaagaagagctacaaatggccaacacatgtgaaaaaaatgctcaatatcactaatcatcacagaaatgcaaatcaaaaccacaatgagatatcatcttaccccaatcagaatggctattattaaaataaaaaataatagatgttggcaaggatgtagagaaaagggaactcttataaactgttggtgggaatgtaaactagtacagccactatggaaagcagtatgaagatttctcaaaaactaaaactaaaaaagaattactatcaatgcagtaatcccacgactcagtatctacccaaaggaaaagaaaccaatatatcaaagggatacttgcactcacatgtttattgcagcattattcacaatagtaatgatatggaatcaacctaagtgtccctcaacagatgaatagataaagaaaatgtggtatatatatactagaatactggaatggaatactctttggccataaaaaagaataaagtcataccattttgcagcaatatggacataactggaagtcattatcttaagtgaaataagccaggcacaaaaaggcaaataacgcatgttctcacttacatgtgggggctaaaaatttgatcacatggaggtacagagtgaaaggtagagaagagagactggaaagggtgaacgtggggaggagggaggatgaagagaactgaattaaagggtacaaacatacagttagatagaagaaataaattcaatgtttgatagcagagtagggtaattatagttaacaaaaatgtattgtactcaggtgatggacaccttcaatatcctgacttgattactgcacacattatctacatgcaacagaatttcacaggtatctcataaatttgtacaaattttttaaaagaacatgaatttccaaagtgaaagagcccagagacttcagagcaaaattaatttttttaaaagatccacctcaataatcaccgtaaaatttcagaacaccaagaataaagagaagattggtcaaggaacttcacaatggaaggaacaggctgataccacctgaacagattaatcactattagcctcacttaaaagtaggacaaccagaaaccattatgtgctcatgatgtaatacaataggaaatacaaagcaccagctatgaagttttattgtttaacaactgaagtagaatttagtcaagtctgaacctaaatgctagtaagttttttattcaattgttgtatttttcactactaaaatttcatttggttcttcttcatatcttctatttctatgctgaaatgtccctttttcttttctttttttgttgttgtttatttgttgtttgtttgtttgtttgaagagacaaggtctcactctgttgcccaggctggagtacaatggcatgatgatcatagctcactgcaaccttgagctcctgggctcaagcaatcctcctgtctcagccttccaagtagctaggactataggcatgcactgccatacccagctaattaaaaaaaaaaaaaaaaaaaagattttttttttttttttttttttttttgtgacagagtttcactctgtcacccaggctggagtgcagtggctccatctcgggtcactgcaacctctgcctcctgggttcaagtgattctccacatcagcctcccgagtagctggaattacaggcacccgccaccacacctgaccaacttttgtatttttagtagagatggggtttcaccatgttggccaggctggtctcgaactcctgacctcaggtgatccgccgacctcagcctcccaaagtgctaggattacaggcatgagccaccatgcctggcagggtcttgctatgtggcctaggctggtctgaaacccctggcctcaagtgatcctcccacctcagcctcccaaagtactgggattacaggcgtaaaccaccatgcctggcccccgccttttttaaattttgtttcaagtgtgttcataattactcactgaagcattttttaccatggctgctttaaagttcttgtcatataattccaacacttgtgtcatctcaatattggtgtctgttactgacttttctcaatcaagttgagatttccctggtttttggtatgataagtgattttctgtagtacacattattgtttagaataacatgagattaaaatggacatgtgccaagcgctgtggctcatgcctgtaatcccagcactttgggaggccaaggcaggcagatcaagaccaggagttcaagaccagcctggccaatatgggaggctgaaccagggaggtggaggttgcagtgggccgagatcatgccactgcactccagcctggggaacagagcgagactctgtttcaaaaaaaaaaaaaaattaaaaaaataataaaaaataaataaaatggataagtaactaatgaatcagaagttttcttgagtaaaaaaaaaaaataggagccaggatggtggctcatgcctgtaatcctagcactttgggaggccgaggcaggaggattgcttgagccgaggcattcaaggccagactgggcaacatggcgaaacctcgtctctaccaaaaatacaagaaattagttgggcatggtggtgtgcacctgtagtccaagctttcaggaggctgagctaggaggatggtttcagccgtgggaggcagagattgcagtgagccaagaatgcgctgttgcactctagcctcagtggcagagccagacagtatcaaaaaaaaaaaagagtaacaataacaaaagctaatacttaaatagcatgatgtgtcaggcactataatgagtatcttatacatattaactcatttaatacttacaacaactctatgaagtaggcactacaattatctgaattttacaaatgaggaaactgaggttaagtaatttgcctgcagtcacacaactagtaaatggtaaagctagaatatgaatccaaaccgtctgcctccaaagtccatgctgttgaaatcagtatgccatcatgcccccagtaatgtattactgtagctttatttgtgtaaacatgtcattgttttcctatacagggaaattttagggtgaatcttgtcattttagtcatcatcataggtattataaaagattactttgttgccactaactaaagaaaaaagccagtagtaggcatatttttagaaaaacaaaaggctcaagaagataggcaattttacgtgaatttggcagagcgacctaacctaacaagatgtgttctttcctacatgtgtctagtgctcaacgaatgcttgttgaatgaatgaacacacacacatatgcatgtctctaaagaatgaacgataaacaggatgtcagctacttttttaaaatgtcaaaaagggaaagaatatggagctatgatcttctaacaggaggacttcctaaaagtcaagggtccggaactcgcttgtctcagatgataattacaggccaatgaaccactgctatctggccaattaacctttctgacaaaagaaggatgtctaaaaataagagaaatgttttcaaatattactgataatataaactgggttttgtacatttaagatttgtccagaatctctttgtcccttgatatgtaacctatccaagaagtatcagctccagccagaaggattttactattacacaacctgtaaagtttacagaagaggtattctgaaggagaaaaaaaaacaataatgactttctgaaaaaacaaaattgtagataactttgttaaaaaacaaaaatttaaaacgaagtaaaaattaagattctcacctagcccattatcatagagacttacattgctatcaagcccgtttctctaggggcttaaaggcaatctctgacacggtgctgcatctcaaaatgttccctcagtgaggtgatgaatctctcttgccctggtctgatgaggccatgagtgatcgtttaagaatcagtgtatcagtgaacaaggcaagggagcaagccagctggccaatatgaagatgaaatacttgacctagcgacaccaccaaagtctcagcaaaaacaggctatgtcctacaaacaggtaggaatctgttcacttttgatctgaaacaatggagcacccctaaaataccaacaccaataaataagagtaaacaacccaatagtttcggattgcagcaggatagcaaaagattcgaagaatctacctgaaattgcttcttcatcataaagaatgccccttagcaactgatgcaataattacttggcattaagatagacatatgatttatttggcatttaactatcatgaatatacataaaggaactcagtgaggttacattacacccttaatagctaactcataactgtagtacgtaaataggagctaatgtaaatgctaagcttctatagataaataaataatatttgatgtatcacccttcagtgagccgcaaactgaaagaaagattatatgatcaatttaggcctgaaatccttagcgcactgttggtgggaatatagactggtacagccattatggaaaacagtatggaggttcccgaaaaaattaaaaatagaactatcatacaacccagcaatccctcttctgggtgtatacccaaaagagaagaccttttgctcacctcataaatatatatgcactcccatgttgattaccgcattattcacaatagccaagatatgaaaaaacctaaatgtctgtcagtgaatgactggataaagaaactgttggccaggtgtggtagctcatgcctggaatctcagtggtttgagaagccaaggtgggaggatcgtttgaggctagaagtttgagaccaggcaaacaacatagtgataacccatctctacaaaaaaaaaaaaaatgtaattatccaggtatggcggggtgtacttgtagttctagtttcttgggaggctgaggtgggaggatcccctaagtccaggagtttgaatgagctatgatcataccactgcactctagcctgggtgacagagcaagacccagtctttaaaaaaaagacaaataaaattttaaaaagaaacagtggtgtgtatacacacacgcatatacacacaggaatattattcaaccttaaaaaggaagtagatcctgccatttgctacaaaacaaacctagcagatattatgctaagtgaaaaaagacagacacagaaagaaaaacatcacaggctctcacttatacatggaatatttaaaaagaaaagagttcaaatacacagagcacaaaacagtagctaccatggatgggcagggggcgggagaggaaacaaagagatgcagatcaaaggatacaaaataccagatatgtagggtgaacaagttagagataatacacaacatgaggactaaagttaatcaaattgtattatattagacattttagttaaataactaaattttggttgctcttgtcatgaaaaagtaattatgtgagatgagatatgtgaatcggcttcactatactacccatcttactatctctctctctctctctctctctctctctatatatatatatatatatctcataacattatgctgtaaacctcaaatatacataacacatttttttaaatttaggtttgaaacaacattttacaatggaaaatagatgaagcaattaaggacctctaaagaattcagttcagatgttatgcctttaaaatataaattgaattaaattatatcattacttgagaaatgtgtatatttcaatgaacatattatttaaaaactgacctaatttactaataaaagaacaagaggcttttcatctctccttttccaaagaggttttttaaaaaatagttctcagtttcgtgattcagtactataatacagttttacagttttacatttcctgctttatctgttgaagcaagataactcagtagctattgtccaggtagactttcatttcacccagaccacggttttatacaaagtaaattttctaacttcagagaacttaacaaccactcctaatcagaaactctttaggcaatgccaagaaaaatatccaatgaaagaaattctgtttaagtacagtatgaacaactccttactaaatagcttttcccccaactccagtgcataaagtatgttccatacatatctttatatcactatatattttgaaatttaaaactttgatatagtcctaaattcgttgctattttactttccatttgttcaaatgtttcacaacttctgtctgtggtactacaagccccttcaaaagacttaaattgtattaaaatactactttcaatttaaagagcaaaatatctgaaaaattaaggtcacagtgttagagagtctaatggagtatggatttctgcttgaagtacttcaaccagaaacctcagcaatcttaaatctgtctctcctggatataataagttttaaagctttgaatgaattttcagactatgtttcacatctctcataacttcagaagaagatgcagcagagaagcaaagagaacagtctctataataatggaatttttatgcagtaccaataagctacagagcctttaaaacaaaagatgaataggatcatttttaaaggaggaaaaataagcgttagaaggtttctttgtaagaatttgctcataggtacaaagtacttttcaaaagatcaagaaatagtaggttctttgattcaggatgtcataaatgttacagaatcacgattaaatcaactattagttttaaaatataagggttttatttcaatatttctacgataaatgtggctagttccacatgtcattacgaaacctaagtcaattttcagatagggcactgaccaggaaatactgacagacaaaaatcacatggaacatgtacaaatctgaaatagggaaacaacacaaaatacatttcaaaaaaattgcttttaaaatgtttgtcatctaaaacagtggttctcaacggaagtgattttgcctcccgggggatggctggcaatgtctgggaacatctttcgttgtcacaactaggggagtgctactggtatctagagggtaagaaaccaaggatgctgcaaaacatccaaaatgcatatggctgcaccacaagaaagaattacccactccaaaatgtcaatagggccaacgctgagaaatactgacctaaaagaatgccaagcacgtgatcaaatatgcttggatgatgcaaaaatacttgctgaatgaattaatgaattttaataaatgaaaagatttagtttgcactttttttttaagacactctgtcacccaggctggagtgcagtggcacgatctcggctgcaacctctgcctccccaggctcaagagatcctccccacttagtctcctgagtagctgagactacaggtacacaccaccacacccagctaattattgtatttttttgtagaaacggggtttcgccatgttgcccaggctggtcttgaactcctgggctcaagcaatccacacgcctcagcctcccaaagtgctgggactacagacatgagccactgcacccggcctggttttcactttttatagcttcttattatctccatcagtttgatgccgcccaatgcagactctgttttgttctccaaatatgtatctactcattcattagattcccctagggtgacaaatatgaccaaagagatgaaaaatcacatgtccattaaggatcttgccctatgatatggttttccaaggaatctaaaagagggacgcatattcaccatttaattgtcacttaaatcagcaggtgaaaacatttcaaatgtcttcagtgattaagagctcaaaaatatatttttaactatgggaattaaaacattattattttatttggccacatttgttgataaaccaacgtatttcaaatttacaagtcaaaaccaaataagtaaaatttaaatactctttagaaaatactcattgtggttctgtaatttgtaacaacatggatggaactggagattatgatgttaagtgaaataaaccaggcacagaaagacaaacatcacaggttctcatttatctgtggtatctaaaaatcaaaacaactgaactcatagatgtagaaagtagaaggatggctaccagagggtgggaagggttgttggtggtagggggaagatgggactggttaatgggtacattaaaaaaatggaagaatgaataagacctactatttgatagcacaacagggtgactatagtcaataataacttaattgtacattttaaaataactaaaagtataattagattatctgtaatacaaaggataaatacttaaggggatggataccccattctccatgacatattacacattgcatgcatgtatcaaaatatctcatggaccccataaatgtatacctactatgtactcacaaaaattaaaaatataaaagaaaacactcattgtgtgagaaatgcaactagaaaaggttaaaatgcccatgtgattttttaaatagtaattcacaattgccagttcaaaataatactaaatgatttttttccatttttttattatactttaagttctgggatatatgtgcagaatgtgcaggtttgttacataggtatacatgtgccatggtggtttgctgcacccatcaacccgtcaactacattaggtatttctcctaatgctatccctcccatagccccccatcccccgacaggcacgggtgtgtgatgttccccttcctgtgtccatgtgttctcattgttcaactcccacttataagactctggcattcccaatttaatctaatatgaaaactatcccaagtggaaattttatatatatatataaaatatgtatatatatatttataaaattatatatataattatatatatgtaatacatgtatatatattccatatttatccttaactgtcatgtagctacagattgattttattaacaaatacttagaagaataatgattgtttctctaaagaaaattatgagtaaattttattttttctttatagctttttaaatttttcaactgttttactatctacataataattttgtaaggaaagtgaactatatattcaaagaaatagagcctcggataattgacatatactcattgttttctatagaaccatatattattccagggttaaaatttaagaacaatagttaatcataaagatatgaaattcccaaactatttccctttaaagaacctaccatttatgcatgggggaaaacaatataactaaaagagacttatttttaaaatgcttctagccaaaatcataatgttggataaattacaaacactaagtcaattataaatgtttacacattattctgctactgtacttttagttgtccttagagacaaatgtttctatgagaaataaatcactccctcttatatttaaatattgccctgagataatgttattccaataagaaatattctaaaaactgcatcagctaaaaccatgacacggtcctgcttacagtcatagattgaagagcaatccaaaagcttttcaaatgtttattcagagagaagtgaagggcacaacttctgaaagggaaatgatttttaataaaatcttacaaataggaagctgcctaccagaagtgtaagtccaaatgaaccaatgaataaggaaattctttgtgggattattccaacctcatctgaagccacatgcacttggaaaactcaaaacaatcaaaataaatccattacctagacatgctttcaaatctatttctttctactgggaatcaacaaccagtgagggtgttgatttgttcttttcatccttttttacagctaaataagcatgcaaacctttaaaagagaggcaaaaatagaaatgacagcaccatttatgaatctaaaataatctctgtgaatcagtgtcactaaattgggcaaaacgaaatataaatatcccaatcaagtagtatccccttgaaggaaaatacaaatttaagattactaatgttacaaagtatttatatgcataacagtcccctgaatgcgtttgtttaaagattactaagtactctttaagggcaatctagccaccaacaattaacttacaaattagtttaagaaatttatattaagagcctaccatgtgcaagggactgtattaggcacagtgaaagaagcagactcatccttcacaggctttggtctcaagaaacataaaggtctagttaggaaggtaaggtatgcctagaaataacttcaaaacaagaagagagatgaatgaccaatacaatcctgagcaaaaagaacaaagctagaggtatcacacctcctaatttcaaaatacagtcatgtgttgcttaacaatgggaatacatttgagaactgtgtcattgggtaatttatcattgtgcaaacatcatagagtgcgcttacacaaacctagatgggccaacctactacacacacaggctatgtggtatagcctcttgttcctaggctacaaacctgtatagcattttactgtattaaatactgtaggcaattgtaacacgatggtatttgtgtatctaaacatagaaaaggtatagtaaaaacacagataaaatattttttaaatgatacacctgtatagggcgcttaccacgaatgcagcttgcaggacaggaagatactctgggtacaacagtgagtcagtagtgagtgaatgtgaaggcacaggtcattattgcatactactgtacactgtgcaaatacttgtacacttaggctacactaaatttatttttaaaactttttctttcttcaataataaactagcttactgtaactttttattgatatatgataattgcacatatttatggggtacctgtgagattttcatacattcacacaatgtgtaatgatcaaatcagggtaattaggctatccattacctcaaacatttatcatttctttatgctggaaacattccaaattttgtcttctagctattttgaaatataaaataaattactgttaactacagtcaccctactgtgctatcaaacactagaacttattccttctttctaactatatttttgtactcactaaccaacctctcttcatcccccccaccctaccctgctcagctccttggaaccatcagtctactctctacttccatggcattaacttgttcatcccccacatgagtgaaatcatgcaatatttgtctttctgtgcctggcttatttaagataatgacctccagttccacccaagttgctgcaaatgacaggatttcattgtcatttatggctgaataatattccgctgtgtatatttaccacattttctttatccattcatccactgatgggcacttaggttgattccatatcttggctactgtaaatagtgctgcaataaacatgggaatgcaggtatctcttttcttttggatatatatccagcagtgggattgctggatcatacggtagactatttttagttttctgaggaacctccatactgtttccatgatggatgtactaatttaaattcctaccaacagtgcactggcttctccctttctccacatcctcactagcatctgttacttttccttttggagaatagccattttaactggggcaaaatatcacattgttgttttgatttgcatttcccttatgattagcgataagaattttttcatatagagttggccatttgtatgtcttcttttttgttttttgtttgtttctgttgagacggagtttcattcttgttgcccaggctggagtgcaatggtgcaatctcggctcactgaaacctccgcctcccgggttcaagtgattctcctgcctcagcctccctagtagctgggattacaggcatgcgccaccacgcctggctaattttgtatttttcctagagatgaggtttcaccatgttgaccaggctggtctcgaactcctgacctcaggtgatctgcccgtctcagcctcccaaagtgatgggattacaggcgtgagccactgcacctagccctgtatgtcttcttctgagaagttattcaggtcatttgctcatttttaaaatcagattgttcattattttgctattgaattgtttgagttccttatctattctggttatgaattccttgtggatggagagtttgtaaatattttcttccattctgtaggttgttgcttcactctgttgtttcctttgctgtgcaaaagctttttaacttaatgtaatcccatttgtctattttcgcttttgttgcctgtgcttttggggtcttatccaaaaaaatctttgcccagacccacatatacactatggaatactatgcagccataaaaaaggatgagttcatgtcctttgtagggacatagatgaagctggaaaccatcattctgagcaaactatcacaaggacagaaaaccaaacaccgcatgttctcactcataggtgggaactgaacaatgagaacacttggacactggatggggaacatcacacaccggggcctgttgtggggtggagggaggggggagggatagcattaggagatatacctaatgtaaatgacgagttaatggatgcagcacaccaacatggcacgtgtatacatatgtaacaaacctgcacgttgtgcacatgtaccctagaacttaaagtataataaaaaaaaaaaaaatctttgcccagaccaatgtcctcaagtatttccccaatgttttcctctagcagtttcatagtttcaagtcttacatttaaatctttaatgcatttattttgtttttgtatatggtgagagatagggatctagtttcattcttctgcatatggatatacagtttccccagtatcgtgtattaaagaggctgtcctttccacagtgtatgtttctggaggctttgttgaaaataaattggctgtaaatgtatggatttatttctgagttctctattctgttccattggtctatgtgtccatttttatgccagtaccatgctgttctggttattatgactttgtaatatattttgaagtcaaaaagtgtgatgccctcaactgtgttatttttgctcacaattcttttgactattcagagtcttttgtgggtccatacaaattttagaatttttcttctattctgtaaagaatgtcattggtattttgagagggattgcattgaatctgtagatcactttgggcagtatgaacacttcaacaatattaattctcccaatacatgatcatgggacatctttccatttgtttgtgtcctctttgatttctttcttcatattttatcatttgcattataaaaaatggttaaattttttcctaggtgttttattttttggttaaatttatccctaggtgttttatattcttgtagctattgtaaatgggattactttcttaatttctcagattgttcactgttggtgtataaaaatactactgatttttgcatgctggttttgtataaaggatatccaaattggaaaggagaaagccaatttatcctttttcacagatgacatgatcttatatttaggaaaacctaaagactccaccaaaaaactgttagaactgataaacaaattattagctgtggtttggtcatatatggtctttattgatttcaggtattctccttctatactcagtttgttcagagtttttatcatgaagggatgttaaattgtattgaatactttttcagtatctattgaaatgaccatataatttttattcttgattctgttaatcagatgtgtcatatttattaatttacatatgatgaaccatccttgcatccctggtgtaaatcacacttgattgtgctaaatgatcttttcagtgtgttgttgaatttggtttgctagtgtttcgttgaagatttctgcatctatgttcattggggatattggcctgtagttttctgtttttgttttttttttcttttttgttatggctttgcctggttttggtgtgagagtgatgctagccttgtagaacgagtttggagtattccctcctcaattttctgaaatagtttgaatacaaatggtattagctttcctttacacatttgttagaattcagtagtgaagacattgggtcctgagctttgttggggaacttctgattgctgcttcaatctcataactcactattagtctgttcaggtttcctatttcttcatggttcaattctgataggttatgtatataggaatttattcatttcgtctaagtttttcaatttgttggcatatagttgttcatgagattctataatgatcctttgtatttctgtggttatcagttgtaacgttttcatctctgattttatttatttgggtcttctctcttttttcttagtctagccaaaggtttgttgattttcatatttaaaaaaaaccaacttttaaattcattgattttttaagtcagcttatctttacttaaaacaaaagtcagtgtttctgtaacatgctttcaaatagatgtcaaatattaactttgtactttgtatttccataattacaaatctcactctgaacaaatcatggctctcagtgatatatcagcatcttctgcaaaagttttatataactatgtaattaatgaaggaacaaacaattattgtaacagttttgaagaaatattattttatgatagtaataattcttcttacaaaaatacttctgtttgaaactctacataatacacaataaggtcccggaatatgtaattaatagcaatagtttcagggtgatcttttgtaattttttttagtctcaaattcattcatttctgctctgatctttattatttctttccttctactaatatattggccaggctggtctcaaactcctgaccttgtgatccacccgcctcagcctcccaaagtgctaggattacaggcatgagccaccacactcaaccgggattttcttttctattgcactgtccggctgcaaattttctgaactttcatgctttgcttcccttataaaactgaatatctttaacagcacccaagtcacctaagtgctttgctgcttagaaatttcttccaccagataccctaaatcatctctctcaagttcaaagttccacaaatctctagggcaggtgaaaaatgccactggctcttttctaaaacataacaagaggcatctttgctccagttcccaacaagttcctcatttccatctgagaccacctcagcctgggctttgttgtccatatcaccttcagcattttgggcaaagaattttgggcaaaatttctctaggaaattccaaactttcccacatttcctgtcttcttctgagccctccaaactgttgcaacccctgcctattacccggttccaaagtcacttccacattttcaggtatctatggcagcaacacaatctactggtaccaatttacagtgtaagtgttcacactgctggtaaagacatacccaagactggaagaaaaagagatttaatggactcacagctccacatggctagggaggcctcacaatcatgacagaaggcaaggaagggcaagtcatattttacatggatggcagcaggcaaaacgactccctgaaattatttaagtcagttattctgaataattttttttttttggagacagagtcttgttctattacccaggctgatgtgtagtggcacaatcttggctcactgcaacctttgcctcctgggttcaagtgattctcctgcctcggcctcctgagtagctggaactataggtgcctaccaccacaactggctaatttttgtacttttagtagagactgggttttaccatgttggccaagctggtctcaaactcctgacctcaagcaatctgcccacctcagactcccaaagtgctaggattacaggcatgagccaccatgcctggccttattctgaattctttatcagacatttcatagatcttcaatgcttctgggtccactgctagagctttgttagtattttttggtggtattaaatctccctgagttttcacaatccttgtgtctttttgttgatgcctgcacatttaaggagagagctacctctcctagtttttacaggtgttctttcgtggtgttagacctttacttcttcatatcggaacttaaacgctggcttgtcatcgtttcccattctgcgcagaacttgtagggagcatcagaactaaaactttaccccagaactatattgctgtcccgttattgcttcctaatctaggaaaaacataaatgggcaccagaacttaatcccagccttttagttatttctaggtcaggggaaggcttgattcaaatgcctaggctttgtggaaaatgcagctaggtattccagcctttccatgaactgtaccccttgcagcactatggcactggcctgtctcttcaacatggtgtccctgctgattggagagctaaagagccaccaagatctgcacaccagtcactgtgctcagtgcccctgtgtgcccccaattcacccccagatggtacaaccctcctggtgttccccatggttcctatggagtgcatctggagtaggcttctcacaaagattccagaccagtggcaaaaatgaatgtccacctccaattccctcctatcaccctataagccataggtctagaaaaattctctgtgagtggcattatgccagcttggggaaggaagtggcacagactgaaacgaccttttctcttaccagtcatggcttatctcgatcctgtgagtctatggggtttctcagcttctcctccaagttctggtatattcagggtggtattcttgtttttaaacatttctagttgtatttttgtagggagagtgatgccagaggatcttctattctgctgcttggctgacatcaccttgctttctgtaacttttctactttataaactttttacatttttttaactttttgcttctttttaataacacatagcttaaaacacaaatacaggttcagctttacaaaaatattttatctctttatatccttattctataagcttttttctatttttcagttcttttactcatttatttttttactttttaaactttcttgttaaaaactaagacacatacacacacattagtctaggtctacacaggataaggatcatcaatatcactgtcttcctcctccacattttgttcctctggaaggtcttcaggggcaataacaagcacggagctgtcatctcctatgataaaaatgccttcttctggatacctcctgaaggacctgcctgaggctgcttaacagttaactttttttaataagtgaaaagaggagactctaaaataacaaagagtataatatatgctgggtgatggctcatgtctataatcccaacactttgggaggccaaggcagaaggatcgcttgagcccaggagttcaggagctgcctgggccatacagtgagaccttgtctccacataaaaaaaaaaaacttaaattagccaggcatgtggcacacacctgtagtcccagatactcaggaagctgaggcaggaggatcacttgaatccaggagttcaaggctgcagagtaagctatgctgaagccactgtactctagcgtgggtaacagagggagactccgtctccaaaaataaaatatatatatatatatatatatatatatatggtgtatatatatatatatatatatatggtgtgtatatatatatgatatatatgatatatatatcatatatataagtaaatatataaaccagtaacataattgcttattattatctagcattatgtactttacataagtatatgtcccacacttttatacaactggaagtacagtaagtttggttacaatagcatcaccaaaaacacctgagtgatgtgttgccttacaatgttacaacacctacaatgttgctaggcaacaggaattctttagctccattataatcatatgggaccaccactgtatacgtgatccatcactgaccaaaatgttgttatacgctatacgactgtatattttaaggctatcaaaatcaaaacagcatggtactagcataaaaatagacacactgaccaatggaacaggacagaaatcccagaagcccacacattaatagtcaactgatgtttttttttacaaaggtgccaagaacacacaatgggaaatggacaccctctttaataaatggtgctggaaaaaatgaacatccacatgcagaagaatgaaactgcatctttatctcataccatatataaaaatcaactccaaatggattaaagacttaaatataagacccgaaactataaagctactagaagaaaacacagaggttaagctccatgacattagactaggcaatgattttttggatatgaccccaaagacacagacaaaaacagacaagtgggatggcatccacctaaaaagcttctgcagagcaaaggaaacagattaacaaagtgaagggacaactcacagagtaggagaaaatatttacaaaccatatatctgaaaagggattaatatccaaaatatgtaaggaactcaaacaactcaatagcaagaaaacaaataacctgatcaaaaaatgagtgaattggccaggtgtggtggctcacacctgtaatcccagcactttgggagggtgaggcaggtggactacgaggtcaggagatcaagaccatcctggctaacacagtgaaaccccgtctctattaaaaatacaaaaaattagccaagcatggtggcatgcacctgtagtcccagctactggggaggctgaggcaggagaatcgcttgaatccgggaggttgagggtacagtgatcccagatcacgccactgcactccagcctgggcaacagagtgagactccatctcaaaaaaaaaaaaaaaaaaaagagtgaatgacctgaacagacatttctacaaagacatacaaacagccagctagttcatgaaaacaatgttcaatatcactaattatcagataaatgcaaattaaaaatactatgagatgatatcacctcatacctgttagaatggctgttatcaaaaagatgaaagataagtgttagtgaggatgcagagaaagggaatacttgtacactgttagtagggatgtaaattagtacagctattataaaaaacggtatggagattcctcaaaaaaactaaaaacatcactactatatgattcagcaatctcactgctgcgtacatacccaaaggaaccaaaatccatatgtcagaaggagatctgcactgccatgttcactgcaacactactcacaatagccaagatgtggaaacaaccttggtgcccatcaacagatgaatggataaaaaatgtgatatatatacacaatggaatactattcagccttttttagaaggaaatcctgtcatttgcaacaatgtggataagcctgggggacattatgttaactgaaatgagccaagcacagaaagacagaggacctctctctcatagggctgtaggggatcttttttctcttcagccagggttggaggccaagatggcccttgagaatcatcatcatgactgctgagagctgggcagccttgtttacctcccttgggcatttgaaaaaaaaaagacaaataccacaccatcttacttgtatgtagaatctaaaagagtcaaactcatagaagtagagtgtagaatgatgattaccagaggctgaggggaataggagggaaggaatggaaagctgctggtcaaagggtagacaagaggaatgttttgagatctattgcacagcagggtgactatagtcagtaatagcatattgcacgtttaaaaataattaagaaactggctgggcactgtggctcccacctgtaatcctagcacactaggagactgaggtgagtggattgcctgagcccaggagttcaagaccagcctgggcaacatggcaaaacccccatctctactaaaaacacaaaaagtagctgggtgtggtggtgagcgcctgtaatcccagttactcgggaggctgaggtgagagaatcacttgaatctgggaggcagagcttgtggggagctgagattgagccattgcactccagcctgggtgacagagcgagactccatcttaaaataaaataaaaataaaaataacaataataaagaaagtaaattttaattatcttaccacaaaaaaaagtgaggtgatgaatatgttaattagcttgatttaatcactccatgctgtgtgcatgtatcaaaacatcacattctactccataaatgtatacaattatgatgtcaattaaaaataataagttttttaaaaacaagaagggaaaagtacctaaaaaacagtaaaaataaaaatgccataagaagtcagaagaaaaagaagtaacttccagctagggtgatcagagaagacaccaagatcaaatgttaacatctgaaatgggcctggatttgggcagtctaagaaggaggtgaacagattgtaaggcaagagaagcaatgtaagtgaaggtgggcacataagaaagcacccacgatcatccagaagttctgttggccaagagagtacctcagaaataggagtaaagttgaagtagaatattgagactagggccagttggggagggcctgaccataaggctaagaagtctggattttatcgggtaattggggagctggtaaagatttctgagcagaaaaaagcgtcatcaaagttgtgctttagaaagatcaatctagcagtaattgaagtaactgaacatcaatcaaatgcagatgatatagcacagtgagtataatgtaagcctgcaggaattcaggaattcatttataaaaatgtaatttatatgcatcttttcagtaacacagctctataaactgtcttgctcatagactagtacctaattatataagcatctaaaaaggtcataagtactataaaatgatatcacaaaacctcttgcctctgcctggaaatccttccaccccctttcccttccagtaaactccttatcctgtagacttcagtttaaatgtcacttcttcagaaaggctttttttaaatcacttatccaaattgggtccccttgtttttctctttcaaaggaacttgtacactttcttcatagcacttatcacagtttataagtatatattttggtcactaattaattaaagtctatttcccccactagactgtgaggggaaagactgtatttttgctcatcattatattctccagagcctaaaatgatgtaacacatattaggcacctaacaaatatttgttctatgaagaatgaatgaatgaagaagagaagaacagattttagggtcaccatagtaatgcccctctttgctagatgcacttgctattgactaagatactttctttcaaagagaaaattaaaagaaaccttaaaccaggcatggtgtctcatgcctgtaatcccaacactttgggaggccaaagcaggaggatcacttgagcccaggggttcaagaccagcctgggcaacatagtgagacctcatctctataaaaaataaacaaattagctggccatcatggtgcatgcctgtggtcccagctacttgggaggctgaggtaggaggatcactggagcctgggaggtcaaggcggcagtgagccttgattgtgccactgcactccaccgtaggcaacagagggggaccttgtggggaagggaaggggaggggaggggaggggaggggaggggaggagagaagaggagagggaggaggaggagaaaagaaagagggaggcaaggagggagggaggaaagaaggatggaaggaaggaaggaaggaaggaaaaaaggaggggaaaaaggaagtcaggaagtcttaaatttcaacttaaagctgaattcttacgtgccaaaatcagaataaaaacctgtacttacacaaggaaaaccttaaagcaaatactcaagtcaaaatatacattcctatctctcatatttttacagaaataattcctagtgcaactactaagtgaactagaataaggaacggaacctggacacaagaaagcattataagtcagatgtaaagaaggcaattatagacttgtaactcctttattcatgtatatcatgttagaacctcaaaaaggaacttcagcattcaatgaaagatttttacttcaacctatatcatcactggagtagaaaaaaaccctcaaaaaagataactaagctttgaaaaaaaaaaagtaattcacttccaaataataaatacttggttttcaatcacatgctgtttatacctatgtacttacttcatgccacaaacttggtgcaaggctttcttcatataataataaacatggacgattagcaatgtaatgaaccttaagtcacagaagtctagagaagtccaaaggagttcaacatgaggcatttgggaccttatctcaagatgcagcccttcacaaaaatttaacttagaaaaatcactcaattcactaggacacatgaagccctaaccaactgccaacaaggaactagagaagttggtttaaaatcagaaatgttgagctaacttggtacaatggattacctgcaaaaaaaggaaaaataagatttccatcattcatttgtttgcagggagctgtttaactattgcaaatcagatgcactacataaacttaaaatgaaaaggaaaaaagaccagcataaatttgttcaaagagatatagtcagtttcactataaggaaatacctacattcctaaaaatcactacactatgcaaaaatggcacaaacaaggacttacgggggaaatgtagctagggacacaaaactccaaatctttgtcagtgatacacacacacacacacacacacacacacgaaacctaataaaaaatcatagcatttttgtatatgttaaatggttaggaaacataaatatatggcaccttaccttgaaaaaaacctgaagtttacttatagatataggcatttgaaagactgtagtttttgaattaatcaagggtgccagaaagaaggttatctgaaatcagaaggaaaggtgtgacaccagatgcgggtgggtgtggctcataacttgtggtgaactgaggtagctggtagatattccaggtatgtacatgtgtccgttttgtgtgttcctgctgggctcggttcaactatgtgctgtattctgtgttcacctggtgtttcttgctgacaaaaatcatggataacacaaacatgaaattcacttatgctcaaatcgcttcctaatatatcaatggcattgcagcaaattcacgttttcaaaacaagtgttaatatagcacaactggctgtgcgggtattcaaattcaaaaagctaatgccaactggatactgcactcatttcccattcctcaaaatgtcttgagcccaatgaaatcacaagattttgaagaatcacagactctctaatagaaaacagccacaatttctaaatagattggtataattcacatggccaaaccctagaaaatgtagaggtccacttgcctccatgaaactacaacctccttcataaaattgctgcctctaaagcaacaaaacataaatagcactggtaaatacagcatttgatcaaatctagtttttgctcaggaatacaggatcttctcctgtcatcatgagcattatcactaatataccttctcacatatccccaacaccttcagcagccatattatgacaaccaaagcacaaagccaacaaaatggcatagccaagttcacaaaccttagcattttttcctgcccctcatgctagtttctaggttggtggcatgacaatcatgtaataaaaacagtgttcactaacagacttcatttcatctggttttaattaagaaaatataacctctaggagaaatgtctgaaccgctatttttagcatttatcaagtattatctgttccacaagctaagctcagtttagtacgtcatgcaaagtaggagcttcctaaatctttgttgaacaaacattagttgaacctacttgatttgttttactattctaccccataattttattcccagaatattaaattctattttcaaaagcaacatagtcactaccggttaaaatatttttgtttgcttttaattactataaaatcagaaaataattgctgtaataaaaactgaaagagtccagagggtataaaatgaaaataagagtccagagcatctccattctccatctcacagataatcatttccaatggttctgtgtaacattctagaaattttctttgcatatacacagcctaagtataaatcacatatggttgtaaataagctcatactatacctattctcagtaacttaccctttttctaaatattatagcctaaccattttttcattatccatatatatatttacacctcttttgttttaatggctatataatattccaatatatataagcattctaaattatttaacaagtccatatcaatagtcaagtaaattgcttccaaatggtttctattacaaatgatgctatatgcaataaccttttacatatatctttgtatactaagatgaatatatttgtagaatacactcttagcagtagcactgcagagataaatgtgtgagcatttattattttgataaatgtcagactgccctcaagaaaggatatgagagtgcattttaccacattctgtcattagatatttttgaactttttcatctttctcaatttgataaatgaaaaatagcatcttattttaatttctacctccttaattataaatgaggctaagtattttttcaaattttttttctgtaaaatatctgttcatactgattttttctcatctttttcttgttgacttatcagtgatccctaaatattaatgatatcaatcctccttctgtcaaacatattgcaattattctcccccacttgggtatttgttcattgattcttatcatggtgattttgtcatgtaaaagcttttagtttttatgaaatcaaataattaatcttttcttttgtggtcactaggttgagagttatgcttagaaaggccttctctgccccaagattataaaattatctgcccatgtttttgccttaaaataataataaacaattggtaatttttactgaatgcttacttcaggccaggcactgttctaagtacctgacacacattattgtatttaatcttcacaacaaccctagtaggttagtagtatcattacctccaagacacagatgaagattctacagctacttatgagaattaaactcatctgagaatgcatagctgctatgtggcagtgcctagatttcaactgagactagcagattcatcaactacaggctgttatctactgactctctctccacgaagataaatgggagttcaaactcttttacaaacctctacctattctcccttcccctctttatatctgttacataaatcctttattcaacattaattttagagcctttacattttcttctgttttcatacaacgcagttattcagactttacttggtctatttttaaatagattccatatgccctatcaaccccttcctatctctgcttcttcattcccaagttctttttatttatcacttagatgattaattttactcatgaggcatttcttcagggactaggtccttgaatgtttgagaatattggttgttatctttatgcataaataagagcttgaccaggtattaaatctgtgggtcacactattccctgcctacacacattccaccaaaactcagacactgttcaactgcctcctggctttggctattaccatgatgtcagaagccagtctcattttccccctttcggtgacttgcttttcctgtctggatgcttggcgattcttttttttaatcttgaagcacaagtaactttactgttacatacttatttgatattgatcatcctgtttcagttcttttagaattctgtgttctttgaatctgcagattactaatccgtttaatctctggtggtcttttccccatgatatatttgaaattattgtccattcgttctactctctatcaggcacaccaataacacatatgttggatcttctctgcctgtattatctacatatcatacagaattcctagttgaaagcctatggcataagcctaacttgaaatagtttagataaaaagaatttatcagaaagacaatgcagtacctcatataactttaggaaatgtataaagtgtaactgagcctgagggataactggaaccacagacttgaacgccaccaggactgcttatctcaactagggctatttttcttttgtctcttatttctgcttcaatgtgttggcttggctgtcagtatcatagacagaccaatttctcccacaaggcacagaacatggctgccaacagctataaagcctcacatcctatgactgaccaccagagagggattgccttgctttccttaactccaatttctaaaaattctatgttccccttcaatttctttaagtgaatacagatgtatttttcaagaatttgtttactaaaataattcttaatctgaaatgtacttcattctgcatgcttagagtaaagcagttaactagctttggtttgctaatttattagttattcatttatgttcatttgattcagttaactgctacatagctcattgtcatttcttctttcttcctctccacttcactgcaggttagaaatcaaaagatactgtcctcttgtctctctctcctctctctctctctttctttctctctgtctccattttgagatattgcactggcttccttggggattttccaggttttcccatggcgtgtcccaacacgaaaaccttacaggatgggatactcatggccccccactttcagtgaaatctgcactctgtttacagtctaaacagtgtataacagaatttagcatcccctttgatttcatccatatttcattatactcttagattctagtccatagctaggaactgagccatttcctagtttcacagattttttttttgtttgcttttcattctatttgttgattctcaattagtttcatgataaggaatatggttagtatggctttacttttctgaatatcttctgcattcttagaagtaatagttactattacaattctactttggaaaacttaaagttcattcattcatcaaatatgcataggatattaactatctgcaaggcactttgggaggcactgaagatacagcaatgaagaagacagaaatagttcctaccctcttggagcttacattatagtggggaaaacagactattactatttttaaaaatcacaagaatagcagatcaataagtaagtaaaggggtagctgtttaagcagagattagagtccccaagtgttatggattagattattctagctaaagaatctctgagttgcttctcagttcaaggagaggcaaaagtctccttgaagctcactttattttgtgaagagtcacttaagtcgcctcccatagtgacagattgcaaaaatgagtaagtaccctgtatctgggtaagtagggccttccttgggcatacaacctagaaataactatcttttttcttgggatacccataggccttctgggagtgttccttgggattcaaagttagctgttggagtaaacctaacattgccctgaccaaaatcttctggcaagaagggatacaaatggcaccaaaagaatactcactaggcaggagctgtctgggttggtgtcccaagctcaatccagcccaggggatcatgaggaagggtgactctaacccagcctataaccaccatgacacaaaattatgctttgagaaacaatgactaagtgtatgaacgtaagtctgtaggtatatgaatgtaaaatataacttctacatcttgggcaggtcatcataaataatcagtccctttgggctgtgcaggaccattcttcaatagcaacagtctttatcagcaacagctatattgtacttttcggatttcaagttcaccctccacatggtacatgagactaaccctttggaacccccagttcttacataatacacaaagtgaaggaagagtcctcaagagtgagaactgaatttcctggtaataaaaacacctggaaaataatgtcactaacttaataattacaagaggtatgactatattgggatttcccagaaagagtaacacaagcagtgacctgaaggacagcaatcagttggccagggaaagtgaggaatgcattccaaaaagaggagccaggaagaaacctggcagatttgaggaaattaaaagggaccagtatggctgaactgtggggaaaaaaaagagctacattgctgtcagtcaaagatggtgaggtagacaaggagcaatatctatagggcctcataaggtatgttaaagatctgaggctctatcctacaagcatgcaaataaacactttttcaggagcggagtggcataatcagatttttatttgtaaaatatgactttaggggcaggatgtaagagaatcaagagtgtaaagtagcaggcaggccagctggaaagctatctgaagaagatggatgctaacaggtggaagtaagtatatagatttggttgtagggaatttaggaaattcccatcaaatggcttccttctctatgaaatagcaaatagaagagacagatgactttgggcattgatggattaaaaacagagatgaataaatttaatcccaaagccttatggaagaaagcaggcactctggccttacgcaattctgctgagcctgctctgctgagaagagtttgccccttgtgaatctggtgttactttatactgctaggttaagaattctgtattattttgtcaaaataaatcaaagtttcacccaagagataaaaagatatagaaagagaactttccatttgcttgcccttgtatagcatgtgaatgtactcttcctaagtatcaccttcaagcaacttcagaagaaaagactgaaggaacttgggaaatactttttgcagttaaccacagatggaccctggctaaaccacaaaaaagagggccttattaaaagcattcttagctgatggacctttcaccattaacctgtcacttaggtcaaaaaacaaaagataaatgctattccccaggtctagcgccaccatcaacatggaggaaatgatgaaagtcccagattacaggggaaattcaacaaccggtgcctttaggagaagaaagctgacattctgtcctcatcccttcaaaaacatatcctaagcagaaagagatctaggatcaaagctatctttaaaggactaaaaggtctcagaagcactgctgcctgcaggtgtaaaaataaagtgacaaaagtacactgacagaccaaattagtgatccctaaacttccttttaggtttgcccactactcttcctattatgactctagaaagcccttgagagggcatctccgggagtgtcatttatgagaaaccaagccaacagagagaacacctagtaagataattagtggattttagaaaagaggaaaaaaaaataacaaagtagtgaaagtacaggagatggattcgccaccatctaatcagcgctacatggaggatataggtttttcaccatgatttatagtcaaaggttaaaaaacttcacatttttaacaaaaataccaacccccatctccctggaagttgtaactctctgcttttgttgtaattggggtttacccatggggttaatttcccattggatataagcctatggccatctctacattgcaggcagcataaaactggggcaaaaaaagaaataccttctgcatccgataacagagtttcacagccggagtcataagccccgagttcaaatatcagttctgccatttacaagttctacgactgaaggcaagttattgaaactcattcagcctcagtcatcttgtctgtgaaaagggattagaacctacctcacaagattatgataaggagaaaaagagataatgtacataaagctcttagcacagtgcctggcacataaataagtacacagtaagggataggtaccattagaaatcattaactctcaccttcacgttcatttgttcgtctctgctgcctctgaagacttcttaggtcttagatgcaccttgcttacctagaacccaaatatcctgtctgcttctgcctatctctagctacaggactccctcgttcctccaccaacaatcccctgggttaagttattacccatccaaacttacaaactctgccgacccatccctcctgtgtaacttccctccctgtcctggcctgttccgcatgttgccattcatttccagtgtgacaaatctgaagtcaagtcagattgtttcagttagtttgaaggctgcctaaaaggctttatttaacctacagaagccaaaatcattatttacatataaataacatcattggtcaactgattaataactttatactcaggaccatgctagactctccaactatatttaatccttccaagttaagactctagttaattaattatattttatccttccaaaatatgactgcatttacaagcaaagaagttacctcaaaatgcagcttctaaatagaccctcagtttctgcatcttaattcaactccttgttatctccaaaacgtgagagttgagaaataaaagcctctaggctactttttaaacaatcttagacccacattgtcttaaaattatcagaatatctcttagtaaacactcaatattttcactatttcattactctccaggtatattttaagtccttgactaaattaaatgagtcaagaaaaagaatctgaagtactagtaacacaaaattggtctaatgtttaatgtgtggttcatttagaggcaacaactaaagatcagggtcattagcctttcctgtgccagatagcatctcataggatatcttgactaaattctgcaaacagtcaattgaaccaatattgcatcttgtaatagtcatacatgcttttactactataaagatgactttttattatgtttccaattcaaaatctattctgctacccaagtctcttccacagcatacttctttaatttagtaaatgaaattttgcactaagaaagcagcaaatatttatattgccaagtgatagactgacctctagtggaaattttttaaattactgagtgagcttctcaggactttaatacagttataactgtcgaacctatgacattgttaaaataatgtttaaggctgggcgtggcggctcatgcctgtaatcctagcactgtgggagggtttgagacaagcctgggcaacatggtgaaaccccaactctactgaaaatactaaaaaattagctggggtggttgtgtgtgcctgtggtcccagctactcgggaggctgaggtgggaggactgcttgagcccaggaggtagaggttgcagtgatccaagatcgagccattgcattccagcctgggtgacagagtgagaccctgtctcaaaataataataataataacaatgtttaaaacattactaataaaatttacttcttaagtcaattcaagcatagactagggttaacagtagagactctggttcagagctcacctctgccactttctagttatgtaacgtttatctggctccccatctgtaaaatgaaaaagtgaatattacctaccacatggggttatcatgaagatcaaattagtcaaaatatgaaacatatctagaacacagtaaggtacacagttcagtgctataatattattagttattactatttgtggctgcaagaaattatggctggaggcaaataataatttcagagaatataaagaaaaacaaaagagtctttacaggaacacatttctttagggattggctataacaaaccaatatagcaccaatacagctattcctcccatttcccaaaatatatgagctatgcctatataaacagaggaacggggaaaatcagaagcacataactacacctgggtaaccttttgtaggaaatactgggaagtcttttcattgtcccaatatgggcatgatgaataacaccagattctatcctttaaaccaaaaacaaactaacagctccagtccatgtgggtctttccaggctttgaactccttttacatttagcacctagctacacactaaattagtcatcagtctcagattatctgagtcatacaatgtagcacttttctataattaacttattctttgggcttatattacaagattctgaacttttaaaaacaatattcaacggcttctacagcaatatatctgactaatgactaaaaaatgcctccctacaaagttaataatatagtctccacctctttttccaaggaaaatccaaatcagcaattattttcagcttacaggaatgtgcataaaattgaaagatggtctataattccaaggtacttccttagtacaaaataattgccatccagagaaaaatagcttgtttttatcataaaacaatatgatcactaaataaaatacagttcttagttccttccatcacagtcctgaagtacccaaattcattttagtaattcacattttctattctgggaacactccaagttgcaattcagttattcaatgtaaacatgaactcattaaaatggcataaaagttcctccaaagtattattcataacatttacatgtatttactacaagagactaaaaagaactgatttatgtaactgggatcataaatcgtggataatgaattatatatgtaaaaccacaactcaaaaacaattacaaaaatgaataccacagtatggtcagacaacttctagaaagcatcagacatattgtaacataattcgctctgctattaaaagtcatcaataagtgtggtgctattaaagcatgtatttcaagataacagcaaaaattagacgtttgaagttttttgaaagcttgagtttatctggaaatataaaagcaagaaagctatttattatagtatttgatacttcactaagtacagttccataaaactgtggccctgaacatttccctaataactgtctaggaaatataatgcagcagaaggaagattgattctgatactacagagaaaaagtcttattcccttacatatcctttgtagacagaccttaatggattatgtgctatattaccttcttatttttcttgtactaaagcaacatttatattattaagattggaacagtaacaattcagttccaccaaagacactaaagatgacaaggaaactatgtacctaggcaaagacctaaggaaaagtatgtatagtataaatttcctttttaggagttataagacatagacattcaaatagaataaagcccagtgctcccaaggaatattatctggagaaggtccccaaaatgacttcttaaaaacatcacaaggcatgaatttaccaaggtttattctatgattctcaatctggctgcacagtttatagaaattggcaaagtgatactagcatgcatcagtaaaggcaaaggtcccagaaaagccagaacaatcttgaaaaataacaaaattggaagactcacactaccttgttttaagactcactatcaagccacagtaatcaagacactttggtattggtataagaatagacaaatcaatgaaaacagaagtcaactgatttttgacaaggctggcaaagcaattcaacaacacaagaaaagtcttcaacaaatggtgctgaaacagctgtatatccataagggaaaaaagaaactgaacttcaactcctatctcacaccacccacagacattaacttgaaatagatcatacacacaaatgcaaaagctaaaactaaaaacttctagaagaaaacacagaatgtttttatgactttcaggtaagttaaagatttcttagaaagaacacagaaaacattagccataagagaaaaactgataaattagacttcatcaaaatgtaagacttctactcctcaaaagacaccattaagaaaatcaataggtggccaggaatggtggctcacactggtaaccccagcactttgggaggccaaggcaggcagatcacttgagcccaggaattcaagactaccctaggcaacatggcaaaaccccatctctacaaaaaatacaaaaattagccaggcatggtggcacactcctgtggtctcagctactcgggaggctgagatgggagaatcacttgagcccaaggctacagtgagccgtaattgtgccactgcactccagcctgggcaacagagtgagaccctgtctcaaaaaaataaataaatagataaataaaagaaaacgaataggcaagccacggactgggagaaaatattcacaatacatatatctaaaaaaaacttgtatccaaaattagaattcctacaactcaaaaataaaaagacaacctgttttcaaaaaaataggcaaaagaacagatactttataaaggatatatgagtgttcaattaatagataaaattttcaaaaaattattaatcattagataaatgtaagttaaaaccacaatgagacatccctacacatcgtccagaaagattaaagtttaaaagactgacaaaaccaaatattagggaaggatgtaaggttcttgcaacaagaaccctcatttgttgatggcgggaatgtaaaatgataaaaccactttggaaaacagcttttctataaggtaaacatgtaatctatcctatgaatgaataactccaatcttaggtaatcaccaaagaaaaataaatacatatgtctacaaaaagccttatccaaatatataacagctttgtttgtagtagtcaaaaactagaaacaacccaaatgaatgtccaacaacatgtgaatggataaatcgatggtggtatacccacacaatgcaacaccactcagcaataaaaatgagtaagttatgggtgcacacacgtagtactgtatgattccatttacatagaaaatgcaaactaatctacagtgacagaaaagcattcagaggttacctgagaatgcagaggagggccgagagaggcaggatggagacattaaaacggacataagggaattttgggggggtgatggatatgttcactatcttcattgtctggcagtttcatggatgtgcacatatataaaaatcaaattgtacactttaagcataggtagtttattgcatggcaattacatctcagtaaaagctgttacacacacacacagacacagaggacagttctgcttctgatcaagatagagtaacgggggacagatctcacccttctgccataaactgctagaaaactggacaaaatacatgatacaatggtttttggaccatcacacaagacacagcactgtaatacctgggagagggaaagcaaacatgatgagttccatgattgcaccagtttaacacatagaagcagtttccagaatgcagcaaattccccaaaagcccagcagtttagcttagttgagggtaagagctgcacaaaagacagcttccgaaatctgcaggagcatgcacatgagtctcggctaagagctgatacaagcatatgtgaggccaaaactacctaagttggaaaaaccttgaaaacagcacgctaactagaataagccagatacaaaagaacaaacattgtatgattccacttatatgaaatatctagaataagcaaattcatagagatggaaagtaaattcaagtttactagggataggcgaggggagaataaggagttactagtaaagtttaagagtttctgtttggggtgataaaaatgttttggaaatagtgatgatggttataacaaattgtgaatgtaattactgtcacttaattatacacttaaaaatggttaaaatggggccaggcatggtggctcacgcctgtaatcccaacactttgggaggctgaggcgggtggatcacgaggtcaggagatcgagaccatcctggctaacacggtgaaaccttgtttctactaaaaatacaaaaaattagccaggcgtggtggcgggtgcctgtagtcccagctactcagcaggctgaggcaggagaatggtgtgaacccgggaggcggagcttgcagtgacccaagatcgcgccactgcactccagcctgggcgacagagcgagacccagtctcaaaaaaaaaaaaaggttaaaatgtcaattttatatgtattttaccacaataaaaaaaaaattttaaaaaaatttaaattaaaattaaattttaattttaaaaaatttaaattaaaattaaattttaattttaaaaaatttaaattaaaattaaattttaattttaaaaaatttaaattaaaattaaattttaattttaaaaaataaattaattaattaattaattttaaaattaaaaattaattttaaaaaaactatccaaggctcgtgttgggggtgggagaggaaggaaaacagccttgcaagaaaaagacagaacaacgcccagatctcatacaggatttgggaacaattcctattcctgccagacagagaggaaagatatcttaatacacagggcagcaagtagaattttcagaagggtttcatcttgacaacagagataaattatccctagactaaagactgctccagacctgccctacttaagcttaaaagcaagtctcaaaaggcttcatctgatttcaagcaacttaactgcatgccagaacaaagcgaacactatttaaagaagtcacctaaatccataatgtcttgcaaccagttaaaagttaatgggcatataaaatctgcgaaaatatgccccagaaatgatacaactagcagacaagaatcatataaatatgttctacatgtctaacagggtagagaaatacataaacatgatgagaaaaatgaaagattttttatttattttattttatttttttagaaatagggtctcactgcgttccccaggctggtctcgaactcctggcctcaagcaatcctccaacctcagcctctgaagtcactgtgattacaggcgtgagtcaccatgcctggtgcctgaaagatatattttaaatgacccaaatggaacctctacagatgaaaaatacaatacctaaaatgaaaaatgcaatagatagaattaacagcagatcagatactgccgaagaaaaaaatcagtaaaggcatagtaataggaactatccaaaataaaagattaaaaaaatgctcaaggaaaaaatgaacagagcctcaatgacctgtgagagagtattaagcattcttaatactttttttttctgctttccaaaagcagaaaaaagaggtgaagtatttctaaacatgacaaaaactaccaacctacagatccaagaagttcaacaaacaccaaagctcattcaaaacaaaacagataaaaaggaaaaattgttaagctggacttcatcaaaatttaaaactttttctctgcaaaagatcctgttaattattaaaaagacaattacaggctgagaaaaatgactgcaaatcacatatctgacaaagaatttgtatctaaaacatacaaagaatgtctaaaactcaaccttaaaaaattcatttagaagatgggcaaaatacatgaatagacttttcacagaagaagatacacaatggcaaataagcccatgaaaagatgaccaacatcattaggctttggggaaatgtgaattaatatcgcaatgaagtatcatcaatcagaaaggctaaaataaaaaatagtagcaataccaaatgctggtgatgatatggagaaaacagatcactcctacactgttggtgggcatgtacaatagtacagccactctggaaattagcttggcagtttattttaaaactaaaattgacttattacatgacccagtcgttgtactcttgggcatttatcccaaagaaatgataacttatgttcacacagaaacttgtacacaaacgttcatagcagctttatcagtaaccgtcaaaaactggaaactattcaaatgtccttcagcaggtgaatggttaaacaaactgtagcacatccatactaaggactattacttagcaataaaaaggaatatgcaacagactttgatgaacctcaagggaattatgctgagtgaaaaaagccaatctcaaaaggttacatactgtatgattccatttatataacattcttgaaataacaaaattatagaaatgaatctgtttccaggggttacagataggagaggggtaggtatgagtataaaggaaggagtagacaagggagactcagggtgatgatgcagttctgtatcttgattacagtgatggttacacaaagttcgtggttacacaagacctgccttgaagttgcccatggaccccaacaccacatgctggagtgttgccagtccctcagtggcccctctccctccctccctatccccactcaccccagaggaagtggacacttagagatggagctaatatgagcttcaggcataaaattgcatacaactatatacacgcatacacaaatgagtaaatatacaactgtagaggtctgaataagctttgtggactgtgtcaaccttgattcctagtatgatactatactacagttatgcaagatattaatattgagggaggatggttgaagcgtgctcagagtctccctgtgtatttatttgaaacattttgtaaatctgtaattatttcaaattaaaagttaaaagaaagaaaaaagataatcagaatagccataaatactttttctttttaaaataactataaatagtaaagaaattaaattcttagttaaaacttttcaaccaagaaaactctagacccatatagccttgctagtgaattctatcaaacatttaaagaagaaataataccaattctatacaaattcatccagaaaataaaaaaggaacatttcccaataacattaccatgttaccaaaaccaaacaaagacactgcaagtacatataactacagaccaatatccttcatgaacctagaagcaaaaattcttaagaaaatgttagcaaactaaatcctctaatatataaaaggataatgaggctaggcatggtggctcatgcctgtaatcccaacactttggggtgccaggccaggagaattgcctgaagccaggagttcaagaccagcctgagcaacataatgaggccccatctctacaaaaaaaggaaaaaaaaaaaatagccaagtctggtggcatgcacctgtagtcccagctacaaaggaggctgaggcaggaggatcacttgagcccaggagtttgaagctacactgaactataattgcgcaactgcactccagtctggcaagggagcaagaccctgtctcaaaaaaagggggaagggaaaggataatgaaattgctttaattttttgtgaaaatgacaagtgttggtgaggatgtggaaaaactggaaccctcatacattgctgctgggaatttaaaatggtgtagctgctgtgaaaaacagtttggtggcttcgcaaagagctaaacataaaattaccacatgaccagcaattctactcctaggtatacatgcaaaggaactgaaagcagggcctcaaacagatacctgtacagcaacagtcactcactgcagcattatttacaatagccaatagacacaaacaacccaagtgtccatcaacagatgaacagataaacaaactgtggtatacggacacaagggactattatccagccacaaaagggaacaagctctgatacaacatggatgaaccatgaaaacactatgctcaatgaaataagtcagacacaaaatgacaaatattgtataattctatttatatgaaatagctaaaataggcaaattcgtggagacagacagtagattagaggttatcaggggctgggggaagagagaagaatggggtgcttaatgctatagagtttctgtttggggtgttgaaaatttttggaagtagtggataaccagctaatgccactgaattgtatacttaaaatggctgcaatggcaaattttatttcatatatatgtatatatcaccacaataaaaaagaggataacagatcacgaccaagtagggttcatcctaaaaatgtatggttgggttaacgtttgaaaatcaatctaacttaccatagtaacagactaaaaaagaaaaactatatgatcatctcaatagatgcaggctgagaagactgggagagactaaatcatggagtaccttacaagtcttaacaagcttatactgtattctaaagactacagattcctcaccaagggatattaagagggagatattaagaagactaactcaatctagttagcgaatcaacaaccgacatttgtaaatggtagagaaaatgtttacaggatgctgtgccagagggcagcaaacagaaactgggcatctgagatggggaaaatgaagagagacttctaaaaagaggactgaatggggagttgaaaacaaacagcagaactttcctaatcctcatgactctctcaccaccgccactgcacccatgtctgggaaatgcgttattagtgatcatactttgcatggacaagaaagaacagttcaggttccaaggtgacctccctcattcaaaacacgaattacaaccaacattcaagtcagtgtgttcttaggcctttaagacttcatttccttttggaactttccaaactatttgatgttcatgaaaccatctaatgtaataagaagaaataaataaacctgaaatctattttcagattgtagataaaatttttataatgtattactatctatctggctataaatatatgccacaaatttcatcacttcaaatgcttaatgtgtgaatataacagatattaactttctcatactgaataataatagctaacatttattaaataccttttttgtgccagtaactggcttaagtactttgggaatattgtctcacttaattcttgtaacaactccataagataagttctactactattcccactttacagatcatgaaacaagacacagagaggttcggtaatttgcacaaggccacacagctaataaatgacagagacaggcttcaaaaccagaaatctgctaacatgccaaactcctaacaacaatgctataaaatgaagcaagtgacagatgttccagagtttcatcaattcacaaaagactactggatgactttaaaaaaccttgaataagacatgaaagaattgctctacttccccgggatttaatgttccatacaataaataaattatatgctataagtgatcctcctgtcttagcctcccaacgtgctgggactacaggcatgagtcaccatgtcctgccaggaagattcatttagaagaaaatttgggaggataggagccctgaaatgtgtctagtaaatagttagcagagggtactatggtatctaacatgatacaactatcaaaatatggcagtatcactcttttacattcaattatgtctcaaacacaatacaaataagctaaaaagctatatttctggataaaagattttaaaatcttcaataatcatagtgactttagactgtactccagagttcattaactatggattctaagaaacaaaaaatagcagaaggaaaaatcaaagatatttcaagaattcattaataaatcagaatattaggagaacaaacaaaactaagtcttaactcaaatttcaaaagcctagatgatttttcatacactttgcttattatttagtatttatgctacatgctataagcagaataatcttagatatgttttttgattctgccatgtcaccttccttgagcttgtttatctgggtatataaatatattatttttctttactatacatattctttttaaaaactctagaatcactcctggacatagtaattacttactcagtaacaggaaaaatgcaaagtactgtgtaatattaacatttattttcatattcaccttatattctaccaatgcagaagctatgaaggtgtaagtatacatgccatttatactctatcctatcttactgctctgcagttctttatacacaagcttactttggctctcttcaatttatacataaatatttaaaacctccttttgcccattttctggatatactcaatggtaacagagccattgtaagcatttttatatggtaactttcctgagcaagaatcataccataaccctaataaaggtcaaatgcaacagtgcctctccagggaagttcttccatgcagcagtgagtcattttttctttaggaatgaaagtttcactctggtgagtaaatgtctgctcatatgcagacatctctcactacaagtcagtcaactatgccataatcttctcttttctcattttgaaatctaccaacccatacatatatatacgattacagtgcctgatatggagctctgctaataggaaagcacttacttatttatgatttatcacacatttgtactgggaagaaaaaccttctgtattagtgaatttcaccatgccgacagtaatctcctagtttcttgtttaacacatacagtgaatttacacatgtacaaaataacataaattaaaagttactttttacagcatcacttgtaatagcaaaatactggaaaacattcaaatacccttcaatagggaactatttaagtaagttgtggtacatccattcagtggaatactatgcagcaatttaaaaaatgaagagggttttcttcaactgcaacaatatctaagatatttttaggcaaaaaatcaaggtgcaacatagcaactacagtatactaccacttgtataaaataagggtaacattttatttatatataatatactatatgtataccacatatgtacatttttgtacgtgtaattcacacacacacacacatctctgaaagcatactcaattgttacttggctccagggaaattaaatgggtatcaaggccacagagacaacaggaagactattttactatatactcttcttttttaaaattatataccaagtccaactattatctatctaaaaactaattaaactttaaaagaatatatagggtaataattatatgcagaggctctattggataagaaaatctgggtttaagtccccattcttccattaaccagtggtgtgtaaccttaggcaagttctccaagccccagtttcctcatctgtaaaatggaagtaatgatagttactgtgagaatgaaaaacaatcaggtatataaaacaattatcagagtacctggcaattattattatttagtgttatcttttaaatggtactgcagacttggaaatcaccaagttatagtcatcaccaattcctttttcttttttcttattctgaatgaaaaaattttgctagttcttttaaaatgtgtggcattcaatcatttctgtccattttatagccactagagattggcccagaccctgaagaatcagttagagtagggattttgtgagcaattaggaaccatcatacatttggtataggttttttattaaatctaaacctttcagtggagcccttattgccactatatataggcatatctacagagtctctaccacactaaataccaaatgaaatgccaccaatttatacttgtatccctattttaacaattataaggtactttcaaatactttagttcaattcctagaataagaatctcagaaatggaagatcctttaaaatacaatgcaatttttttcaacaatgatgagggaatcagagcatatatttttatctctcttgtagatgaatatttttaatttaagagcaacctgttaaatatgaatttaaattatattaaataatgaaataaataaatgaaatgaaagccaaagaagagaagcgacttgccaaagactcacatgctttacaagagaaaaaaaaggctgcctagcattcacatgttctcattttactgctcatttcgttcacattcttacaaggaagtcatcaagtatgctactttccctcacctaaaaggctcttacttatacaacctaaaaccccgtttacatctaataatctgatttttaaaatgggcaaaagatttgaatagacacttctcaaaagaagacatacaaatggcaaacgggtatataaaaaggtgttcaacatcactgatcatcagagaaatgtaaatcaaactacaatgagacatcatctcatcccagtttaaacggcttttatccaaaagacaggcaataacaaatgctagaggagatgtggagaaaagggaaccttcatacactgtttttgggatgtaaattagtacaaccactatggagaacagtttggaggttcctcagaaaactgaaaacagagctaccatatgatccagcaatcccactgtggggtatatacacaaaagaaaggaaatcagtatatggaagaaatatttgcaatcccatgtttgctgcagtactattcacaatagccaagatttgggggcaacctaagtgtccatcaatagataaatggataaagaaaatgtggtacatatacacaatggagtactattcagccataaaaaagaatgagatccagtcatttgcaacaacatggatggaactggaggtcattatgttaaacgaaatgagccaggcacagaaagaaaaacatcaaatgttctcactattcgtgggatctaaaaatcaaaacaattaaattgatttttagatggttttagaaaggatggttactagaggctgggaaggagaatggagggagggggaagggggagggggatggttaatgggtacaaagaaatagaacaaatgaataagacctagtatttgatagcacaacaggatgactatagtcaaataatttaattgtacatttttaaataacttaaagagtataaatggattatttgtaacacaaaggataaatgtttaagggcacagataccccattttccatgatgtgattactatgcattgcttgcctatatcaaagtatctcatgtatcctataaatatacatacctaccatgtacccacagaaattaaaaactgcaaattgtaaaaaaagaaaacgttgttcacagaacctatcttggatctggtagccataagtctctcccctctgaattccagctactaccatagcaaacaacttagcacttcatcgtgggttatctgtcatcttcatggtggtattgtctccccaggtgtaagcaatctggaagcaagttggtctggtaaaaaaaagacattataatcaccaccatctaccctatctccccctcagcctattatccctgacatttccctccacttggaagctcagacttctcagccaagcaaaggtatctgcctcttcattcatccctccctctaaattcctcctgggatgccttttccttccttcccatcaactcacattcctcaccttgagccaaaccttaacccaatccccctcacacagaaagccttaactcagcccattttcttagaaaccgatatacacagtgttgtacaattttcctattcacatctcataatatttctgtatatatgtttggaaatgtatatttctgcatatgagataacttatcagcctgggcaacatagtgagacccccatatatataaaaaaaatagccaggcatggtggtgcatgcctgtggtcctagctactcaggaggctgaagcaggaggatcacttgagtctggaaggtcgaggctaagcctgagtgagagagtcaccagggaattcttccagcatgatgactttcggtttcacaataccaaatcaaagaacctgcactgagctaagactcatcccagaaaagacttaggaaaagacaccaaacacttagagggagtcttctaagtgtttggaagaaaatctgtcctgaaagagaactctctgtccatgaaggatgggtccatttcaaagagaagatacgtaacttcccctatgtgattaatttattggcaggataacttgcatcagtttaaaggcatttcatccacaatgagcaaaagctaaatgcactaaatcttctttcacggaacgtgtattttttgaactcttagcggtttgcatttaatgctttattttaaaatcagatttaatcatttcatataactagtacttcttcaggaagatggatttcattttacctctacatctattaccccaggtcagaactgcaatgaattgtaatgccatttgaaaccactaatacagcactcaacaatccagttattaagtgagtctgaaaacacaattttccaaaatgactatagtgctcccacttcctattcttaaatatctaagacactaattgaatgtccatactattttatttataggtctttctcaaatactctcacaataaaaccaccaattttaattcctacttccataaaagctctttgttggctctattttgaagacttaacagagctgtatttttaaaaaaatcaatttgataaacaaaaaaacattttcttatgatactcagagatctctacagcatatagcttgatattttttaacaacaggaactaaggacaaaactaaaaagtgtaattctcaattatacaaaacaaataggtattgtattagtctgttttcatacggctataaagaactgcccaagactgggtaatttataaaggaaaggggtttaattgactcacagttcagcatggcttgggaggcctcaggaaacttacaatcatggcagaaggcaaaggggaagcagacactttcttcacaaggcagcaggaagaggggaagagccacttatgaaaccatcagatctcatgagaattcactcagtctcacgagaacagcatcagggaaactgtcaccatgattcaattacctccacctggtctctcccttgatacgtggggattatggggattatgggaattacaattcaatatgagatttgggtggggacacaaagcctaatcatatcaagtatgtatgtgtataagtatatatgtacatggtatatatcctcttaattatcttttaaaattttcatccatatcacagccttctgggctatggtatgttcagaaacataaaaccaatgagataagtcaccaaagcaaaccctacagtggagaagtggccacaacatagcatcagtagtggagaagcaaccacagaatctagaaattacaaagaatatctgaggacatctggcacagcatgaaatttctttcatagaagatctgatggatactgacatggacattgtttaaagttttccaatgactgggaacccattccttaatttcctcaagaagcttatttcattggacaccaccagaatgtttttcctcataatgagccaaaattatctccttataaaacttcttacaggtcatacgtaattatgtcattcttacagatacgtctagtccttctttaacaggtttctgcctttcagatatgaagaaaatgatcatgtgtccccttggtcatacctcctagaggttgtcttttctacaaccccaacacactcacctgtccttcatatcatttaaaggtcttcactatcccagtcccttcaccttctgggtgaaatccaatttgccaatatttctactaaaaaaaaatggcatctagtactaaaagtaaaattccacaaattattgataacattactcatgagaaagcagatatgtaggaaaggatcaaactcaagaaccctctgcttcatagggagcaagtcttgacatgtactatggaaatgactagatgaacagaaaatataaatcaatgctatcaaagacaatgataagaaagatacggggagggtggtaaaaaatagtgtcatcaagttattcattctgaaagaagttaacccccctatatgctagtccacagcctaaattatctgaaataatgataatgtgggtgtaatatgaccaaaactttctaaatttacaataagcatagttatatagagaataatcatatcctctgaaataagttacttttaatctcatctaaagaatcaaataaaataaaaaacactagatgtaattaagactgtttagtttccctggagattacagcaatcagacattttaagtattctaagaatgaaacatttgagacaattaaggaaatcctattgaaaaaaattagtctgtaaaacagagataatatgggactaaggaatggcttattaataacattcaattctgagtataacgaatacagctattacaatttcaattcactagtggctgagctcaaaaagctaaaatgctgccactcaatctgcctcaaggatccagatctaatcagtacagtcactgcctgttacatttattgaatcgcagaatgattttaggctgaaaggaatttagatgaaaaaaaaaaaaaaaaagaaagaaaacaaagctagtaaatggtagggccagaacctaagaccaaaatctgggactttgctatacttggaacaactctccaaatacttgcaaatagctatcataccctcccttcccacctctaaccaatcttctttcaaggccgggtccttcaatgattcataatgtagggaggattccagaacaaagtcctacataagtgacctctggaacttcatacatattccttcatgtctgaagtgccagcctggactgtgtcttgagagaatgaatactgttaactggatacattaaggatggctgctcaacaagactagaactcctgagctgctgggccactcctcaactttcagttattaataacacaaataaggcagggcaagagaggcctgagagacacagccttggagcaagccaatcagtgagagactatgggcaatgatcagagcaagactatgataatgccaacgtcagcaacaccagaggataaacctctggtttaggcgccttcctccttatgcctggcccttctccaacagctctctctctactaggtctcagccatccaataggaaaggtcttttctgttaccaagtgccagggcaaacaggagatagaccctttcagacaaagcatacagccacagagggagctctccatgaagtgaaaggtcataaccctaaggtaaacaggcagttaatctagacaggatgctatatgaagacaatgaggaaggcaaaatcccaaaatagcagattcttagagaaaatgctacagacaaaagacaaagaaaatgatttttttttttttttttgagatggagtatcactgtcccccaggctggagtgcagtggtgcgatctcagctgactgcaacccccgcctcctgggttcaagtaattctcctgcctcagcctcccaaagagctgggattacacgcatgcaccaccaagctctgccaatttttgtatttttattagggacgaggtttcaccatgttggccaggctggtctcaaactcctgacttcaggtgatccacctgccgtggccttccaaaatgctgggattacaggtgtgagccactgcacccagcattttttttttttttttttttgagacggagtctcactctgtcacccaggctggagtgcagtggcgcaatctcggctcactacaacctctgcctcccaggttcaagcaattctcctgcctcaacctcctgagtagctgggactacaggcgcccactactacacccggctaatttttgtatttttagtagagatgcagtttccccatgttggccaggctggtctcgaactcctgacttcaggtgatccacccgcctcagcctcccaaagtgctgggattacaggcatgagccaccgcgcccagccaaaaatgatttttttaagctagcgttagaagaagagcaagtccaagacagatgttaattaactacaaattgtgtttctgtcttatccaacaaaatggacctcaggcagggcttggtggctcacgcctgtattccaagcactttgggaggctgaggcaggcagattgcttgagcccaggagttcaagaccagcctcagcaacatggcaaaaaccctgtctctacaaaaaatacaaaaattaaaaattagcaccaggtgcagtggctcacacctgtaatcccagcactttgggaggccaaggcgggcagatcacttgaggtcaggagttcgagaccagcctgaccaacatggtaaaacctcgtcctactaaaaatacaaaattagccaggtgtggtggcacacacctatcatcccagctacttgggaggctgagacaggagaatcgcttgaacctgggaggtggagtttgcagtgaaccaagattgcgccactgtactccagcctgggcaacaagagcaaaactccatctcaaaaaacaaaaaatttagccaggtgtggcagtgcatgcttgtgctcccagctactcaggaggctgagatgggaggatggcttgagcccaggtggcaaaggctacagtgagccaagatcgtgccactccactctagcctggtcaagagagccagatcctatctcggaaaaaaaaaaaaaaaaaaacacctgacttcaaatcccaacccaacctggcataacagggtctctgtaaaatggcatgctagcctgtccagtcattgtctgccattattcttctagatctcaacttcctctaagacttacatgcttttccacctctaggcctttgagtctgctgctccttctgcctcagcttcctcttcccttttgctcatccctccctgacttcccccaagcagacacagaagtgctctcctccatctcccttcacaccaaccaatgtgtctgttatagcacctgcctcaggggattataatttattggcttgggctggacacagtggctcacacctgtaatcccagcactttgggaggccaagatgggtggatcacttgaggtcaggagtttcagaccagcctggccaacatggtgaaaccccgtctgtactaaaactacaaaaattagctgggcatgttggcaggcacttgtaatcccagtaactcgggaggctgaggcagcagaatcacttgaatccgggaggtggaggttgcagtgagccaagatcacaccactgcactccagcctgggtgacagagcaagactctgtctaaaaaaaaaaaaaaaaaaaaaaaaaaaattattagcttgtttccctccacaacagattatgagctcgacatggagtgtatctttttatctttgtatcccaaaaacctagcatagtatctggctcataatttagtaagtgaatgactcaaattagggaagtgaggatgagtgcagtggcaactgcatgccaggctgtgtgtcatgtgtatctggcatctctccctcagtgatttgtgacagacagaatggtgtctgatgcacagtaggtgatcaacaaaaacaataaattaagcgaacaaacatgaaaagagctataacagattcagcaaagtattatttatgacatcaagtatgaagctcccttcaaactctaagactctatggagtttttttaattgcatttatacaaatttattagaaaatttgaaaacatttttcaatgggatgggaaactagtatttattgaagggctacatatttgttaggcactttacctatgatatttgcttttcagaattctgggaaattgtaattataagccccattttatagaaaaaggaaccaaagctagaaatgcaggaccaaaatttgaacccaggtgagcctgagctcaccaatcctaagcttttccacactgcacgcttgaacctctggaaagaacacgaggcacacctccctatcattccactccaagaaaaggagttctgaacaagccacggctcaactggatcacaattccagagggaggagttttcaatggaaggtaaaaaaaaaaaaaaaaaaagatgaaaagttctttcttcccttgaagatcatcatcttttctttgtggaaaggttcacatggcccttcctgtttctcccatgaggctgtagggaaaatcttaaggcctcttcttgggaaagggcaatccttcctttgctcttccctttccccaaggggtcaagcgggaatcaggttacaatcctgaaaaaaagatggcaaaggggcacccatatgggtctacttagaggccttaagtgagattagacagggaagcagccttgaagcttacatcctcaacaggccaattatcttagttcaggctgctctaacagaataccatagactgggtggcttaaacaacaaacatttatttctcacagttctggaggctgagaagtccaagaccaggacaccagcagatctgatgcttggtgggggtactcttcctagtttgcagatggccatcttcctgctctgtcctctcatggtagagaacagagagcactctcatctttccattcccttataaggtcactaacagcattcatgagggctccaccctcatgacctaattatctttcaaatggcccaaaataccagcacactggggatttagacctcaacatatgaattctgaggggacacaaacattcaatccatagcactaatgcaccaaattatatccctagatggaaatttggagccaaagtcctgttagcaatatggaatgttcctttgcctggaatgtcctctgtgtaggatggtggcatgtaactggagtgacaaggaatcagccaaattttgtctccccaaaacatgcctgacgagttgactttaacaagtgaaatgaagtgtacaacaaacagtcaggacaactgaatagctacacataaaagaatgaatctggacatctacttcaaatcataaacaaaacttaactcaaaatggatccaaaatctaaatataagagctaaaattacagaacttttagaagaaaacatagtggtaaatctttatgaccttgtattaggcaataatgtattttagatatggcacctaaaccaaataaaaaatatattgaacttcataaaattaaaaatttttgtgcttcaaggaacactaccaaggaggtaaaaagacaatctacaaaatggaagaaaatatttgcaaatcaaatatctgagaatagtctaatatccggactacataaagaactcttacaactgaacaagaaaaagacaacccaaattaaaaacagacaaaatatttgaataggtatttctccaaagaagatatacaaattgcatatcttcatattaacacatgaaaagatcctaacaccattagttatcaggaaaatgtaaatcaaaaccataatgagataccacttcacacatactaggatggctatactcaaaaagacagtaacaagttctagtgaagctatggagaaatgagaatgctcatacattgccgttgggaatgcaaaatggtacagccactttggaaaacaatttgacagttcctcaaaaagttaaacacagagttaccatacgatcagcaattccactcctagagaacccagaagaactgataatatatgttcacacaaaaacttgtacatgaatattcatagcagcattattcaaaataccaaaaaaaaagaaaataacccaaatggtcatcaactgatgaatggatacacaaaatgtaccatacaatggaattctatttggtcataaaaaggaataaagtactgatacatactacaacagaaatgaactttgaaaacatcatgctaagggaaagaagtcagatgcaaaaggccacatattgtataattccatttatataaaatttccataacaggcaaatctacagataaagactgatgtttgccaggggctcagggaaagggagaacaaggcatgactgctattggatgtgaggattcttcctgagggtgataaaaatgttctggaattaaatagtagttatgattgctagtgtcactactatttaactagtgtgcactttaaaagggtgaattttatggtatgtaaattatatctcaataaaaaaagtgaggtgcaactataaaaaggagccaagtttacatattatatgtaccatcaaagagatatgacagaaaagcaataaagaagttaacttgaaaatcactgctggatattggtgtttacttttataataacaaatatgaaaaatattgaattttattgccataaactgaaaaccaaaataaagaagattgagagaaaaattaattggatttccatgaaaaatatccaaggataaatatttgctttcttcccaatatttcagctgtttggaagctgagctccttagagcaaagataagagcctcgatgttagatttgctagcagcaaacaaacttgaaagaattcaagtctaagaacctgagcctcagatgcactgcctttggtaaatggtaaatggattttctcccagtgagctctgtggtagacaagcattccaccatgataatgacaaagtaacagagtagaactttcaataaccaacatctcaaccttggagactgcattaacattttacgtaaggcttttttatgagtctctgaattaatatgtgtgagtccaaatggccagtttttccaaataatcatcagctcatgttaagaatactgaatcacaagcaaactttttacacatacactataaaagtaaacatataatacaatattctagaactgtgcctggcatatgatcagcaccccataaatatttattgaatgaatgtttataatagtcaatattgtttactaaataactttatcaaaaataaggataatagtattcctaagtgaacttatctttatcaatagaaaattgttttttcttaatttatttctaatgtaaaccacatccttactgaacttcactgacaagtcaatggttaagaaagataattagtccatatatgtagaaaggacattctaattattaaaattactgcccctcaccttgtaaactttttaaaataaaacaacttcaagtcaataaaactgtgggatttgtgaggttagtaatttcttatgcacttacaatttattttagttaataaactaagaaaatatatattaaagcttaaaaataagatgcccattcttcacattctagagctctaagataaatccaaacaaaacacagttagcctcactcatatatactggagttcagcaggaaaggaaattctttctgaatcgcatcttaaggcataccaatttaacaatgccaaaaaagtcagcaattaattttatattgcattttccattttgtaagtctctttttaaaaacagggaagttatttctcagtatttaacaactataggtgtttgaagtactacatagtatcatcagatgaataaaagtagaaaatagctccagagaacacatcttctctttcagaaggatacttcttctgtaagtctctaaggataagcttctacaacgtgtgacagataagtcaatggttgaaacagccatcagttcaaacaactgtcagagacagccttcctaaatctcccttacagcagtataagctcttttctgctccttgattcaaggacacatgaagaagacacgagtacccacctttgtatcatcctcttttagattttttattggacatcacactactcagctttcttgtacttattttctttacctcttgatttgctaatattacaaaataacatttttaaagaaaatgcagataggtagctggtctcttcatgggaaggactttctaagcgtaaaagcaatggatcataaaggaaaagattaacaagcagacaacataaaattgttttaatttctataaatcataagccatcataaatgaaagggcaattgtggggaagatgccccaaatgacgaagggttaatactctcactataacaagagttcacatggttcactgtatggccaagacagtgcccccagcattccctcatcctccatacaggaaaccgcaatgtctctgcaaaaaaagaggttgcagcttctctcctccagctttgaaaattacctttgtagggacatggatgaaactggaaaccatcattctccgcaaactatcgcaaggacaaaaaaccaaacactgcatattctcactcataggtgggaattgaagaatgagaacacatggacacaggaagggaaacatcacacaccagggactgttgtggggtgggggggagtggggagggatagcattaggagatatacctaatgctaaatgacgagttaatgggtgcagcacaccaacatggcacatgtatacatatggaactaacctgcatgttgtgcacatgtaccctaaaacttaaagtataataataataaaattaaaaaaaaaattactctgcctttccttgtctgtcttggtctttgcctcctacctggatgctctctttcttccaagccctgtttgactcaaagttcagaaaaacaagcaatcagcccagtcttgattccagtttttgccccaggaaacagactatgaaacagttttctgccttgccctgtagcctgcagggaagtaacaactcgccccaggctccagggataacttattcaactaattccagccaaagcccagcatagtggttcctgcctgggctggggaagataaaaatcaaacaattaaacaactggtaagaaaaaactaagactccaatacaaaaaccatcaaaaagcttttgctaatagctaacaataagatttcacttaaaacatattaataatgacagatgtgagttaaaataaggaggtgccatttttatctgtgaaattagcaaagtttttaaaataataatgctaatatgggtgtcataaaactgacggtggcaatgtaaattggcataatctttctgaaaaacagtatggcaatgtttcgatgttttgagagcattcacaatgttcctgccctttgacctccctataatttcatttttgggaactgtttttttatttttttttgagacagggtctcactccattgcccaggctggaatgcagtggcaagttcactgcagcctcgaactctcaaaaatatcttggtctggatggtcatgtacatggtcacccaactttttggccacattaagagttttgtctttattctaagaataatgagaagccatgatggattttgagctagaggaggttggggggtagcataatcaaattttagttgtgaaaatactactcctgctgcagggcaaagaatggatgggaatattgaaaggaaaggataaatacctttagattagttaagaggctactactggacaacagatcatggtagattggtctagggtaatagtagcagagacagagatactcaaatggatttgagatttggtttgaagataaaatgaatagaacttgatgattgtttggatatggaaaggaagaaagtgcgaggtgtcaaggatgaggccaagatttctgatttgcaaactagaggttggtatgacccattgagatagcaacagagatttacacgagctaaaaatttaaatgcgcgatatatctgcatatccatcactgtctaaaggcacgggcctggagaacaaggaaagagtttgggttcaaaacttgttgatgttcctttccattcacagagccctctttcaaggcaggactatcctattttctggttggatattggagtcatttggtggtcaggcaaaaaagaaggtccttcttagctggtgatatgggacggggagcaccagaccactcttagcatgcaaatatcccttactaacgctcaagtgcttttcacatgtactgttcacaaaacagcttcacatataggttcactgaaacccacgaccttgtgagaaattataatctacatttaggaagctgagggagagttcttaaattacctgtccacagagccagtacggggctgctttatgtcatcctttcacctcctatgtgcagcctctaggtgcaagagactatcttaagggcaacaggaaacctaccatataatggggtcccactaggtaccaggctctagcagtttaaaaaaaagaaacacaacttcagaacttctaaggatgtttcccacacacttaccccacagtaagttcgcttctaaactttcaaaaagtttcacgtcccaagatggggtgaaggtgagacggtggagatgaaccggggcagacagagaccaccccaaataccggacccgggggaaatggggtaccaacggctgggccccaggagacactcggaggggtccgcgggctcggcccggtccctccgctggggggttaccagccggccggcagcgagatacccagaggcccgtttttccaccgcgttgccatagcaacggcctggccggctgcgccccgggccgcccgccccatcccgcgggcccgccctgagccagtgactccagggaccactcaccgcggccggcggactggcgggtctccgacaggtgcgcacactcggcgcaggctgtcgctgagcccggaattctgcaccgggagaaacttttcagcccgcagagcaaccgcagggcagtggacgggggccgcgcgaggacaaacagcggcggcgggtgcaaagccccttctccaagccgcggggttggccgggaggtgccggctgcacaacggcgcccacgtgacccaggtgcagccccaggcgcgcccaagggcagctcgccttagagaaggacctaaaaccccgtctggggcacagaggagcagccacgtgttacgtaaaataaagctttgtagcaggaatatcacagtactgaggtgattgatgctcaggccactcttctcactcggagtcaagcccatcaagccccagccagttggagcaagggctgcaagccttgaactgcagtgagtggggagctggcctaaaaagacgggaaaatgctggggggagggtgtttgtccccacgcaggggctgagaagactcctgacagatcaaatgacgattctcagggatatgttttagctacaaacctatgagaaccatctgaatgcctgccccatgcaacagagggtccagctgtatgctaatgtatttactggcctgaactaagaatggcttctgtggtcctgggtcctactctctagcagtgtggggaagaaattcaactctcctaatactagcctaattatttgaggcagatgttctctaaaattagctgattgatagccagtaacttgatacggcaggtggattcattgtattgcttcgggggaggctacatttggcaactagttcatccagtccttttcatcaaaaaactcaaaatggtcataatgggtgactggtaacttcaaacttcaaaccactggactaggccgggcgcagtggctcacaccgataatctcagcactttgggaggccaaggcaggaggattgctagaacccagaagttcaagaccagcctgggtaacactgggaggcccccatctctacaaaattaaaaactacctggccaccaaagggctgcaagaaacctaccatataatgacgtcctactaggtaccaggctctaggagattaaaaaagatctcctaggataatctcccgcatcttaaggtccttaatcacatctgtaaagtgccctttgcatataaggtaacatattcacaggttccagcctgggcgacatagccagccctgcctctaaaaacaaaagcaaccactggactgcgttttgccctggattaaaccagaccaccaaaaaactgtatgtttgtaccattttgtcttcaccgttggcaacattgcatgaaccaagtcatgtttagcactatgccatttgcttatattaagagatgctgtttaaaaaaattcatgatacctctgcatttactagagggattactttaagaatgttgtttattacatctttgtagcagaatcctaccagcttgtccagcgcagagcttttcaaacttttttgagcacaatccatcaaaataaatatgttttacattatcactcaatacacaggtactcatatatttagtaaatgaaacaagttttataaaacattacccacatcacatgctatgcaccctgatacttttaatctctttttaaggctagtttctacccactaatggtttcttgaccttcaatgcaagttgcatttcaaaaacagcagtataaccagatgtctttttctggaaactagacctggatcctcagacaaggtaaccaggccacctgactacagttgattgctccaatagtagggacctgactcaagataaggcaatcatatccctctcccaggaatttggaattaggacagagagattgcaatctttctctaggaagctaatgtggaaacacagaacatctttaaaatagaaaatcagaagccttcaacagacatactttcccaccatgtggccaaaagcaatgtagaaagccaggctgcagggaaaatgggaaaagaagaggaaggctgaaaaagatatacagaaagaagagaccaaaagagttctgacggctttccattcctagtcatggtattttctgaaatgaattgtattcctgcctttgaattccatatagtatttccaactctttggagttgggaggaggggcctaccacactaatataatcacctatatgccccgtataggagggtcaatgcaagaaatatatttcaatcctgagtgccagaaaagaacactttttccctagagaaactgacatgactttttttaataaagaaagcagaccatgagattgatcacatttccctttcaccttgacttcaggaagatagcacccaaatttgcaactcaattttaataactttgtcaaactacagtttgcatatctgcatcacaactttctcctgttctctttcatttcccctcattcctacttttatctttttgttgtactgactattattttaaactgcttcaaatattttgcacttgctgtttcctctttctgtaaggctctgcccctgtatctcctaaagcctggttccttctcatcattcagatctcagctcacttgccacctcctcagagaagccttccttgatcttcctacctaaaatagccccaccccacagtctatcacatcaccctgctttgttgtctcagagcacttaacaccatctaaaacaagctctttattttccctgtttcctcaccagaagctaagctccaagacagcagggacctggcctctttgtttattgcttgttcctagtgcctgggaacagtgcctggaacttagtagctagttagtaaacattatggagttaataaataaaagaattaatagaagaaaggaggggagggagggaggcagagaggggaggggagggttgaaggaaagagattttgttgaacatggtaagatatagatggataggtaaataggtggatagatagactgacaaatagacaaatattcatttccagtgtgcaaatgtcactaatatttatagagaggaaccagaggaactatacaagaaagtaaaatatactcgattccctaaaatatatacagaaagatcctaggtttccttgggtaactcttgacataatgccttagaccattttttttaagcattcaagtcgctcaaggcagctacattaaatattagggctagtaaccatagctgaagtcatcaattctcagtgagataatggattgcaacaccatgaccactaacatgacaaattcttaacactgccaaggaactcagtctattctaggggccgttactatacaacaatctgctctcattctatccctgtaattattaatgtcaccactagcaacaagtgctatatgttatttacttaaacactctatggtaacgttattgttacaatgcaatatcaaactgcttgacatttaaggaagagaagccagaattgaaatttgtcaataaaacaaaacacagaagcaattagtacagtttgtcccaggatttgctgaccctattgtaaaaataccagaatttgtggggtgagtggaggatttcagttttcttaagtcaagaagcagtggatttatacatgtaataaggttatctctgctattcaaaaaattttaagagactctatataacaaaaaaaaccctataattttttcattccataaaacaaattaagagatgcttagcttattatgtgttatattaagatttcccccttccttccttccttccttcctttctctctctctctctctttctttcttctttttctttcttttctttgaggggtctcactctgtcacccaggctagagtgcaatggcacaatctcagctcactacagcctcaacctcctgggctcaagtaatcctcctacctcagcctcccgagtagctgggaccacagtcatgcaccaccacacctggctaatttttgtatttgctatagagacagggtttcttcacgttgcccaggcttgtcttgaatgcctgatctcatgcaatccacccacctctgcctcccaaagtgctgggattacaggcgtgagccaccatgtctggcaagatttcttaaatgggaacatatctttgaaaagtatataatacaaagtgtaactttttcctaatgagatctttctctgattactgataggctctaccaatttatatgtctttccatttgttctcttcccctactttgacaaaataaaactataccttatccataacagctcaaaaatgaaataaacatttggcaattaacttggtgtgtctcatcaattttggatatctggactagctttcttgtcagataataattagagttcaagttagtgcatgccaaacattcatggattggaagacttatattgttaagacagcagtgctccccaaactgatccacaagttcattacaatccttatcaaaatgtcagtggtcttttttgcagaaattgacaatctgatcttaaaatgtataaagaaatgaaagggacccagaacaggcaaaacaatcttaaaaacagaaacaaagttggaagattcacacttcctgatttcaaaacttactacagagctaaagtcatcaagactagatcattcagcactgtaagacagggcaagaaaaaaaaaaaactgggtcataccagtataagaatagacataaagatcaatgaagtagaattcagattccagaaataaacccacttacctatggtcaattggcaaagataccaagacaattcaatgagggaaagaatagtcttctcaataaacggtgctgggaaaactggatatccacatgcaaagaaataaatttagactgtacctcacatcaaatatagaagttaactcaaagtgagtcaaagacctgaatataagagctaaaactataaaactgttagaagaaacataagtataaattttcatgaccttggattaggcaacggtttcttagatacagaacctaaagcaaaagcaaccaaaagaaaaaacagatacattgaacttcatcaaaattaaaattttcatgtttcaaagaacactatcaagagagttagaagacgatccacagaaaaggagaaaatatttgcaagtcatatatctgataatggtctagtatctaaattatatttttttaaaatactcctacagcttagcagtaaaaaagacaacccaatgttaaaatgggcaaaggatctgaatagacatttttccaaagaagatttaccaatggatggccaataagcacatgaaaagatgctcaacaacattaatcatcagagaaatgcaaatcaaaccataatgagataccagctggcatactgatatgtgctagcccagctacttgggaggctgagacagaaggatcgatcaagcccaggagttggagtccagcctggacaacatagcaagactcccatctctaaaaatataaataaataaaattaaaaccataatgagatatcacatcgcacccactaggagggctataataaaaaatctggacaataacaagtgttggtgagaatgtgcagaaattggaaccttcatacattgctgatgggaatgtaaaacagtacagctgctttggaaaacactctggcagttcattaaatgattaaacatagagttattatatgaccgctcctgggtatgtgaccaaaagaataaaaaacatatgtccacacaaaaacttatacatgaatgttcacagcagcattattcataataatcaaaaagaggaaatgacccaatgtccaacaaataatgaataaaataagcaaagacagtatatccatacaatggaatgttatttggccataaaaaaaatgaagtactgacacatactacaatatggatgcccctgataacattatgctaaatgaaagaagccagatgcaaagagccatatacggtatgattccatttatatgcagtgtccacaacaggcaaatttatacatataaaaaataaattagcagttgccaggacagggaaaatggggaaaactgctaacagttacgtagtttctttttggggtgatgaaaatattctaaaattagaccgtgttgatggctgtgcaccttgtgaatattctagaagccactgaatcgtgctctttaaaaaggtaaattctggtcaggtgcaatggctcacacctgtaatcccagagctttgggagatcaaggtgggaggattgcttgaggccaggagtttccgaccagcctgggcaacatagcaagactccatctctacaaaaaaaattttacattagctgatgcacatgcagatcatggtgtgcatctgtaggcccagctacctgagaggctgaggtgggaggatcatttgagctcaggagtttgaggctgcagtgagctatgatggcgccactgcactccagcctgagcaacagagcaagatcctgtctctctaaaaaaaaaaaaaaaaggtgaagtgtatatctcaatttaaaaagtaaaaacaactaaataatgcttcatattttacagattctaaaaccactttttttttcactttttaacttcttagaaattgggctgcctctcactgattacatattactattgctgttagccaggtagcagtcctgatattgtggcataaaaaccttttgttggcaccttcctgaagaaccaagaaattacctacatttatgtgccttcgttttaataaaatacaggtactactaacccacctaataatatcaccaattccatgccaggcactgtcccaaatgctttatgtattttaatttaattctcacaataactccgtgaggtgggtactgatgaagaaacagaagtacagtctacaggattgacttgtccaagaccacatggctagtatgtgtgagtcccatccgggctgtctggtccaggggctgcgctcctgaccattggcatcactgcctcccttacctgtaacatgctgtgagtgcaagtcagccttaaacagcctttaaggttcccggagcaaagtgggccaagagagtaactaaagctaatagtcttgcgacggtttcatgataaaaacactattcacttggaagtttgattcatatgtcgaaacattgtttggctatgtctaaggaatttcacggtggagaacttcgtttactgagcacagataaaagggagtaatctttttctgctttgcttacacatgagtaaagggagctggagccttagtctagaccctcatcatttttccaccagttgacagcagagactacctccctgtcctgtgagaagagctgagtgaggggcaagcccagccaggctcaagcatgggaatagatggacgaagtcccttttactcacatgtgaaggatatagacacagagggaaagccaccagaagtcatcccaggaaagaatgcagggccacatctggggcaaacgttctaccgccctgtcactgacatccaatgttgataatttaatgcaaagtagatcacaggaagattggaaggactcctgaagtttcgtggtgtctggcatgcccaggctcatgagagaagatggattgtgccacctccaagaaactgtaagcagagggaaaagatagtgaagcccttcctgtccccataccgccaaggctcttaacacacccagtcctgctgagtcccctcagataccaggtgcctgttcagaatggtcggggaaacccagctggagcctgactgcttccagtggcctcagttccttgagggcagagtgggggtgaagtctggactcagaggcctccactgcctctgcacatcctcttatgaaaccttcagtggcattttccagccatagacaatagtggctcctcccctccagcttaggcctctaagccaaacacaatcctatcagaagagaaatgatggaagcaaaggagacagcggaagacacactctaacgaggcaggacgctggctctgaattgtgtaacagaaaggggtgggcagaggagctacctgggatcactattgtttaattcttttattcttcttaaatttttgtttggaaataacttcaaacttttatagaaaagttatgaaaattaaaatagtttttaaaatgcccatatatcctttgttttttgttttattttgagatggagtctcactgtcgcccaggctggagtgcagtggtgcgatctcggctcactgcaacctccgcctcccgggttcacgccattttcctgcctcagcctgggactacaggcgcccgccactatgcccagccaattttttgtatttttagtagagacgggggatcaccatgatggccaggctggtctcaaactcctgacttcgtgattcacccgcctcggcctcccaaagtgctgggattacaggtgtgagccaccatgcccagcctgtttttttgtttttttaaatagagacagaatcttgctctgtctttcaggctggagtacagtggcatgatcatggctcactgcagcctcaacctcctgggttcaagcatggagtcctgttttgttgcccatgctggtctcaaactcctgggctagagtgagcctcctaccttggcctcccaaagctgtggaattaaaagtgtgagccacccaggtgggagctaaacatgtgtacacatggacatatactgagtgaaataatagatattagggaatacaaaaggtgggagggggtgagggttgaaaaacctattgggtacaatgttcactattcaggtgatggatacaccaaagcccagacttcagcaccacacaataaatgcatgtaagaaacctgcacttgagtcccctcaatatatttgaataaataatttaactttaaaagaaaaaaatgtgagccaccgtgtctgcccccatatgtccttcacccagattcacctattaagattttacatcagccaggcacggtggctcacgcctgtaatcccagcactttgggaggccgaggtgggcagatcacaaggtgaagagatcgagaccatcctggccaacatggtgaaaccccgtctttgctaaaaattagctgggtgtggtggtgcacacctgtagtcccagctactcaggaggctgaggcaggagaatcacttgaacctaggaggcagaggttgcagtgagccaagatcgcgccactgcactccagcctggccacagagcgagactccatctcaaaaaaaaaaaaaagattttacaccatttgctttattaatagcactctctctatatatgtgtgtgtgtgtgtatgcatgtttaattaaaaaaagatatacatctacagctttgttctgtaccatttgtgggtgagttacatacactaaggaccttgacttctaaatactccagtgcatattttctaaaaacgagaatattcaattatataaccacagttcagttatcaactttagtacatttaacattgatacaataatctcatctactctccatatccccattttgtcagttgacccaagaatgtcctttctattacattttcctcactccactacaggacccaatatagggtcaggaattgcatttagctgtcatgtctctttagcctccttgaacctggacattttcctagcttttctttgtctttaacgacagggacatttttaaagaatccagtcccctatcccctgcctttacttaatataacgtctttcattgtgggtttgcctgatgtttctctgtaatgagattcaggttctgcatccttggcagcaatactgtatcatgggtgacatcatgtccttctcacagcattacatctgggtgcacagtatgtccacctgccccttattggtgatgttattttgagcacatgatcaagatgttatgtgatttctccactgtataatactccaattgctgtatattttttcctccctcacaacttttcctgcacaacaatgagcagtcagtggagagacaatttaggactatgcaaatatcctgctcctcatcaaaatttccccctagggttagcccttaacaagttttctgacgatccctggggctaaatgagtgccccggcgccacctatggggcttgcagcacactgcaacaccgggaatgaacctcggacctctctcactctgccacttgtctggagtccaggaactacttcagccctagacattttgaaagatcctatagagacctgagttgcaagcctgagttctagtccagacaccgccaatgactcatgaggaatcttggacaagtcttcttaagacttatgttcctagtgaaatgtagggttggctgacagagatctgagttatacattcaagtaatacttattgagcaactacaggcactgttccaggatccaagcaagacttctgctctcagggaagcttacaccctctgtgactcagacagtgagcaagaacacaagacgaagaaaaagataaacatacctcatagtaagtgccatgatgacgatgaaacagggctgtgagagagtgcctgggtccacttcagattgtgtggttaggaaaagctctctgaggaggggtgcgagctaagatctaaagggtgattggagccaaccctgaccttgagaagttttggaggtagagccttccaagcagagggaagagtcaaggatgactaggggtttggtacttcttccatatctatggctctttgggggtgtgggggcagggtcaggagactcccaggtgtccctgaagcagagcaagagacggataagagagaggtgtgttctccagaataacagggagaaattctagaggtgttgacaaatgaagtggcttttaaaagatgagtaaagattttgaaaggtagattatagaacagagaaagacattccacgtaggaaaggggaagaatgggaggcacacaggagtcattggctatggcaattctgaaatccaagtgggcaaatattttgagggcctcctagtctggtcgggaattattcattattttctgattcaggtccctggaagtagctcccttgcctgttgttctccttatcccttgcttctgccctcaaagaggttcttcacattttagtgtccctgctgatgtggggcttgaggcataaacctctttgggggctgagcagccttctcaactcttaggtgtgttaagagcctgagcattctctaccatagattattgaaagcccaagagccatttaatgtcttcaacagttattgttttctgttagtctaggctcatcattcccctggcaataaaacactctaaaaacctcattatgggccgggcacagtggctcacacctgtaatcccagcactttgggaggccaaggcaggcggatcacctgaggtcaggagtttgagaccagcctggccaacatggtgaaaacccatctctactaaaaatagaaaaattagccgggcatggtggcaggcgcctgtaatctcagctactcaggaggatgaggcaggagaatcgcttgcgcccaggaggcagaggctgcagtgaactgacagcttgccactgcactccagcctgggcgacagatcaagactccgtctcaaaacaaacaaacacacctcaaaacaaacaaacacacctcattatgtgtctatctattggaatgcaggcagcatcactggctgaaagctatacctgcaattatttttgagaactacagtagttccaccttatccacgggggatatgtgccaagatcttcagtggatgcctgaaatcatggatggttctgaacccaacatactgtatactgttgtttcctatacaaacatacctatgatgaagtttaatacacaaattaggcacagccagaaattaacagtaactaataataaaatagaaaaaaacataacttgtatactgtaacacaagttatgtgaatgtgatctctctctcaaaaatcttactgtactgtgctcacccttcttcttatgatctgttgacctaataaccaagaaggctactagggactaagggtgggtagtatatatagtggatacaccagacaaaagtgatgattcatgtccctggcaggacagggtgggatagagtggggtggtaagagatctcatcacactactcagaatagtgtgcaatttaaacctcatgaattatttctggaattttctatttaatattttcagattgccattgaccagaggcaactgaaatcacagaaagcaaagccaaggataaggggagttcacatgcccatgccttgctctctctctctctctctctctctgtctgtctctctctctgtctctctctatccctctcctcctcctccctccgcacaggctttggtggaaaagccacatccttagaattttttcactgaatcttatccagctaaaagattttactgggcactatattcttaatttgatattttccctgaagtaccttaatccattcaaaggttttaacaatgaatattatgcccatatttttaatatgatccttacctcaaggctgaattttaatgggccttcaattctaaattttatcttagtcttcagcgtcaagaagcaattacctcttcaaaaccctaagtccttggatttttgtatactatgtattttctttcactccttaaaaacagggcaattcttttctgaactcatgtctttcttgaaatagcttgataaacagaatatcaaccaatgtaggctaccaatgttgttttccaatatcttcccctctattgaaattcattaagtacatgatgtgactccaaagttatctcagactatagttttgccaaatgtttttccactgcataacctgaatcactatccttctagtcaccaatgtcggtttccttgctacctgcttgctaggccagtgccttggatcttagtgttttgttattgatttttttttctccagagaaacccaagcttctttgtactataggccagcctatgctgcagtaataaataacacacaattctcactgacttacaacaaaagtcctcattcatgcaaaatttgctgcagatatggaaaatattgcaaagcttatattatccatgtattagcacagcacaccagactggttcagacttaagcatcttcatatcagtgcatgctctcagaatcacctcagtaagggaagagagaaaataaacagagaatcaagcactggctcttattcaacctagcaatgacctacatcactgccactctcattggccaattcaagtctcataaacacacctgaaataagtaagtggcgtgcagtagtgcaatcttcccatgcactcaggagaggagcactagaatcattggaaggtaacatttacgtcttcccttctgctgttggtaggatcttctctgtcttgggtgttctgaagtttcactgcaatacgtttcaagtttctttttatttttcaagtgtattttgttcaacatcttatagctatgaattcatgtcattcatcacttctggacagttctcagccattatctcttcaaatgttctcaatgtctcatgatgtttttagtgtgtttaaaccaagacgcaagtaagttctatatagtgcaattggtttatatgctttttaagactctttaaggtttcccctccatctcccttttttccctttgtaatgtaaaccaagttgtttgttccatcggtccttggagactggattttgctgactggatccttgtgaagtcatttaaggtgttcctctattctctgcatttcctgtcaattgggaattaatctttaaattggtagatgtagagacttgtttaggttcagattctatttgtttacaaacaaatgcacacaatgtctgatcgtctcttttttggtgatgtgagcagccacagatggtcattgcctagattcattcattgagggctaaaaaatgatattctaaatctatcagtccttcttcaattactgtggaaaactttttaaaaagaaacttccctcatcaattatttggttaccagagattcagtttatgtaggagaaagaggacgaatcctttattaagctaattaataaaatttactttttatgttttcattgagacagggtctctctctgtcacccaggatgtatagtacagtggcacaatcatggctccctgcagcctcaacctcttaggctcaaacgatcctcccacctcagactcccaaagtgctaagattacaggtgtgagccaccatgcctagccctaattaataaatttcaaaagtcacagaggcactgccttggcagaatctttaccataaagcaacattgtcagtgggccacaccacaaatgggaaccactggaacaaatgaggagtcctagatacaaacaactgcttcctccagcatcaggccttagcccttaggctggggcaagaccgaggctgtggtgttcctgtttacaagcatgaaggagatacttattttctccacgaatgtggagcttggcctccgcaggtcttacatctctgacatagctggaaatcaagggtacatcaatttccaaaaaagcttaggaatatcgtcccagcccagtgagcaaataaagcactgtttttggaatactggttataatatagttagttgctgtaaaaaacaaaactaaaagaaacaaaaaacaccccagactgggtgcccacacctataatcacagcactttgggaagccaaggcaggaggatcgcttaagcccaggagttcatggctgcagtgagtcatgatcatgccactgcactccagcctgggtgacagagcaagagcttgtcaaaaaaaaaaagggaaaacagatactggctacaactgcagagctgtctctaaggattggttacaccctctcatttctcaaagcatattctgtgcaaggccttcaggagtgatgtctataggacaaggggtccccctctccaacctgggcataactccagggcccatggataagagtgcttcccagagaacaggcattcttattctaggaagccctacataaaacatgaagctgcacctacagtctgtggtaaatatagcttttattgcaaatttttgaaattgttttttataattttgctttttaaattatttggctaggagtaattcatttaatttacattgggctcaggtttcttggcaattatcttgtgtatatagaatttcttatgaagcgtgaaactctaacttacaaattgttttcaggtataacagaatttttatgaaactttatgaaattgttataaaattaacaattataggtttaacatgatatatagacgtttaataagacatttatgtataatttgccatttttcattttatattgtttcaggactttttttttcttcttgagatggagttttgctcatgttccccaggctggagtgcaatggcgcaatctcagctcatgcaacctccacctcccgggttcaagcgattctcctgcctcagccttccgagtagctgggattacaggcatgcaccaccaggtgcggctaattttgtatttttagtagagacggggtttctccatgttggccaggctggtcttgaactcccgacctcaggtgttctgcccgcctcagcccctcaaagtgctgggattacaggcgttagccactgcacatggccaggagtttttttttttttttttttttgagacagggtctcactctgttacccaggctggagtacagtggcacgatcatggctcacttcagcctcaacccccaggctcaaagtgatcctcccacttcagcctcctgaatagctgggtctacaggtgtgtgctaccacacctggctaattttttttttaagagacagggtcttgctatgttgcccaggctggtcttgaactcctaggctcaaacaatcttcccaccttggcctcccaaagtgccagggttataggtgtgagccacagtgcctggccaggacttatttttataggcctttgaaagatcctagaccctggatactatgcctctactctctagtggataaaataatccataggccaggtggggaggaagaggaggtcaaatactgccctacctatgagagcaagacttgctccagggagctggcctgactagcagcttgccatggaacccaaggagtcgggggagtagaagggctgtgtccctagaacctagagaaggactagtactaataaaattagtaaggcaagtcagtgtggtggtacatgcctgtatctcagctacccaggaggctgaggcaggaagatcacagagtaagcagggaaacggttcacgtacttgggccagtctggagaggggtgagaggtcagagaaaatttttcaggtctcatcttaagcattaaaactgatgattatccttccttgaaacacaaactcccttggcttctctgataccacatccctctagttttcttcccacgtcctggctgctgagatggagaatatgagaggaagaatctgttaagggggtggctagtgtgtcaggtaacactgagacttccaaggggaggtgtccaatagaccacaggatcggtgagtctggagctcagaagagtgggtccatgacttttatcaccaaacatcagttagagtgttgagttgcaagtaccagaaaccatttctggctgatgtaagcaaaaaaaatgaatttattataaggttttttacgtggttcacagaattgtcaggaaggctagagaattatactcagagctgtgcagccaggaacaattcctgaaatcatgtgcaaaactggtctgctgaagaaactggcaatgacatcgagccccacgtgcttcaccttgtaccgctgctgctgctactgctgccatggaaaccccacctgcctgcaaccaacactgtcaccggaaaggaggctctgggcttttttttttttttttccataaatcactaccactaggcctgtaacctgacttcaacggatgccaggaaatcaagattctagtatatttagcttctgtagggaggaatgagctgtgtctcccaagactcctgaggtgggaaattcaccaaaaataggaaaggggttcagactttatgcagcctaattgaacgacaaatattcgtaacaatgtccttgaccccccccaaaaaaaaaaaaaatggctagaaaccactagcatggaggaagcagagaggacagcgagggataggtaaccatccttataaagaactatataaagaacattcttgaagtgtttagcacttggaagtgttaggcattcatatgatgccttttccctaactccaccacagacttgttgcctgtgttttgagaaacaggctgtgttaacacagtaagaagccgagacatgctggcatgtccccgtagtctcagctactcaggaggctgaggtgggagtagcactggagcccaggagtttgacaccagcctgggcaacgcagcaagaccttgtctctgaagaaaactaaaaataataaaaataagaagcaggctgggcgtggtggctcacgcctgtaattccagcactttgggaggctgaggcgggcagatcacaaggtcaagagattgagaccatcctggccaacatggtgaaactccacctctactaaaaatacaaaaaattagctgggcgtggtggtgcgcacctgtagtcccagctacttgggagcctgaggcaggaggatcgcttgaacctggaaggcggaggttgcagtgagccgagatcgcgccactgcactccagcctggcgacagggtgagactcccgtctcaaaaaacaaaacaaaaaataataagaagaagaaaaagcagagaggtgagttcttccctagagagaaaggcttcccaggctattcttccccaccttgagttcttatgatgtagagatctaggggcaagaagaccatgtgataggttcaactatcttcgctgaaaaacactccaggacgcaattcttggtaaagaaaagtgctgttttttatttgttcttgaatgtataggttcttttaaaatcagctatacttccctttaaaatatcctccctcatgccccaaccgcttagaatccaatagccactcctaacaagggcctaggaggaactcatcctacatagccaagaaaggggtacagcttgaggaatgggcatatggctcaggaagcagcaccagctgataagaactttccccaaagcagctctgtttggcttgtgagtctcctttccctgccctggtctggactcccccagctgtgtcccacccctggaattcccctgttccttatgtggcctgatcttgagagttaaaatcataattaacatctttacagctggagagctgagagatcactgttctcagccattctcccaccacaactttatagatgaggaaactgtatccaaggttacacagctcataatggaaagagccaaaaattttggtgttcagactctcaaatcagatatctttctagtatatacctccttacctccaagaaagcaaccaatagctgcctccaactccagaaacaactggagcaagcaggtggtggtgatcagcacaggtgggaaaggccctgatataaggagtcatgctgactccagctgagccccagcaagggagcagccaccgcgctccctagtctccctccatccgaatgttatcagcagcaggcacccaccctgccaggttctcctcctggttagcagcactgacatgcacggaaacacatcttaccacaatcccaggctccttcccaactacagcaggctctaactggtgcaggatcatggtgaggagctgcccaccagcctggtaatccagtttagccagactgcggcctggatgctgtaaaacctaatccacacccttgggctgacttagatggggtctcttagcaaacaggctaaaacctctgtgttgtctgggagagacagagggaaggactcacagatgctgtcctcccagcaggagctcataaacatggttggcatgaggagaactgagttcaggaaaaggaagggactcaggaaatagagagacagacagaggaagcaggagcagctgtgattcttcctccctacccaactcctgaaaagaagagaccacagacagccacagacatttcccccatctaggtttcaaggacagctcagcctgtgtgggctgagaggtaagaggagagaatccagagacttgtttttctggattctctgagaatccagagacttgtggtgtcataaaagctaagggaggaggttgtttcactgagggttggtgggtggtgtgaaatgctgcggagaggtcaagacagctgagcactgaaaggtattcattctatttggcaactgggcagtcactggtgacttttatgaaaaagtatagagggctgaagaacagctgaggaagaatcagtttaaaaaggatctttttaaaagtaacttggttaacaaggaaaatgtgtaaggggtaacagactctgagaaatgctgttttaatcttgtggagaacttgtttgcaggctgtgtggaggtaaccagtggagacagaggctggagactccagggagtgggagcagtggagtaagcgagggagcagtcttggaggacatacaacaggattcaagatatagagaattaaataggagcaagaatggaggggttggggagagttacagacacagatgaatgagaggggagagaggaacagcaggcaaggaagctcttgctttaggggctgtcttctgtgaagtagacagtgagctcagtcatttgtggaggacaaagatggaggcatgggtggggaaaaaaaaagggatcacaacaagttaaagaatttccagtcaacactgagagctcaactgaggctgccaactgtgaatctgtcatgcatagcagcccaggaggtggaagcagcaaatatgatgatgccgaaaatggagaatggctgatagtttcagcaaaattgaaggggatacgcctggcgcagtggctcacgcctgtaatcccagcactttgggaggccaagggaagcagactgcttgagcccaggagtgttgataccagcttgagcaacatggcgaaactccatctctacctaaagtagaaaaattagccaggcatggtggcatgcacctgtagtcccagctactcaggaggctgagatgggaggatcacctgagcccagaaggcagaggttgcaatgagccgacatcataccactgcactccagcctgcatgacagagtgagactctctctctcaaaaaataaaaaataaataaataaataaataaataaagttgaagggcatgagaaagttcaggatgctgacaaaaacatcagtgtgtgataggctctgggttcatgctggggagaggaagaagtccaggagaaagttaaaagacaaggagaggagagagagggctgaggtcatggaaatggactaaaggagcagggcaattttagcagtactgagggatggagaagaagcccaggaaggggtgatccagaaggagcaaaggctcaattctggcgttcagaaaggaagactataagtgactccatggagtgagagagggagcagaacagagcccaggaacaaacaaggaggcgcctccgtcttagcagccaggcaaggagctgttgctagaaatgggtacagggagggagccagagtccgctggtgggggatggcagggactgccatggaacagagcatatggaaggtatggttgccactcaggtaggggtcctagaggcaggcaaggtgtatagttagcaattgctagaagtcaggcagggctaacctaaccatgttctgtggaagagtgctctgcaagttcatcctgaaccaatttttttttttttgagacggagtctcgttctgttgcccaggctggaatgcaatggcatgatctcagctcactgcaacctccacctcccggattcaagcaattctcctgcctcagcctcccaagtagctgggattacaggcatgtgccatcacacctggctgatatttgtatttttagtagagacagggtttcactatgttggccaggctggtctcgaactgctgtccttaggtgatccacccacctcagcctcccaaagtgctgggattacaggcgtgagccaccgcgcccagccaaaaaataaaataaaatttaaaaatcctgaaccaatttttaactaaaatccccttgcatcaactgaagccattttactgtcttatttctcagcatacccaagaagtcaatttttcctctagggctgcatgctgtcccataagaatctagaactcaccgtatttccactgcatgatgttgtcaaggacaaaaggacttggctgacttcaaaactgggccattatgggaataagtcaaaagcaggatcagcccaaatgttaatgaagagcctctgcaggcagtcacttggctagtaggatttttttttttttaatttctaagtcatgttctggtttttgcatgcaaaaacaaaacaaaaccatgattcaaaacactggtggctaggtctaaaggaaaagccagcgagaggcaggtgtgtaaagggagcctctcagcatgcaggctctctacgatgagaagggagcatgtgtctctctagcacattactaagaccccctctggcccagcaagctgatccgtgagcccaggaggccacacccaagctgggagcctcactcatataaggaaagccaagcttttaacaggtatttctgctttaaatttgtggtctccaattgctcctgaggaaggatcaggtctgagcctgtcacaacactcaccagttgcccaacaccaagtacaacaaagttcacaggatggtgggaatgtgggctgcacaaaggaaagatgacctagagcaggaattagtgacatgagaacagagggtactttgccaagccaactgaacagagaaggagattcaaaaattgaaagggaaatgaccagaccccaaaccagaaagtcatgtgagtctcaaagggcagaagcctaagtccaaagattgccggactagtaaagcattcaagactcagttaccccaaactagaaaacgggatcacggaagcccatctgcttagaacgtggcatgtgctgctgaaagaatggcaagccaaggggcatggtttgctttaaagtgaagatgatctctcaggttgggtagagaaggaaatgagcaataccatcaactcacaaagagagaagaaatgttttctaattaaaaaactgctcattagcaaaggccctacaaacaagaacatccttgaacttcatctgttagcaaaaataaagccatgacctcagactcccctgaaattagccatgcaatgacaggaccagggagagctgtctcagtcctggccactgacatgtcaggttcatagctcccccaacaatatgagcaatgggttccttctcaaccaagcccttgcttgggaggtagcctgacctccagtatcctcacaaacaccctgcgagggccatgcagatgcattcaggatgcagcctcgagctcctgttcccatggcttccagaatgcttctctctgcattctaggagaactaaggctctgaggttgcttcatggtcaccaaaggacactggctttttgcctcttgatttttccccctgtccaccttagacaaacttcccccaggaatgtctagatctggcccctgttggtccctgaggccttctctaacctccaacaaaaagggctgccagaaaagtgttggcttttttggggctgtagacagcctggaggcgggctggtcagaagactcacttctgatctttggctcatgaacttggagaggttgagaactagaatctttaagcaggaggagaggcccagaggagtgagctggttgtgggttactctctccacccatggaactctggacctgaagcagacagcagctgtctcacagtattcacaagcagaactcacgatccatacctctgaatgaggatgatgaagggtatggccactgacaagcaccaacagtcacttctaggaaggcaggttctcaccctaaagaagtgtgattagcccagagtaagtagcacagagggcgggctctgaagtggacatcttactaagtctgtaagtgaaatctgaaccagaagatttaagtggtctctccacagccacccagctcagtcaagaatgtcacaccatccacagcattttcacagcagccacctatgtcaacatcaggaaagtgactatgcaaaacaaataccctgaaaaccgttagaacccaaataggcacaaattgagacctatggcctctagaagcctccactagtctgcacatggcaggtgcctctatccagacaggacaagcaaaggcaaacagtgacagtctttggctgtgctgggccagggatcacagtcctgccatatgtctaaacctctctcccttcttttacccacttctgagcccaggaggagttcagatgtatacatggctcctgagccctggacactaaaaggttagacgggtctgctttcccaggcagaaaaaaattcaccaaggaaagtaggttttcccgagcctaaccaggtgtggtcttgtcaagtggagcctatacatctgattactctggtaataataaataccttcctctttcctgtttattactgaaatcttctctgtagtggatgtactacggctcccaaataaatgctgtagatgcaaatggcaaagaagagcactacacagttcaacaagactcatctaccatccacactctgaagaggataagctgcaagatggggaggaatggtcgacagtatgggacaacagctgccagagtgcccagtctccttttggctctcacacctgagagatgctgttggccaggcgaaatgacattctttttgctctttcattctcctgaaagaaaaatatatatttggaattaaaatagccaaatgtaggatttattaacatgaaaaggctatgtcaagattgcagttctgccaagtcaacgtattttattctaccctaggaatgcagcagtaaaacttactgaagccactaaacattgtatgctaagtatggtaaacaactggggatggctggccagaccctggcacacagtaggcaggcaaaatatttcagtggaattaaacagccctgaatggacatttctggtctacacaggtgggaccagcccaaagatcagaggagctctctctgctgcaagcaatacctctccttccttacctacaccaaggggctaagaaagatcccttcctttctctctcaaacccaaatagaaaccaggcactaagaccaggtaattcccttcttaggggcatcacaatcacagtgtggagtaaccagcaccaaactgggaatcaggacaactggtttctcagcccaggtctgctgctaaatgctgggttaccctgggcagggacaggcacctttctgagtttcaagtctcgtgagtaactggcattgatgggccctgtactgccctgccttccctgggggctaaggggctggaagtgagggttcgttgtcaccaccatctttttgcaccacccgaacagcttcaccttaggttctgcttgggtgcccctctgcttgcctgatcaccgcccacctgctgctggctggcagtaactctttaccatatgtcgtcgccgcctcttgggttggatgccctcctgcatgtagggaggccacgggaagccctggggagtggaacatccactctcactagacacctcctcggagtctgagtcctcctgccttggctgggcaaaccgtttctccgggtagatctccttcaaccagccctcaaagaacacttccaggcagcggccagcctctgcaacctcggagtcaggctgatgggggaggagagcagtgatggtctagcctgtttctaccagtccatctctttcgggtccctcaagagctacacagagcacaaagcctagcggggtgtcctgaggtgtctggaacttgacatttttctcctaggactcaggaaaactagtttggtagcagctcttatagcagaagtgaccccaacaggtatccacagatggccactcactagtacctcccctttttcctgagtccatgctaaggcctgagtgtgggagagagcttttaaacactcaccacagcaggcccccagaatctgctccccagtcctcatggcagcccagaccaaacctaacctcccaaccctacccacccatgacagtcctggggatgcagggaaataggagagagggaaaacaggcaagacatacataattgaacttagcacagttccagaacatgaggcgcacatctgataccacctcctctggggtggtatagtgagctgggtccttcttttgcagcttcctccggatgattgacaggtccatgggcctcttgataatctggtaataatgccgggccttgggggaggagacatgaggagaaggaggcaaagggagtgagagaagaaatggaggtgtggataagaaggaagaagaaatggaaaatgaggtgaaatataagtgaaagaataggaagaggaatgatgaggagcagcaggaagaaaaggatggagaaagaagacaaagagcaagggaaaaggaggaatgtgtcacctgtcaagtaggatctgatacagtagcagttgtggtgggggaggctggaatggccatggccctacggtcccctggactatccataagttaatattgtcactactcccagtggccatgctctgagcccaacctgggaaccaccacgctcctgccccatggcctgggccctctgagcagaaaagacagtagcaggcacaaaattcaataactcagaattttgtgactctagaaaaacaggggttaggggaggctggggtagcagtataggcacaaatccacatgcaaggagaaggtgagagaacagcgtggccttccttaccagggggctgacaggttcatggaagggcaggctgaggttattgcagcacaaggacaataccagcttctcacacttctgcaaaatcagaattggcaacagagtcactttgttctggtctcacctcagtatgaactaaagatgttgaccctgataactccctggctctgtcccacaggatgccagctgccatactaaggcacaattcaggttcccaagccagaggaaaactgctaggagaaggaaaattatccaaacacccctgggccaagttgtcaggcataggacgaagaaatgtatccagaaaagcccctcatcccctctcaaaggcctcagaccctgtaggcagaagggggctgccaaaggcagggaaccttgtttccaaagactcctccctaccttctggtcatacatgcttaggccaggagatgcccgcattccaggctggttatagcaggcattctcacagtcgtactccatctcgggctgggtcaggctgcggcacaaggtacacacccactctcccctgcaggggcaggtgaggccatgttaggcctcagcacattgcccagagcacccttccctctccctctgccctatggcaggcgtgagaaactgagtctccggctttgccgtgtaagaaatggctttctagccacaggcttggaagaaattcaataactcagaattttgtgaatctagaaaaacaggggttaggggaggctggggtagtagtataggcacaaatccacatgcaagaagaaggtgagaaaagaggtagaaatgaagtcaaccaaatgtcaagcatccacctgtctgtgtgcagaagatacccaggcccattaactcacagacctgcaattcaagcaggtccagaagaggggagtaagcccatcctgggagctctgtgggcctggcctggaataatcatccctggaaggtaaccctactagccaggtgatggtcctggactggcatgactcaccctgggaagctgagcaaggctggcacatggcaggagaggtggaacactttggggcagcggtcacagcacagtaactctccgccattgaggcaaacagcacagaagtcctcattctctattggggctggggggcccttcttggctcctggggttcgaggaatgagtctgtgttcttcaggagatgtgccctccacttctggtggccgctgcccagccaaagaagtgacagtgacctttcttccctccagacctggggcctgggtggcctcagacagtctgtcctggctgaccttggggaagaagtaagtctgggcagccagagcacagaaccaacaagctctcgagggaggggagggagagactggcaggccctgcatgcctacatgagagccacttattccaggaccccaagccagcaagccccatgaatgctgggacacctcactcctaatatgcatctcacaggaccttgcagcaggggacaacgtctggccaagctgcagccccatcagagactcaggaaaggtcccagagtcagaattcgggcagtagcagaaagaataagctcttaggctgggccagggtttaaggccaaggcaaagcaaagtggtaccttaatggacatgctggaggactcagtgccacactcgatgatcagcaggaagctcccatcctgatcattcttctgtggcttcagtttgaacacaggcatctctcctgaggaggcagcacagatcttgagtcgctccagtcgcacatagggaatcttatgctcactattgaaggctctgcagcaagacagacaccccggggtcttggtgggatcctcctctggtcccaacctctaagtcagaaacatccatgatccctgtgatgattaatattgagtgtcaacttgattggattgaaggatacaaagtatttatcctgggtgtgtctgtgatggcactgccaaaggagattaacatttgagtcagtgggctgcgaaaggcaggcccacccttaattgggtgggcaccatctaatcagctgccagcaaatataaagcaggcaggaaaacatgaaaaggagagactggcctagcctcctggctatatctttctcctgtgctagacgcgtcctacccttgaacatcggactccaagttcttcagttttgagactcagactgggtctccttgctcctcaagcttgcagacaacctattgtgggaccctgtgatcacgtaaattaatacttaataaacttccatatatatatgtatatatatatgtgtgtgtgtatatatatggaagtacacacacacacaacacacacacacacacacacacacacatatatatatatatatatctcctacttgttctgtgcctctagagaaccctgactaatacaatccccagctgaattgttactccagatcctcttggatttggactctgaatgtggactctacaggtccaccacattctgtcctcctggcccacctctgcatggccaggccctgtcagccactgggaagccctatggtgtagtcctggtcaaagacaggagctccctgaagtgcaagggcggcacccagagcgcatgcctcgtggtgcaggagccaggacatcctcccacaaccatcccagacatccacttgaaggttgaggggttgaggaaggcagttgcaggcaaatttcttccacttgtagttaattcatcaaggatgcttcatccctgtgccagcatctcaggacgtgaagtcatgggtgggagggagattagccagaaggctgttacctgatgctctggttctcttttgcatccagctctagggctccttgttcaaaattctcacactctaaggcaaaagacaaacaaatacctgtgacacacatttgtggcaacaaaccccgtcatgcatatcttctacttatatctgctattcatacctttggccacacatctgtcatacagtagttacctacactatagtcattcatacatagtggtgacaagtctgccgtggatctccttcttgagaggaggaagcccaccttcttttaaaaagatgaacacaagtaacactcaagaggctgcctatgggtaagtgttgggtcaggcactgatgggccagtttctcaccttcaagatgagctcagaaatcacttgttctcagtacaccagtgttgcctcctctgaggagtctttttgtccagcctctgccatgtcagccaagtgctgggattccagcagtgcttgagaatccagctcacactccatggaaaagaggctcccagggagttctcccctgagtatgcagtctatggagatgggcaggaggcagtgatggggcaaaaggatgaaactagcatccattcagcaccaggcaaggtcctaggcactgtacatgcgcaagcagggtctaaaaagtttaactgcataaaatgcagagttacattattgtgtgtaataagaaccaacgatttttcagttggcctttcagtcagtgtgaaaaaaaaggagaaaaattatttctttcgttttcatttattacacatataggaaacagactaatcattacaaattaaacacgcatcatacattgaacgaaaaaagtcccaaatgatcatcaggaagtcgcttcctgacttcccaactagccctcaccttccacagaagaacaaacttagcctagcctggttggagaaggggcatgggaagctgagaagcgaatcagaaccaatctccaatggtccaaattgccttcactatgaggcacaacacaaatccacattagtgtcaggtaccaggaaaatccttactactcagaggaagttatcaaatgatttcactatagttactggtcccagtagcctaagaagtaggtgcgattggccccatttagagagaaagaaatcagttgagggaggttaggtatcttacccgggatcacagggagagagaactggtttaccaaattccatctatcggactccaaagtcagacatgctcttttccctataacattttgtcaaggctagccctcctgggctgagttctgtttccccctaggtataatgcagacccccaggactctttgcatggggagtgttacaaaaagagtaagtcctggccatgcctagatcagccatggccacagtgagggaagcagaacaggtgtcactaagacagttccggaggagagaagtaaattcagcctcagagagatgcactgcttccccagcttagagcttgtctgctggcctctcttacctagaagtgctgagtccatctgctcaagtctgtggccaacatgaagggcaggctgcttgagtctcaccttttgggttctggtactgctgcagagctgtagacgtgctgaccactggcgccagtggaggtttcttcacagagaggttaattggctcctccagttctgaggggatggccaagtccttgggagcatccagaccggggactatgggaccttgtcccagtaagtcagtgaagcgagtggaatcctcactttccatctttcaaaagtgaaatgtcgacaagaatcaaagaactcagacatggttgtcattagtggtctcagaactgttaagctaaggtcagaataagggtcccagtggccaatcttttgcccaatgatgaacaaaggaagtttggatagcatttccccaggacttaccttacacagagcattctccagggagggatcagccccatctctgggacacaggctccctgaagttcggccagaactggagctggacccagtttctggctgcatgtcagaaactggagggatgctctgcagaggacaagttgccagactcggcacagcctgggtgtgaccagacattaggctgggcccagcctgagggtgatcacttgccaggcttgccatagcctgaggggagtcacttatcaggttgggcatggactggaatgtgctatgcacaaggctgggcacagtctgtaggtgactggttgtcaggctgggcatggcctggttttgaacacttgtcaggctggacaccattttggggggagcactcagcaggcttggtactgcctggggggcaccagctgtcaggttgctcacactctggatctgtggctctaggggcctctccaacctggtagatgacaactccatctccagagtgttggaaaagcccatgatgctcagcgaggtggagtgctgcaggaacagagacaaggggtagagtcaggctgctagctgggaatggagggagggagaggagggacccaacccacaggaactcccatgctccaattccactctggcttcagagtctggtagctgctggtagctgccaggaactcaggcaatgcatgaagccctgttcctcttcctgaaaccaaggaggctgctaggctatgacatagagagagaggcacaagcggagaactattgtgtgtgtgtgtgtgtgtgtgtgtgtgtgtcacagcaagagtgagaaggagaacttattgcctgacctgaggcatgtacacacacacacagacacacacacagacacacacacacacagccatatccctcaccccagtcttgtacctaagcaaagggtccggctgtgggactgccctctaacttcaaattcccctctgactataccaccagtggcttctcttcccgtcaaggggtgctatagaatagtttctgctatacaaaagtagcagggggttgagaaggctcaaactcttatctgcctcagaccttctttgagagaatgccaaggctcagaaagttccaatcagtcctggggaacctgggtcaactgcagggccttcttatggggttgttcagatcaactccaagcactactagcatttgatgtaggctttaaccaagatatttgaaggtcttttctggccctagtatacctgccaaagatattccaaaccagaggcagagaacatcaaagcagctaaatcttaatatcacccaatccgtacaatcattggataaggcagtaatgttctgactccaaaattattttcttacatctgaggagaagagatgtaaaaggtttataaaaagaagttgaagatacagatttctgtactgaatccattccatttttcagattgaagagacagatttagggaaaaggagggagactggctctaaatataatcttcaggaatgtgtaagtttcatatccctgccctttaaaaaaaagactaaatatataacaatttcacatcttttgaaaaacaaagagaaaatgggaattaggcatatctatctaagtttccaaaatcagtgtcttgaacctgtcatttcttccccattcacattttcacaggaaaataaatacttcaaatacattctcaagtttcaatataaagttactaaagctattttgccatgaacactgtcctcatctcagtgaaagtcactcctagtcattcagttctgcaagtcagatcctaggaaggaggcatcagtgaagcatccctcctgccacacccaagctaataccaagccccatcaattctaccccttaaacatctctcaaatatacccactaattcttccctctgctaatggtgccctagcctaacctactttcacatctccctagacaacagtagtagcctcttcaatggagaagtattttcaaaacacggatccgatcacatcatttcttttcataaaaccccgcagtgcgctacattcttcttagaataactgcaaaaatccttaacaagactcccgaggccctgatgacctgtcctctgtcctcctttgtagccatagctcattcaataaccctctcctcattcactgaactctagtcactcattttttccagttcctgaaacataccaagctctccctccacccactatcctcacccccttcagatggactgctttctctgcacagagaattctcctacccctgccctgttccacttatccttcagaactcagctcaactgacattttttgccagaaagccttctttcattctctagtccagactaggttcctgcttttatgctctcatatgccttgtacttgtactttcagcttcataccacaatccgtgatatcatttgattaatgtctgtttcccctactaaagtgtaaactccattagggtacggatttttatctattttgcttacccaccatattcctagacccaagagcagtgtctggatgaataaatgaattaatgagctgtttaaaaattcaaaacaacactaatacaggactgtttattctacaaatctttagccaaatgaacagcagcttaggtctactgacaacttagtctatgagtctctctaaaataatgattatttttatacagctaaagtttattgagaatttattatatgcaaggcaatttgctaaatgttttacatatattactttatttaatcctcacaataaccattaaaggttaaaagaaacaatccatgtgaacatttagaacaatatctggcatactgtagatgctcagtaaaccccagttgtttctactgctgcttctattatttttattgttattattgttgctgcagacctagttttacacttgacaaagatgaggctcagaagggcatcttaagttttttcatgttattataaaacataattttgtagatttccatttctctttattgtttgtgtactgtatatagaaatacaattgatttttgaatactgactttgtatagaccttgctaaagtcactctgggattttcctttggattttctgtgcacacaaatcatgtgcatccatgaatagtaagtttttgttttgtttttctgaacagggtcttgctctgtcaccctggctggaatgcagtggcacaaccacagctcactgcagccttgacctcccaggctcaagcaagcaatcctcccacctcagccgccagagtagctgggactacaggcgcataacatcacattggctaacttttattttttatttttgtagagacaaggtcttgctatgttgcccaggctggtcttgaactcctaggctcaagccatctttccaccttagattcccaaagtgctgggattacaggcatgaaccaccacgcccatcctgaatggtaaatctatttttttttctttacatttgtttttcttgcctcactccactagctaagacctccagtacaatattgaatagaagtagtgatagtagccatcctagtctcatttctgaactcagaggatcctttcaatatttcatcactaagtagatttgatgtagatttttttatagatttagatccagatcttggttgggcatggtggctcacacctgtaatcccagcactttgggagaccgaggcgggaagatcgcttgagcccaagagttcaagaccaccctaggcaatatggtgaaaccccgtctccacaaatgatagaaaaattagccaggcatggtggcatgggcctgtggtcccagattctctggaggctaaggtgggaggattgcttgagcccggaaggttgagactgcagtgagccaagatcgtgccactacactccagcctaggcaacagaggaagaccctgtctcaaaaaaaaaaaaaaaaaaaaaaaaagagagagaatccagatctttggtaccaaagctacaacttaattttgacttgtctccctccatacctctctgggcttactccccttcactatctctcatattctgttctatttcttttccttccccctcttctcctctctccctcctctctcatgagctccttctctctcttcctgtcctgctttcttttatcatctctttctcttctttccctacctctttcccttataatttaactgctttagtaaggcttatattttctattcttaattttaaacacagatgagttaaatatcttttatctctccaaagaaaagtatgctttttatattttccttagtagtttaatagtgttcagttttttaaaaagcttccatttcctccacagtctgagtgccaagacaagaagggttgaagagaagcaaggtggaaagaatatttaaaccaaattgggtaagctaggaatgaagcccagcttaagggaccaaggccaaaaatcaatggctatctcaaacatgcccaggcctgcattccttaatgtctccttgttgtcctggttatgcactaccatagctttctaatattctatatttccttatctatgaacaagaacacccagtgactatttcattccgttttgcaatatatgacagtctaatcctttgcactggattctttctcctttcccctatttgacatgtatgtttagtgtggttttggcgctcatttaatctacccatgctggacattgagaattatatagatgtctcttcttagtgagatccttgttgccaagcattaagagcactaaaatccacgtgagaccacccaaataataatggtcaggtgccatacgtcacaagatatgcacaagataaaatccccaaggacaaaacttcccagattaggggtagagatcatattcgtgggaaattggctctcctgtcctaattacctattgcacatgtgagttaacataatgataggggagaggaagacatgcagactgagctgtggaaaaattgcggaaactccatggcagtttattttgaggtgaacctgatgaacctggtcccgtaatgcccagaagacaatacgaggtcagcaatacatcccaagatattgcatacttgactgatttatttccttttcacagccacagccaatctcaaggaggccaatgctatcaggagagggggtgaagctctggtagtattaacaagaatgtggaaaatttccacggaggaagggactcagagaaagtgctgtgagaaagccagcccaaccccatttttacaggctatgcagacacaatggcatttctgaaacctatatatgctatgtgttagttatttttatactatatcggctctctagagtgaagggttgtaaaatattaaaacaaaaggtacttatttcatgtacaaaaagaaaaagaagatttgagaaccttcatcctagtctgttgctagtgctacaagatgggtgggggcaagggtagggccaaccttcagagcaaggaaagcaggctgagtctccagggcctgggaggagaggaagcacttctcaagagcatgatgggattggaaaagggcttgagagcgtggccaggttgtctgacacttggtgccacccatgcagaagggagctcacttgtcaatggagatgataccacccaccctctagaccccaggattgttcagaggtcaaatgacaggaggtgaatgtgtatttctagctataaagtacgtagagggttatcactgaggtttctaggctgtcaactgtgtaactgacaccttgacttcatctttacatacaaaacctctagatttcatgaaggaaaaggtatattttgagattcactactgaaaataaactattttctagttcagagaggaagagtcaaaatgccaaaacacattcactctgataatcagctcaggtcatctttgggagatggagagagacaaccctgagcctacagagccccctcttacctcccttaactagcatctcctctcgatcctcgtttcccttcccccaaactgtgtgtccccgtccctgtccctttcctcttgcctcttttttgtctccttatctttgtctgccacctgtctgacttatctgaaattacctcacctattaatttaatggattcagttaacctatttaacctacctgtctttaccatctaacttgacaacttgcctgacctacgacttccctgaattgtctgactttcaacctctgctactagtcacctatgtgaccctgcacccatctaacctgaattctgcttgacctgtgctctgtcacctgctgccctctctctctcctcactcttaccacccagatgtgtttctagagttcagtgtgttgacattattattctaatgattgccacatggtattgtcaaaattcagataaaacattgctctttcattttaacaggaagggaaattgagacacagagtgattacctagatttcccaagctcatacaggtccaagactaggaatctgggaccagccttgaaaacaggctggctagtcttgattctgtgccagaagctagaaagctagtgccctagtaagaaatgattgagaaatcaataaacagacacttagtgcacatgccctgagtttaatataaatttcaggttcttacagcaagataatattgctggggataaagtaatgcagatagggtggtgttccacataaattaactttccagttatctgaaacatacctctttcaataacaaaatgcaattggcttaaaaacattatttcaaatgggagtacttctaaaacactttacacactcttctgtcttattaagcagagcataaggaggctaaggagaccatttcttagtgatatcaaggaatttggatgaaccaataagtaattcagtgatgctttcgggaacttctaagaatgcagggcttagcttgttctttcagtgaatgacctcataccgtggcacttttccaagtgatgtttcttgtcttctcccttgttagctgcccttatagaaatcttgactccctgcctctactctgcttactactataatgtagctaaactaaaactttcccaagaaaaccatatatttaagcttgctagatcaagaacaccggctagatacccacatatgagtttatgatttcctacagaatataatgcatgagttttgtgatggctgtttttgctgctgttccaaagctttgcctcatcacttctagtttcagatttctgttctagtggttaaagtaatcagaaactgaccactgtgtaaatatgcaatagaaaaagggaccacagatttgggagttgtgtctaggaaacacactgaaggccttcagtctagctaaggaaacaagagagaggaaaacagattggtgaattaaatcctcaaaatatgtgaatgcgccgggcatatcacctgaggtcaggagttcgagaccagcctgaccaacatggcaaaaccctgtctctactaaaaatacaaaaattagctgggtgtggtggcatgcgcctgcagtctcagctactcaggaggctgaggcaggagaattgcttgaacccaggaggcagaggttgcagtgagctgagatcatgccactgcactccaacctgggtggcagagtgagatttcatctcaaaaaataaataaataaataaataaagtgaatgcttcaacagcttcaagattaagtagactggtttaacagtagcagatcttgaaacagaatcagatggctgaggaagggactaacttttctagtaagcagtttcacatgttgattttttttttttttttttttttgagatggattcttactctgtgggccaggctggggtgcagtcagacgatctcagctcactgtaacctctccacctcctaagttcaagtgattctcctgcctcagcctcccaagtagctgggattataggtgtccaccaccatgcccagctaatttttgtatttttactagagatggggtttcaccatgttggccaggctgctggtcttgaaatcctgacctccagtgacccacttgcctcggccttccaaagtgtgggattacaggtgtaagccactgtgcctggccctcacatgttgatttttaatggcaaagttgttgctcttattgacaatgagtgttcctccatctcaagagaaagctcttgtacttattaaggctgtcactatggatgtaactatgcagatatatgataacttagtaaagccaaatgagaaaaggttcatgggtggtgaagggagaagtgaaaagtgcccagtgccctgataatccagggaggacagaaaaagtaaagaggatctcagaatctgaggtagaagaaagaggaaaggagtaagtggattctagtaagtctgaagtgaaagcctgatgagtggaaccctcaaaccccaaggcttggagactcaggagaatttggtcaaaggtattttgcccaggccagtgtaggaaactgacttaaaaacgttattttgaatacaaaattagccaggcatggtggaacatgcctgtaatcccagctactcaggaggctgagacaggagaatcgcttgaatctgggaggcagaggttgcggtgagccgagatcgtgccattgcactccagcctgggcaacaagagtgaaactccatctcaaaaaaaaaaaattattttgaataggagtacttctaaaacactttacacactattctgtcttattaaacagataggagcaaggacctgttttctcatgggccaggagacctagacaaaaatcttaggtttggatggtgaatgaaatcaggatagaactaaggagacaggcttcttagagtgtgctaagttcaggagccagacttggggagtgtttggcctgactcttgagtagaaagagtgtataattctgcagatgctgaccaggacgcaggctgtgccttaagaaagcttcagcaggccccgggaacattctgagcaaatgctgctgtcagggctaggctatgaggaaaagattgtccctgaggttgaggacccacaatctgatccatagcagtagctttggagactatggaagcaggatgcctagtatttactcacagttaccagggtttaatgagtttaagcaagtcattgtccagctttgggttttaatttcctcctacacagcttaatgtaaatctcactgagtttttataagactcaaattaagagatcgggcatcaaaatgctttgataatggtataaatactatctgcctgggtcattatcctttactcctctgtatcactcttaataatctgcatcacaggaatgcctaccgcttctgtatcatttactggaaatacatctcaggctcctaagccatgagccgcatgctggtggcctcgaagtcctctcttgaagatctggggctatgttatgagcagcagaagaaaggtccctcttgcaggtgaactgggacccggatagggctttctgtgatgcctacagctttgactccatgagagcttttcattttcttaagacaatctcgctctgttgcccaagttggagtgcagtggcgcaatctcggctcactacaacttccgcctcccaggctcaagcaattctcatgccttaacctcctgagtagctgggaccacaggcatgcaccaccacgcctggctaattttcttgtgtttttttgtagagactgggtttcaccatgttgcccaggctggtctcgagctgttgagctcaaacaatctgcctgtcttagcctcccaaagtgctgggattataggcgtgagccaccacacccggccaactcctttgaggaaaggattgtgtgtatttttcggcagttgactggttcagaagcatgaaatgaatgcatcaaaatgtctcccagtttcacttgagatgtaagggttgctgtggtagggttgtagccatggtctttctttcagagtggctgaatcaagattaggaagcttaggcaacagctggtgccaggcaaataccaaaattcattcaaaaggggttgcagagctcaagccactagaaaatccattctagaactttcacatctcattttcagccgcaacctgtttccaccatcggctcacatagcaccaactccaaggtacttgtacgcagatgttctgcttcaccaaaagtcctcttttggtgaaatacagtcagtgtggaactcgcagaaaggtgcgtggtgccacaggttcttctggtccatgaccttcagatagattcttttgactttcctggcactcacaggccagcacaggctgggagtgggatggaggacaaaacacctttaccagataaaacaaccaataccaaactaggctgggtcctaagacctctccccagcaaagcctcgggctacttcaaggattgtaaagacaggaaaatccagcaggtaagaggccaaatggagtcctatttctcccattgcagtgcagaaagagaagcaatttaacctagtcattgaacacagagctgtcaaggacccgtggtctggtcctaacattgcccaatgggttggctgcataactcttaggtgggtcacttaacctctctgtgtctcagtttccacatctttcaaaggggaataagaaagtggcttcctcatagtattgctaggataaagagataaaatgaaataatccatgtaaaaacctatgaaaaaattagaacgatactatacaaagtattatcactcaatggtaaaaggctcagaatgttgtttgctatccttgagcttcacaccctccaccctgcccaaccccagctccaaggcaacaaatttcctcaaaaagaaagcccttttcctcattgcagtagttttgtggacaaccagtggctctcactgtcagggttgatctctctctgccaatccaaagcttcctctaagccaggatgacaaacttgagggtcctttttctgggagttcaagccatcaaaagcctatgaaacacatgaagaatgccaggccatctgcccctccaaacctctacaggagtcccttttaataaggggcagaagcagctcaaaatgagaagatagaattcctaggacctttgctaaccccattgccaacttgcagccacacaaaagggcagcaccccttgctgctcagggaaccctgttggccattcacacaagcagcactgactccatgcatgtatgtcgctcagctcctttcctctgctctgtgtataggaacagaactgaacctcatcaaatgagaagcagcattttctgcatggcttccactacaactgagcactggcaatgaaaccacctttgcaaaaattatatcaatgagcaaattatgacagtgaaaaagatctgatctaacttacccactcccaccccttgcctttcccgtaatcattcctgggcctattgtagactggccttttgagatatcttctcaacttttctgcatgtctgacatccatggcttcacccagatccatcaatcccactcctgtggccccacccagaagcaactcagctcaaatggacagctttaacgcatgatttcatctccatcccaaccaatcagcagcaagcacctatttctagccacccccaccccttccccaaactgcctttgaaaaatcccagcctctcatcaactaaactctttctctactgcaatgccatggtcttcacttgtgcagcaggcaagaagaacccatcaggcggttacagcaactctcatgcttgcttctgaactactgacatctagagctagctgccttcaggtcatcttctaatgtgtattccacaaaagaatagcaataattcaaaacttaacttcttcccctaaatatgctctttttcccatgctcccattccagtgggtcaagacagatccactgggatgggagcatgggaaaacacctgggtgttaagccaaagggctttctctgccttacctatcatcaattagacactgaggccaaaactcctgtgatctgatatctcttgaaatctttgcttcctctccattcctattgctattgatttcattcatcctcctgtttctcctctgtactattctggtctcccttaccacagctaaagtggtctttcaaacttaattcaaaccatatccctcctttctggaagtccttcacttactcctcacatcccccaagactgaatcccagttccaaagcataatttagaaggccttacagcccctctggtttcaatccatcccattccccagtgcatctcgtgatcctatcaagccaaattacaaattatctgaagcccccctaactgccccaggctttctctcacttctgaagctccctagttgccattccttttgactatttgttctacccctctacccttcactagcccaacttctccttttcaaaatttcagcttaaaataatgtcccctaagaagtcttctgtcaacagccccctctcccagagctaggtgctccaatggggtgtaccccaatgactattatagcactttaccacaatttattattgttgattaactgtctcttccaccagactgtactctccagcatgggaccgactatcttattcaccaatgtatgcctggcacctagtagaatatggggcacatactcagatatagatatagatataatcatttaatgcatatatatatatatatatatgcattatatatatgcattaaatgattaaataaatggatgaatggttaggtggctggcccaaatacaagaagttaaacatctaagagccacaaagggccaatatacagtacctcaagggcctctatgccaagtcattttcaacagggtaggacaggcacagacaaaaagcctcaaaagtcaccagcaatttccaagctgacatttcatttttgccatcccttcttttttctaaactctcctcaagtgtcacggagactgactgttctaagacatgcattgcaatggtacagagctagggaaacttggtgaggggcaggtacactgagcaaccagcatagctgggctgcagggccagagggatgctacagggccaagggtacaggctgggagagttcagaacacctgacagagcttcaagtccagggctgggtggaggcactggagagctgagggcaccaggccagagaagacaatagcgtaagtgaaacagggccaagggacactaggaggaatgggtggaggacaggcacagcactgaggctccagctagatgtatgacaggggttgggggtgaaggggcagaggtgagaatagatagttgaggatttgtggggttctgggttatgtccagggtaagcgaacactttcagtaagctagtaggtgggtggacagaaaggcctccaagagctcatcttcaagagatctctgtgtctcagctgctcatctacctctgtagaacatccctgcagatcactcacccaacaaattccattgattcaaatcctaaggtatccaactctgggttgtggaggccacaaaaaatattttccccatcttcactgtggacagaaaagttcaagctttggattctaactgatctcattttaaataaacctcagctctctcgtctactagctgtaaggccctggacttcagtttccttagctgtacaatggggatgctcacttccacaaatgttggaggtgaggtgagataatgctggtgaagcagcacacacggttccaagcacagagtacatgttcaataaattggctctctttcccttcctccttccactctgcatgaagcccaggaggtcccattttaagtgtgcgtgggggagtggaaatggggaggaggaagatctaggttgctgactcactacggcagaaggcatgaatcagggctgtgtagcgtccagggatggaacagggacgctcctccccccaccctatcctcctcctccaagtgcctggggtcttggctggcagtgggtcccatgtagttagggaaaacaggctccttcagtacctttctcaccacatttggagaggagtgctggatggtgctgtccactggggggacactgagaggggtttcttccccagacgcctggggcaaggcagcagcagtattcttgtcaagagggagagccggctttgagccctgagatgctgggggctcatctgtagcctggagaagaaaataagaacttgggtgggttttactgcagacagcgtagcagcagcagcagtggcagcaaaggctagtgctcaccctgccatgtgcatcatcaccacttgcacattgtggactgcttaaacgttttccaaaaagaaaaatactcttatcccaactcttccaaagactacacgctaatgggaatgtcttaggatgaaacccaaaccaagaattctgagctaattttgtgatattcactttagcaatcataacctagttttgacttacattttagcttgtggccctctatgaaccctagacccttctctgccatcacatggattattctatatctcctcaaaagaactgggcctcaggggaagacattgaagcatgatctgaagttgtcagtactgaagcgtaaatgtgaggccttatattctataataaagtaaaaatctgtaaagctgctttgaagatataactgtgattacagatttaaaggggataccactatagaaaaagtgagagaagggtagagaaaagaggatagaacaggaggttctggggggaagaaaaagaaaatcaagagctaagaatgaagatgtgaaatgtagcaaagatcccaggggtacaaactgcacctcttcaactgtttcaactgtcttttagctgagaaaaaagaggtgcaccatccaatatcctcctgtggaaagaagacttctgtggcattacagaaatgtcagcagacctgaatccaagtcttagctctatctctcaatgttgtatgatatggagacaaactgctagccttctctagctcccacttatatacctataaagcagagatggtaatgcctaccaaacaacattgttggtaggataaatgatatggtgcatataaaacatacccagcttagtagaagtaaaaaagtttaagtctatatctgtgcagtattataaaagtgctgcctgccagcatctaacatggaccctcactctgctccttaagctctgccctccccctgtctgggattcataaggtccggcaagggagctagggagatgacaagataagagacagcctctcttctgctctggcactggcaggagttcagcacagctcagaaggtaccatcggtgggcagggtccctactgtcatccaggaagacagggctaagccaagctactccggagtatactgagcctaaatctaatttgggactgggtactatgctctctggagcttttctgaggtgggaggttgagcccagcatagttttgaaatgtgagggctgagctcaaggcagccctaaggtgcagaaactgtattcctgtgctgccttgtttttggggaggctgtgttccctgagtgatcctacgatgggcagaatatgcacgccaagccaccctgacgcttacctgcagggtctcctcctggctctgggactggacaggtgctggctgcctcacgatgtagttgatctgccccacaatggtttgctgaagatgctgaggagatttggtctgactcagttgcaggctgggctgttgagcctggagaagaagctccaagtccttctgcatttcctccagctcaaacttgtgatgcattatgtccatgttctgagaacaggcagggccaggagggctctcgtgctgactagaagccagatgctgggatggaggaagaggtgggtgtggctgctgtgggggagggggaaggggaggtgggggatgggggaggggtggtggtggaggtggtagctgctgctgtggctgctgctgaaagtgactgagcttcagcttctggtggtggccaaactggacttggatagagggtgtctgtaaggtgggctgggcatgggctccttgctgaacatcctgtggggggacaatgcacacgggctgggaagtcagctgctgccccagccgctgggatgtgctctcctgctccacggggggctgggtttccagccagggctgcagcagctttggtggatgagggctgcaggccagctctttctccctgggcagcagggcagagcactgcagagaccccagctgctggggcaccatctcagggggctgcctgaagctgtgggctgggtgtatgctgggtggggggacctggcctttgagggaaggcgagactggggagcagtgggagcagcacacagatgaggagcacactgctggagactggaacttgtgtgaggggtggctaagagcctcttgctgagccactggagactggtggctttgataaaagggtgatgacccctgtaagcctccataagcaggagcatctgccctggacatttgtccaccttcagtagttatgcagcctgaaaatgcagaatagagagtttttcaaaagtttttcaagttgctcccaccttgctacttcctgctcctgggacaaaagaacctcattcaacaatcctgtaccaggaacagagattaagaaactcaacccttgatctcctagactcggtctagaatgctgccagtaatagcacctgtatgcacctgctttgggggcctaggatatttgagaaattagttcagcttttaccagatgctcagccctgactctgtttctgtcccactagggaaaccacaagctctctcaaatagcacccactcatttttttccaacagaacagcccaatcagactctcacaaaaagaatcaactttggggttgggagggagtatgctagaaagtagcaaagggtagagagccatgcctgggaccaatgaacaagttcccagatacaggtgtggggaactgtgtgttgagcaagtaggacggaagagagtggggaagctctaataccaggtgatacagtttggagctgtgtccccgcccaaatctcatgttgaattgtaatccccagtgttggaggtggggcctggtgggaggtgactggatcgtgggggcggatccctcatgagtggtttagcaccgtccctttggtgctgttcttgtgatagaggtctcgtgagacctgatttctttaaagtgtgtaacacctcccccttgctctgtttcttgctgctctgtccatgtgatgtgcgtcttcaccttctgtcatgattgtaagtttcctgaggcctccccagaagccgagcaggttccaggatcatgcttcctgtacatcctgcagaatcatgagccaattaaacctcttttctttataaattacccagtctcaggtatttcttcacaataatgcgagaatggactaatacaccaggtcagtgccaggcaccggcactgccccctgaggcctctaggtcccttgtgcacaagtagatctatggctaactcagtctaatgactccttcctctcattattttggtgagacttacttagaagaagtctgagctccttaaggaaaatgtgttttattcaccattggttctttggtgctcagcatggggcctaaacaagagtaggtggccatcaaaggtctgctgagttaaatcaaaggaaagagggaagaaaagaaataaacctacatatcatttgtcactttgccaagttcaacaaattttcaataagattaacagcctcaaatgaaggcagcagctggccatcagtttaacactcgttaggctgtcaacacaggcacaacttcaagctgtctacattctgcctaaagactgaatgccagcaaatgattgcagcagggaagaaaaatgcacaaggccatgaattatctgcttacatctcaactcgaaaggatatgtctgtgtgacacaaacatgcacacgcagtctcactgttgctgagatacccctgcttgtgcccacacgtgtatacctttgtgtgaccacagagacacacattcatctgtactgccatacagcattccggagagcagggtgactgtcttgtctcctcctcagcaataaaaccaatgtaacaggacatttacacagaatggtaaactcagatttcaactcatcctgatacaaagtcctatattgccactgttatttaattcctcatcctctcctcttccccctcaaaaaaaaaaaaaaaaaaaaaaaaaggtttgctgaatgattccatgaccactggcagtcccagagagtgctttctcttgggcatatgctgacctacccagtaaggtaagcaattaagtcaaagcccacagggtgggtaggcctgggtgggtgggtccaagctcaccaagagaagctagctgcttggtccagaagttaggctcccaggtgaatctgatactccaaggggagccaggatctgtgttacaacttgtctccagcaatcgctgcatctgaaacacaatctgacaacagcaccaaaggtcatttatttgggcatcttgcacctaaatgacaactccccttcccttactctttggacaagctgaaaggctcaaagtcatggccctttaacctctggtcatcctccatattctcattctcttgcaccttagcacctgtccatcctcccagctgatccctttcctcttatcaaggctcctggaacctacattcttttttttttttttttaattgagacggggtctcactctgttgcccaggctggagtgcagtggcgcgatcttagctcactgcaagctttgcctcccaggttcacgccattctcctgcctcagcctcctgagtagctaggactacaggtgcccgccaccacgcccagctaattttttgtattttgtttagtagagacggggtttcactgtgttagccaggatggtctcgatctcctgacctcgtgatctgcccacctcggcctcccaaagtgctggaattacaggcgtgagccaccgcacctggcctggaacccctacattcttatcttttcaggccttaagtgatttgtcattctccctcactacatcgttgactggcagctccattcattctaccatcacctcaatttaaaagcctagtgggggcaggcattgtctgagctccccattgctgtacttccacttgcaggtaaaacacccttctgtcctactcaatagccctcttcctctcccaacactttcatctatttctcatcactaactctcctatttatccagggctttggcaagtgtccaacttaccctgctatcctctagttaactaatgtcccaacgaacatcttagcctctcatttcattgatctcttgcatggcaaccaccttgttttcagtttagtcaccatacctagaccctattcatcatttacaaccattctacctatgagacctttaaactccaacaacccaccctggtcataacaagttcatgctctttcagagtatgttgttcaacctctccaagccctgctccttcagtccacaggacttcccagcttcctttcatttacagtcatgatatcactagtgtcctaattccctccccatcgccaactcctactcttaggtaatccagccataccaaagccatgttatctggggccacttcagtgattatgaatttcagcagcacccctcagccctttctcttgtcacttcttttcttgtcatctttctcttccactgcactcaatgaccatttaaaatctttactttggtgctacttaccaatgttttaaccctcttattatcacctcctatttcacagagaaaaaaaagacaccataaaggataaattaccccaacttgtatcccttctaccctcaaacttaactacagcattgtccccttcctgtcctcccatctcagacgaagggactgtccttgtgtttaaggtcaaccagttcactctatatccttcctcctgctttctcagtgtacttaccccaccacacacccctcctctctatcttcaacctcttctcccatatacatgtgtgcaaatgttttccaagcttaaaaaaaagtttcccccaactctgccatcttctcaggctatgtttttatttttcttcttttcacttctgtctctacttcgtcaccacccatcctcagtctcctcattctagcttttgacccttctacttcactggagcttctttcagaagatagcctgattcccagatccagaggctgctcgtcactattcatcttctttcacccatgcagcattgtcaaatggaccacttaaaattggaaactgttcatttctgtgtaccacactctgttttgcttctaacctctgaccattgcttctcacctctgaccactgcttctcactctcctccagtcatcatcttcctctgtctatgctgaaaatgacggtattccctgggttcctgactttctctcttcttgctccacacactcttccaaggtgataccactgatttcctggtgactcctacatctccttctccaaaaccaacttttcttctgacttccacacccatatattaaaacggctttttaatggtaggtagcttggagttggttttggatgcactacaggcaccttagattcaaagtattcaaatataaactccatcgacttctctcaaaattcttgctccctctcctgggtgctgccgtcctctcaagcctaatacttcaaccttatctccaactccttttctctcagacccccgtgtaaaccccagtaactttctatgagatgcccagcacactgctcatgtccagggtaatgtctgaatcaattacctatgacaaagaactacagactttcccaactgagctacctttgggagggcaggaccatttcagcacctgtgtcctctttgcactatgggatttggtaaaagatggtgtttacttactaacccaaaagcagtgattgaatttgaaggatggatggagctgctatgttattcctccttccatcctaaaaagaaaaggcacttccaaggactgcctcattgcccctctgacaaaggggatgctctgataagcttcaaggacaggctgaggagttgggagattcctcttaccagctctttgctgaaaagaaaagggacactggttttgctgcagacagcccagttgatgaaattctgcacatgctcaaactgacggttgagaaccatgatgctctgtaactgctgttccagcttccgctttctctcattagtaatcccctgggtacagagagaagacagagtccttgatcctgttactggactgtaatccacctgcttgggaagtctggtggcttgtgtgtgtcactgatggaatcagatgagactacacccctgagaggacagcagggcagagtgttgccatgggatgctggctgatggaaaaggggagggggagatggtgggagattttatagtgcaaatatggaatgggtaataaatgaaagaggaaatgaataaatgtctacatctcttgggcataaattggtgaagaaggtggtttgtttcatgactttctcttccaagactataaccctgagcagttaaggatggaagctgcctaagagacatagcatcaaaaatcagtttgaactgattttctagcccttaatgagccaccctcccaaaattaggctgacattttaaaatacagggagcagcacagagctatggaagctgcatatctgaattacagcctaggcttccctaggtcctgggactagcttgatatatggatggtttctgaacccaaccatctgatccatctgtctatacatacctctaattcctctattagcccattggcctgtttgttcagctcattcatcagaaccatcttggccattttgatctggttttccaccttcctatgctgatgcttcacttcaaaaatcctgtaaacacaatgggacaaaccatggtaagctttcctcatggactatatgaagacgaagagacagcaaacataagaaccaacttggaggctgcctactgagatcagggcctagcagacaccaaatacaaaaaaaagagagccttcctccaccatcccaccttttgtacaaagccccacttgatcaaagttcagcttggttttctctaggtaaacctcaagtctacaccaaggtcaacccagtagcccaccagttgacacagcactagaggtaggaccaaaagagaaagtatgggaataatttactgtaatttgttgtgtttaaaaggaggatgctccaataaatgtcgccatgaggtaaaaagaggcagaatgcatactgcctcagtagtttctgagggccggggggtgttgggggaatggagagtgactaataatgtttatattattggcataataacatattatataataaacatattatataataaacaataataaacatataattatataataaacaataaacatataatataatgtttattataaacatataataatgtttatattaatgtggcttctttttggggggatgaaaatgttttaaacgtagacagtaattatgtacagttgcacaattctgtgaatatactaaaggccactgaattatacatttaaaaagaataattttatgatacgtagattatatctcagtaaagctatttttaaaaatttaaaaagcatgggcattgaagtcaccacagacctaccatctaaacccagcacagtcactggctagttgtgtgatctcagatgagttaccaaacctctatgaacctcagtctcctcatcagtaaaatggagaaaatcgctaactgaaagaatggcaagaactgaacaaaataatgcatatatgatacccaacccagtgcctgacacatgaggtgctctcagcacctaccacttcctcttcctatgtaaaataccaatgatttcatgtgacttgtagatttacagagaacacacagggaaaggggtgataaagcacagattgcccctggtttgttccaccctcataataagcagcactctcttccctagtgtctgcttggtacccttgttctcaagcaccgacttctggctagttcataaggcatattctttgacccagactcactctgatcatcctgacctagcttggtctcagccaccaagggatgacttaatgacccctccctggccctgagacctcaaaggccaagacatatgccttctaggacatatgcccacatctgcttaaccacagttcctcttcacaggcactacatctgacggcctggtgttggaaccctgggtgtgcgggaacagagcatttccagcactggcaaggcactagcctgtgctacctgtcctcaatttgctttgcagatgtctgtagactggatttcttatgtgccacctgtgtagtcacaccttccagaagcatcctctggttttgcaaaacttcttcaacatgtctgcacctaggggatgaggcagagaaaaagctgagaagggctgagtcctactttgagcatgccaaccaagcgggaatctccacagggaactgtctcagccagacccatggaagctgtgatgacttctagggaaagtctaaggcaccacaggctcttggcccattaggccttttccagggaagtcctacaacaggagcagagaaaaacttcagcccaggggctgcaggttggcttgggcagggagaagattctgatgcacggggattcccagagctctcacaagtaagaaatccagagccctccccagcccatttcaggcagtctgtcagccccacctgtgttctttgtgttccaccactaggcagctatggcaagtgagcatatcacatgtctcacagaatagcttgagtacttcctgtgtgtgtagaggacaatacaaggtgaagtctccgggaccaccattcactcctgccagagaagacagagaaagtgagcttctcttgctcaggtagacaaacctctcagttaagctttgctgcacagctctcagccttcagaggacactgcagaaatacagagctcgggggaagtgttataaacaggagatgactctccaggggcacaaggaggattttgggctgagcttggctggatttgcccagttgtccagaaatagcacaccatcaagcccaagcatcccactacctgccagaggctgaggaaggcgcttgctactactccacatagatctcctgcaaaataatgaatccttcacaattaaccttaacctgttcattaatcaggattctgtttttaatggagctgaaaccagctatccagccttgccaggctccaggctagatcacgtggatcatgaactctggttcctgtggatttgacagttgtagaacccctcccacaattcaagggccttgagaaaagactttcaagaagattgtcatttaaaacagatggtggctgggcgcagtggctcacgcctgtaatcgcagcactttgggaggccaaggtgggcggatcacctgaggtcaggggttcaagaccagcctggccaacatggcgaaaccccatctctactaaaactacaaacattagctgggcgcggtggcgcatgcctgtaatcccagctacttgggaggctgaagcaggagaatcgcttgaacccaggaggtggaggttgtagtgagccgagatcatgccaccgcaccccagcctgggtgacagagtgagactccatctcaaaaaaaaataaaaataaaaataaaaataaaacagatggtgctgggtagacaaacaaacaagccctaatccagactaagttaatcaagtaaataaattagaagggtaacatgattactctagaggggaaaggcagggagctcagccagcttccacaataattcaacactttcctctctataccatttcatccacactcatccacccccaccatcaacagggagggacgagagtgagtcacccctttgactctgaaggagacttcctttgggaaaggctctgagactgtccctaccttctcccccagcaagaaaacaagatcggagagctattctccagggatcttagggttcagccctgctttagggcatgggagtgggcagggagaggtgggattggtacctggagatcccttctgggcccgaggaaagaatgggcccccggggacagggctgtgtcggtgttcctctgtgcaagagctgcacagccagcgattgcagtaggtgcagaggatatgtgctgccctcttctccttgcactcagagcagttctggaagcagagagttctggagttactgatgttatcctcatttgtgtctgcctccacaagtggtaaatgctctaaagacaggggtcctgcaggcctattcctccaccagtttggagtgtaacctattctgcagagctgtctgggagtaacatgccggggcttgtggaaggaagcatcctttgtaaccaaaagaacagtggctacttcaggtatggtggctcacacctgtaaccccagtactttgggaggccaaggcaggaggagtgcttgagcccaggagtttcagactagcctgggcaacatagtgagaccccatctctacaaaaaatacaaaaattagccgggagtggtggcacatgcctgtagtcccagctactagggagactgaggtgggaagatcgcttgagctcaggaggtcaaggctgcagtgagccaagatcgtaccactacactccagcctgggcaacagaggaagaccctgtctcaaaaaaggatgaggaagaaggcaaaggagaaggaagaagaaggaggaggaggaagaggaggagaggaggaggggaaggagcagaaggaaaaggaggaagggaaggaggaagggaaggagggagggagggagggaggaggaggaggagcagcagcagcagctgtctcaggggctgttcacacaagtcctgtgctgaagctaaggacacccagatgcgtaagccaaggatctgatctcatgctatccacagcacacaggatggtacacattaactgagtaatgctgtaattaaaaggatgcaacacatgctaaggaagcaaaggaagccttcctggaactcagtctaggagtggctaggaaaggttttacaaaaaggaaacacttgagctggatactgaatgacaagtaggttcaccaggcagataagggaggaaaatgttgtaacagagggaaagcactggcaaaagcaggaaattcaatgtgcttcagagaggagaaagcccacatatgggagtacacagcaagatggtcaaatgcaaccaaggaagggcaagtatagaccagcgttcagagttgtgctcccacacctgggctctgcctgatctgagggtacctaggcctctcctagtccaaatgttcattcatttcgtaagcaaatatcttgcccgggctattataaaacatcaagagaaggggagatttggaaaagttggcctatctgtgtctgaatcacagaggccaccaaactgatgtgaattctgaaagttctactaattaaactatgaattccttgaatgtagagtatatgggtcgatctccctaatatccagcacagggtctggcacatgtgagacattcaacacaaatcagatacaggaacaagtaagtaaattagtaaattactaatttactaatttaccctagtggaaagaggaacagaagggctgccggccaataagtgataaaaatttccttaagaaactcaggaaaaaggtgatagttgttaaatacaggcaaggttaataaacccatttaatccaggctggtacatgaatttcaactcaggatgattaaaaaaataaaacaaaagcccagtactggtatttttcagcaagagctgtaagagagagaaaaataattatatagacagtaagcaactcttaatatatcttaacttacattcaccttctgctaaagggattgacacaaaaaaaagtcaataattttcacttaatagaaaaccccctcattgtttcccccaactcatgcatttttattttcttctagatggatggatggatgattaggaaaactgatggagaagtaacaaatcagatgatagagtgatggatggatagaagacttatggacaggggcctcacagatttctgaaaaagatcagctgcttctttccttgtcctgacttaccctggccatcttgggttgctcagtaggaacacaatgcagaaaaaaatgttcagttacatccctggtaagatatactcgttcacacccaggacaggagatgagctctgtgcaagaaagaaagatagcagagtcagggcaacatggctgattataactaaggcctggacataaggctttctaatacacaacaccaagatacatggcaatacccatgtgtgccaaaatgaactacacttgatgccatagcctgcatttagtatgtgggtaccctgaacatgaccatcccattggggccttccctacagaccatctggtctcctcacattcttgtctttacctggtcctaccttcctccctgccccataaaccatgctactacaggcccaacgctgctttggttctgacaatcaggtgccttcttgctgctcccattcctcattccacatccctgagagcacagctcccatcactagccaagatccagagtcagtttagtctgggcacagttccaggtcattaaggttaccacatagcaggatgacttggaagatctcgaagctaaagcctccagaaggctttagtcagagaaaggcaaggcctccctgcccgctcatctaggaggtatttttctcttagtacagcatataccagtcagtctgcctctgaggctcagaggtcttttggagggctctctccccatagaccaagttagatgcatcatatatatgtatattttacctatgaacagcttgacctacaatctctccccagagaaatacatcagtctctaacatattcttcagcatagtgggcttctggactataaaagcagcagaagactcccaccctggagaccacagtgattctgccggcccaccgcaagggcagtcaacctactaggaacaagaaaatgagcctctggagtagggcaaggtacctgtgtccagggatgagggtgatctggaaaggggttggctatggcagtgaatgcagcagtaccgctacaatctcctctgtctcatctcttcaaaatacgaaagaatgatatgatggcagttgctccagacttatagtcagacaaatgtaagtccaaaataccaggcctaccagccaatgaccttgggcaaaacacttaatctcacttaattgccctgtaccccagtttcttcatatgtaaaatagggaaaataagagttgctgtgcacattaaattagataagacttcagaaatcacatggtcctccatgaatgtcaactttggagttcaaaagattcctcatatcctattcacagtaatgcaataaactcaattaccaactctctggtgacgaaagttagtttgagtggtagattcaaaaaatggccacaaattcttcccctccctgcatccatacccttgcaatcctaccatcaaaaggtaagactctccacgagcttcaggtcagtgatgagtttttaatttttaaaagaggtaggaccctttgccctttgaatctaagctcaccttgtgactttctttggccaacagaatgcagcaaaagtgacaagttttccaagcctagacctcagtggccttatataattctgctcttgttcttagaactttaagagtgccatgtgaaaaatctaacctggcattgagactgctggaagatgagagatcatgcagagaaagttctcagttgtctcaggcatcccacctgaggccatcatagaccagccagccccaactaacccactagctgaatacagtgcaagagtgaacacagttataattagctaagcccaggccaaaccagaagaattacccagagaatcccagcccaaacagccaaactgtagaatcataaaataaataaagtttagttgttttaagcacaaagtttagaggtggcttgttatgcagtaaaagctaactgatacatcccaggaaaatagaaatccacaaaatcatgaaaaataatagtttaatactccctcaccccaccaaaaaaaaaaagaaaagaaaagaaaagaaaaactttctgagtttttgcagagccatgggtgttaatgacaggactgtatctggaatgtcctgcatattctcctgcctgtcaagaacaatggccagaggtggagaaggatgctctccacaggtgacatcatccaggggaataaggctactgtccctctcttccacttggctcaccctgaggtgacctcctcatctacagcaggacagaaatgctgctctaattgttgaaaacgacttccacaagacatcccgggtaccagatgcccaaacatcagtcattgtaacatggcctcacgagcagaatgaaaaaagagaaagaactgaataggtcaaacaaggcctcatcacacatcctctgctcccttggccttaaagccaaagtcctcagcttggcattcaatgccccttgtaaattgaccttatctctctctaatctcatctttagctttgcctaacatacaacctgtgtttttgccatgcccaacatctctgctatctcttgaatacaccagacttttgcatgactctgtgtctgtgaaaaatgctgtttcctcttcctgaaatactctttcttgcccctctccttttcagataaactcctattcatcctttcatacctgttcaaatgttccacctttgagcagcaagatcaatttcccccgggatgagttaattagtccctcttctgggttcccgcagcaccctgaacatccttccagtacaacgaatatcacattgcattttaaatacctgttcatatgtctgcacacaaaaataaaccacagttggtattaaaggatattacctggtttttagcagattgaacaattatagagtaagtcctcacttaacatcagtggtaggttcttggaaacggcaactttaagtatgatgacatataatgaaaccagttttcttcatcaatgttataacaaaaggatgtttacttaaggaactgctgtacattgttttgcttaaaatcacagtttttaagaatctagttgatgatggtaaatgaggactgcatttctgttttgtttttgtttgtttttgtttttttttgacgtggagtcttgctctgtcacccagggtggactgcagcggcacaatctcggctcactgcaacctccgcctcctgggttcaagcaattatcccgcctcagcctcctgagtagctgggattacaggcacctgccactacgcctggctatttttgtatttttagtagagacagggtttcaccatgttggccaggctgatctcgaactcctgacctcaagtgatccacccacctcagcctcctaaagtgctgggattacaggcatgagccactgtgcctggcagaggactgcatttttcgggagtttgtgtgttccatgtgtactccttgcactcacagcactgaaagtagtaagaagccacctggaagttttctggaaaaaaagccagtgcaggtttataaggaaagcagaggtgtggggcttgggaaaagcttttaattaaaaaatatgagttctaggcccagggctggcagtatctaactatgtaaccttgggtaagtcaccccctttcactcaaccttactttctacaccattaaaatgagggaataggaatgcaggggagtacaaattatccaacccatttactctgcctacagcagccagacgtttttttttcctggaggccaggcacggtggctcatgcctgtaatcccaacattttggaatgccaaggcaggaggatcacctgaggtcaggagttcgagaccagcttggtcaacatagaaaaacccagtatctactaaaaatacaaaaattagtcaggcgtggtggtgggcaccctgtaatcccagcctcgggaggccaaggcaggagaattgcttgaagctaggaggcggaacttgcagtgagctgagattatgccactgcactccagcctggccaacagagtgagactctgtctccaaaaaaaattaaaataaaaataaaaaattaaaaaaaaaatattctcttgggcaagataggaaggaacagacagccaaatggcaccctggctatcagccttgtcagaaagtcagggaacaagctcgtagttgaaaggaatcctggatttaagagattagccctctaagaggggctgtgcagcaaagagcagaggtggagaaccatcacagtggtgcaggcactgtcccagggaggctgcgggccccagagtggatccaaaggacatgcactccctttgtgtcacaacacctttgtccagaaattcttctcttccctcacaaagtccctaaccccatcaagctgtgtcaaccttgactttttattatttttaaagagattctccatcttttaatgaggatatcaaaacaaagttttactttagacaaggcatatatcaactcttagagctatgtataatcaaacatctacttaacaatatttaatattagtttagttataaatacatatttaaatcacactgcacataaaatattatttagatatcatgcttttttctattttattcagttaattattattcaaatgacagccctactcttgtgtttcacatataagaacactgattctgagaaatatagagacagggccccaagtccacatgattatcctcaggagatgtggggcttctgcctccagaatgaggaagtcacagacaccagaggtgttcctgagaacttaggagcctagcagagcagctctgaaaacggaggacatttagtccatctgtcacaagtgcaaacacttctggtccttgagaggtgtgggataaattttcatgtgtacaccaccactctctgaaccaggcactttacatgtgtaaaaaattccccaggcgaatacaatgtacaaccaagtttgagacccagcaccttagagagagcatccccttcccctgtggctgagcctgatagctgtctcctgtatcatgcagctgagaaaggcaggctcaccccgctttaaaaagagactctaagaagttaggaaagactctgaattcagctgtgatgtagctcccctctggcagagaaaagggcagattcccaacagacaggtagtgacctgatatccctgtacccggggattggcactgagctgggagccagactcccacagctcaactgcaggacccatgagcaggcctagagtgcagcctgaggtttggcactaccaagaccgctgctgggacctagaacatgtgctgagcctaagacttagtgaggcagcaaggaagtggggcccacacatgtctgtttcagacatgaacagcagggccaaggcaacacggacaccagagaggtaggggaggagagaaatcccaaagaggtctcagaaagctggtatcgggtcagcttaggccaccaagtgaggacacactcgttgcataagcctgaggccaatgctaagcaatcctctgagggttaggaagacttcattccacagctcttgtccagggctccaggcaacttgaagctggggtccgagctctgatcccaacagagcaatagcatccactggaggagcctgatgctcctccgctagttccaacccgtagacccaaagctggacagagcttcactgttcatccagccaattccccaccacacagatgatgacatggaggccctgggacagggaggagcttagctaaaatcacatggcccttgtataacataggtgataccgtgaactactaagcagtccctgattacctctgtagccacaggtaagatgctctacctccctatgcctctgtcagacactaagcaacgagaaaaaacactctagttgtatcctctggcaggctggacatcctcaccaacagtcctgccctcccacccccgggcagccccagtctactgagcaccaggagcaccagctaaggcccccaccacacagcccctgaaggcttcctccaacccaccactcagagcagcaccaccttcaagaaacatgttgcacccaatccccaaatacccagaccctgctagaaagacaaatttttgtccaagtcacccctaaagtgactgctgcttctgccccagctgccagcaggcttatctgtggccctgctgccgtgattagggcaacactgggagagaagtcagagaagcgacaggtgagaccaccacaggtcccagaggatggcgcttaccaagcgcccaggaacacccaccctgcatgctgcagccaggcgggctgcaaggcctaagcctcggggaatggatactggatagggtaaggggagcagcctggatcctctcctcctttctctgatgcatcctcagccagggctgcatttctctagctcacctgagatactcctgcaagaaagagcttggttgactcctcctgtttctgtttatctcgaaggctctgcagcaattttcccaaactgaacagcaagagggagacctcaaagaggcgactctcttcctagctgcatctccttcctaatcctctgggtgccttggaatagaagctcagaaggaagaaaacgacattttcaactttcaggaactagctctgtcgccctctgcacagctcgggagacagcactctcagccttttaggactccatccaaaaatccttcagccctccatgttccccaaaatgacagtgctcatgtgtggctggaacctgccccgatccggcagctcatttaaatagagctcatcacaacaacagtgttggtggtgaagtgagtagctgcaggaccctggggaccccctgtttatacgtaggaagaatgatgcaatctgggtatcaaaatagcaatccagaatggaataacaggctcacgcagcagcggtgcctgcacagccagagctcaagttgacacactctgtcagccccacactgctgcagcacgcagatgccaggcacacactctcaccgcatcattttaaaaaacagcaggagcccaagatatccctccatgcccccggcactgaaggagggtgtgggggggccttcaacagacattgaaatctgtctcctacatactcacctgctcctgccacttcacctgaagtccttatcctgtgacgtcacagtcagttgccatagtgaccaattgtccgtcacaagcagaggattaggacttcggatggagaagacacacatttacgatgcacaaaggtcctgggaggtctcccttggcagttaactctacccaccaggaagatccagtcacacacaagcagggagggaaaaagggaagaatgaacagggttgactggaggagacattaggatggggcaagactacaagtacagcataatttcaaaagcacagagcaaccagatgagggggagtggcagggatgtgcttggaaagaccggaaggagagtaagctcctgaagggacctgaatgctaagctcaggagcttgaccttcatcctaaaataaaaggcagcccaaaaagtttctggagagtgactgagctgggctttatgattatcttgatggactgaacacagggaggtcagggtagttgagcattaatgggaccctaaataagggtaaaaatggaaaaaagcaaaagaagactcatttcaaagagaactgacaggacacaagcaaattaggatgttggggctagtggtggtgtgtgaagaacaaggaatcaagtggaggggctgtcatgaacagaggtaggtaacaggaggaagagagcagtggccaaatctcatgttatctataccttcctttctctggcatccttgccctcttaatatcaggcctcattctgccttgcctggaccagtgatgccccaatctggagagcttgttagaaatcctgaatctaccaaacccaaatctcttgtgtgtgggtgtgggactgggaatctgtatttttagcaagcatcacaaacaattcttaggcattcagaccagcactggttcaaggcccagcaatcaggaaccaatggcctggacagctgcggttgtccagcaggtcttcctgtatccagtcctgtctcctccaatcattcttctcactgggccaactgaatttgtttttttcttgtttgtttgtctttgtttgttttgagacagtgtttcattctgtcacccaggctggagtgtggtggcatgatcatggctcactgcagcctcaacctcctgggctcaagtgatcctcctgcctcggcctcccaagcagctgggactacaggcgtgcaaccagctaatttattttttattttctattttttgtagagacagggccttactatgttgcccaggctggtgttgaactcctgacctcaggatatgtgaccatattccactgatcaaaaaccttcaatggctccccactgtccacagaatagcttaatcaagatccttcacaatttggccctaaatttcctttctgaacagaatccccacttctctccttcaagcatcccatactccagccaaaattaactccctcctgtttctaatatttgccttcccctcccctgcgtgtgcctcatcctaacactattccctacctgggagtcccttgcacatttttctgactctgcctggttcctctacagctattcctacttggtgtcacctacagattcaaaccacccaatttccccagacagaacctaaaacaggggtcagaaaaccacagactgcctgttcttgtaaataaagaatacagtaatgcccattcatttccatattgtctatggctgccttctgcttttctgctacaatggtagagctaagtagttgtaacagagactgtatgacccacaaagcctaaaatatttactatctagccttgtgcagaaagtttatgacatctggcctaaagcaacagctccttaaattgtgctagcctcaccctttggagtttaattctgattacggggattttgcttgttccaagcccacgtccatctttgtgaactctaattctgataactgggtcacatctgagctggaccttcaagtttgtgtaggatgtttcaagcaagaaaaggcatttcaggaggaaagaacatcataaatggagaattatagatatgaaagtgtgaggtctctttggaaagtcttgtaaggctacaacatatagagaaatgacaggaggtgaggctacagcattagtttgggaccagattatgaaaagacttggaggccatgctaagtgtctgttctaaactgcaagcaattggaagcctttagagagctagaagtgtagtcccggagtcagagggagtgatcagggtcaaagctagaggatttggaagcataatcacagtagcaataagtgaagtgacgtcaggaaaaatatcactgtaggaaagaatagggaataaactgaggtcaggcagatatccagggcctgtgaggaagagccagacagccggcctgagccaagagtcagaatctggctatgaaagccaggtgactggctggggctggagatggatgcacgatccacagccttcagagcccatgctcctaggaaccacctggctgtgaaacaggctttctgtgccaagaaagtacccacagtataatgcaaaaagtacaggtaggatgagtctgggctcatttcatctgacagaccctcactgaccgaggtagcacctctgtctcttttcatcccaaatcttaaagtcaatccaaaaactgatgcactgacacactccatgcaaaaccactgatcccttttccagctgggcctggagacagagagtcatttggggaaccaagggcagcatcctattctgggtctgtagtttctactggccctcaagcccaggaaagccctggactgtcaggcaaaggagctggatttttttcctggctctgcaagtgaccgattatgtggttttcagcaggatcctagcccttcctggactcctgatgcttcatctatgcaggagggattggagattaagggccttccctgccttttggcctccacagcactcaaccctaaccactcccccttaaatcagaaagttccagcagacaagaggcccctcaaagatcccatccatcaatcacagccatctcgagctccctccctcagcaaatctgttctagctatagccttccaagcagcactggcagcagcaagcacctcccccaaaacacagcctgcctcctttccattaccgggggaattgctctcccagtaatgggtcctgttctggggtgccagtgctattcccagggccctagagagccaattaaggcgaggaaactgttcgtgaactaaaaagccactccactgacagggctccaggctccagcttctgcacctgctgcacacccagctcaccagcctgcccttcacctgggagacttgagttactgcccacaacagaccccacaaggctggacacactgcagcacctggaatgagcaaagagtagtcacccacctcccaggctcctacagctgagatctcacctctggcctcccattcccacccaagaccattagaacccctgcagctgagctgctcattaagataagtgtcatttccctctctgattctaaggttgtagcatcttgcatcagttccccctctttggatattcctaaagtcccaaggcctgcccaccgagggaccgtgattgctcctcctttcagcattagtagtgttcggggatgctgtcactcttcactagcttcaagaagcatcgggctatggtagttatttggtgttcttaaatctcattaagtctagccctgaaagccagaaagggcttagaattgcccagtcaattagtgctagtgtccaggtgagctctagggtctgtgacttccagctacatcctcaactttgaaaatgggaaaaataagatactaaacaagtagattctgaaatctgtatctaagtatcaaagtcttccagccatgatttgtcttttaattgatttgaagagaaacaataagtaatgttccttttcctcacatggggaaggaaatatccaatcaattccctcttccctttcctaaaatgacaaataaaaccacagcaactctgagaaccttgaagacagagccagcatatggtaagagtcagtttcagggatgttagctcccttcagagcttgctacatttacttaaagtataattttggtactcagtggccaactttccagacagaatttgacctgggaccattcttaattagccaaaaaagcaaatagccccaagtagatattctcattggctgagaaaatccaattccaatagctagcatttgtgtacccagccatcccactgcatggctaggccactgtattctcaccacactcctacctttgctctggtccccatcattagcttttgaagatcttgcccagctggtctcctcagtacctgagaggtgacgcagacccatcttcctagttgctggggagaatctcagctaggctgtggctgtattaattaaagatttgcacttgatccagcaattcaaatactgagtatacaatagtcccccccttattcatgggggctactttccaagatgcctgaaacagtggatagtaccaaaccctatatatactatatttttcctatgcatacatacctatgataaagtttaatttgtaaattaggcacagtaggagattaacaataactaataataaaatagaacaactataagaatatactgtaataaaagcaacatgaatgcagcctctactgtctcgctctctctctcttccccctgcccccccacaaaatctcttaatattttcaggctgtgagtaactaaaaacttgaaaagcaaaaccttggatgcggggggaggggactactgtatttccaaagaaaatgaaatcagcatgtcagagacatacctgcactcccatgttcattgctgtattattcacaatagccaggacagggaatcaacctaagtgtctactgatgaatggataaagaaaatgtgatatatatacacaatactattcaaccattaaaaaaaaggaaaacctgtcatttgtgacaacatggttgtacttacagcacattgtaagtgaaataagccaggtacggaaagacaaatactgtataagctcactcacgtagaatctaaaaaaactgatctcataaaagcggagagtaaaagagcagctaccaggggctagagtggttggcagggggcaagggtagttagggagatgttggtgaaagaatacaaaatccaagttagatagcaggagtcagttcaagagatccattgtacagcatgataagtatggttaataatatattgtattcttgaaagatgccaagagagtagatgtaaagtgttctcaccaccaaaatgataactatgtgaggtgttgtatatgttaactggctagatttagtcattctgcaacgtatctatacttcaaaacatcatgttgtacactgtaaatacatacagttttacatgtcagttaaaaatttttttaattaaaaaatatttatatttgctggctcaggctgcaggatttgttctttcttcaaagattttccatggactctcctcatcagtttggtattctaagtgagcgtggactctccccgtgagcaaagtgccacaatgtcgatcgcaagctttgaagacaggtgaacctgaatttgaccttaccgggcagtagttgttaaccttagtctataaatatcccaatcctcatatttttcatctataaaatgggaatactaatacctactttataaggctgctgtgaagtttacaaaagataatgcctgtacagtgtctgccaaccagtaagtgcttgataaatgcattttgtaactcccacttgaagaacaaaaagggacagatcacaagtgaaaaaagccttctacccaggctttattgattaagtcatttattctataaatattcacttaagacctcctctcctgtatcatgttctgtgttgggctgcggggttacaaacatgaaaggcaccgtctggttgaatgagaagatgcctacctcatgacatcccctcagttccaagccccagagcaggagtacagccctggggaggctctgttgaagaattagagttgaaaacaagctggacagaccctgagcccaggcacagcccctcttccattcaacacagcaactgctcggctctgcccagcaagtaggagaaacaggtttatagaaatgaactcagccccatgtagcgtggctccatctggttggaggcattgaagctaggaacttgtttattcctcagcctctatccgcctcccctgccatccctctaccggctcccacattttactttaaaaaaaaaaaaacagatttctgcccagattcacagaaagaggataaacgttccagaaagcctgtgttcctactctgctggacaaactgactgcactaaaaactctctccaaacatggcttctcaaactacagaccagaaatctaagttcaggtattaggtatttcactaggctagccagagacaggtgacagctctgcctttcatcagacagctgatttgggagccattcttttgacccttcagaaaatattcagtgggcaactgatatctgccagtcctagtacgtggacaacttacctgagttattgatcctttgcttgaactttaaacaatcttctcttcactgtattattatcacctgtttatttggctgtcattcattagactatgagctctttgaagtcaagggctctgtcttttcatctctgtaccctaaatgccatacagcctggtacacagtagtcaataaatatccatgggggagagacagacacacaaaccaacaaataccacaccacatagggtcctaatagttccaagtaataaagaggaagttaagccaggcacggtggctcatgcctgtaatcccagcactttgggaggccgaggcgggcagatcaggagatcgagaccatcctggctaacacggtgaaatcctgtctctactaaaaatacaaaaaattagccgggcgtggtggtgggcgcctgtagtcccagctactcaggaggctgaggcaggagaatggtgtgaacccgggaggtggagtttgcagtgagccgagatctcaccactgcactccagcctgggtgacagagtgagactccatctcaaaaaataaaaaaagaggaagtttattcaactttttacccataaacgtaaatgtggaaggtaaccatgacccagccagactgtaagacctactaaagaatataagaagctgggcgcagtggctcactcctgtaattctggtactttgggaggccgaggtgggcagatcaccagaggtcaggagtttgagaccagcctggccaatatggcgaaaccccatctctactaaaaatacaaaaaaattagctgggcatggtggtgggcacctgtaattctagctactcgggaggctgagagaggagaatcgcttgaacccgggaggcagaggttccagtgagccaagatcgcgccattgcaatccagcctgggcaacaagagcaaaactccgcctcagaaaaaaaaaaaaaaaaaaaaaaaaaaaagaatataagatgccacatattatacatattatatgagaaattgactctctggttccaaattaagcatgtttccatctaacaggcttttttcccctatttcacatgttctcaagttctaaataacagcactttttgtttttttacctttcttaccttctttctataaacgaggcatagtacagaaggctttatgtatatgtcctcatttcatcttcacaacagtcctatgagttagtaactaccaccattaaccccattttacaggcaaaaaaaacctcttgggcagagagatgaagtaacttgcctaaattacacagctagtaatggcaggcagatcaggaatgacactcagatggccaaatatactgacaccaaagcttttgtttttattcttcattgcaattagaataacttggcaacaaatactatgattcaggtaattgtcatacatatagacagagatggagtctcactttgtcgcccaggctggagtgcagtggcgcgatctcagctcactgcaacctccacttcctgggttcaagtggttctcctgcctgagcctcccgagtagctggtgtctgccaccactggtacctgccaacacacccggcaactttttttttgtatttttagtagagacagggtttcgccatgttaaccaggctggtcttctcctgacctcaggtgatccacctgccttggcctctcaaagtgctgggattacaggcatgagccaccaaagcacccagaccattaatatgaatttaatgttctccttttagagtcaaacacagccttgacacatgcataattcattcacattaaaaaccttaaatgagatcaaagacctgaacttaagagctaaaactataaaactcctagaagaaaacagaggggaaaatatttatgacattggatttggcaatgatttcttgaatgtgacaccaaaagcacagacaacaacaacaaaaaacatagataagttggacttcatgaaaatttaaaactttgtgcatcccaggacactatcaacagaatgaaaaagcaactcacagaatgggagaaaatatttgcaaatcatatatctaataagagattggtatccagaatgtgtaaggaacttctacagttcaacactaacaatgacaaccccattaaaaaatgggcaaactgaaactctgtacccatcaaataacaactcaccattcccccagcccctagaaatcacctttctagtttctatctctacgaagctgactactctgaacatctcatgtaaccagaatcatacagtacttgccctgttatgacaggcttacctcatttagcataatgtcctaaagcttcatccatgttgtagcatgtgtcagaacttccttccttattaaggctgaataatattccattatatgtatataccacattttgtttatccattcatctgttgattaacacttgggttacttccaccttttggctactgcaaataatgctgctagaaacatgggtgtacaaatatctcttcaagtccctactttaaattcttttaagcatatatccagaatggaattgctggatcataggataatttgattttcaattttctgaggaactgccatattttccacagcagccacactgtattatattccctccaacagtgcacaaatattccaatttctctacattcttgtcaacatttattattttctgggatttttttggtttgtttgatagccatcctaatgtacttgaggtggtttctcatcatggttttgatttgcatttccctagtgattagtgatgttgagcattttttcttgggcttattggttatttgtacttcatctttggagaaatgtatattcaagtcttttgcccattttaaaatcaggtttttttttttattgttgagttgtaggagttctttatatattctagatattaacccaacaatgctggaactttttttttcatggcttaaaacatcagaagtttattactttcaatgattccatgggttgactgagtagttcttctgcttcagtgatgtcatctgggatactgagatggcccagtccaaaacagcctcactcatggctggcaactggtactggttgtcaggcagaaacctcagttctactctccatgtgactgcctgggcttgctcatagcatggagattggattccaagatggcatattccttttatttttatttatttttttttttttgagatggagtctcgctctgtcgcccaggctggagtgcagtggtgccatctcggctcactgcaatctccgcctcccgggttcacaccattgtcctgcctcagcctcccgagtagctgggattacaggcgcacgctgccacgcccagccaactttttgtattttagtagagacggggtttcaccatgttgcccaggctggtctcgaactcctgagctcaggtaatccgcccacctcggcctcccaaagtgctgggattacaggcatgagccaccgcgcccagtcccaagatggcatattccaagcagcaaacttagacattgcagatctcctgaggtccagcctttgaagttacacagtaacatttctgccacattccagtggttaaagtaagtcatagaacaatacagattcaaaggaaacaaatagacttcacctcttggtgggatgggtggcagaaaagaattgtggccatctttaaatccccatagtgatgaagggcaccatcatcaaagctgacaaaaggtgccaccactgctgcagaggcccaatatcatttggtccaaagcatagactgccttatgttgatgcattgagactgccatctcctattgctgctaataccaacagtgctatttaccattactgaagaattacggtaaagtcacaggcaccatccttcatactgtcaatactgctgaaatcaatggtaataccttgcatcctcattgtccaacatgattttaataaaactcctttagggccaggtgcagtggctcacgcctgtaatcccagcactttgggaggccgaggcaggcaggtcacttgaggtcaggagttcaaaaccagcctggccaacatggcgaaaccctgtctctactaaaaatacaaaaattagctgggtgtggtggcacatgctgtagtcccaggtatttgggaggttgacgcaggagaatcacttgaacccaggaggcagaggctgcagtgagccgagatcgcaccactgcactccagcctgggcgacagagtgagaccctgtctcaaaaaaaaaaaaaaaaactccttttgggattttattcacaacccctagtggcagccacctatcactcaggcctcaggtctgtccaagggctgtggggccagggtcagagattgttaagcaacactgcattaagcctgagggactaacagtaatcagccctctcctctgcccttaggcactggaattgaaccaaacctgaccatctcatttatttcttttaagttttattttaggttcaggggtacatatttaggtttgttatataggtacattgtgtgtcatgggggtttggtgtacagattatttcatcacccaggtaataatcacagtacctgatgggtagttttttgttttgtcttgttttgtttttatttatttttttttttttgagacagagtctcactctgtcacccaggctggcatgcagtggtgcgatcttggctcactgcaacttccacctcctgggttcaagtgattctcatgcctcagcctcccgagtagctgggactataggcacgcaacaccatgcccggctaatttttgtatttttagtagagatagggtttcaccatgttgcccaggctggtctcgaactcctgacctcagatgattcgctgccttggcctcccaaagtgctgggattataggcgtgagccactgcaccaggcctgataggtagttttttgaccctcactctccttccaccctccaccctcaagcaggtcccagtatctgctgatgccatctttgtgtccacatgtactcaatctttagtttccacttataagtgagaacattaagtatttggttttctataatgctggaactttcaagatatatttatgattcaccatatttataaatttaactcactggattttcaagagttctttaagtaatcaggaatgcctatttgctagataattggagtacttacaaagaaaataaattacattttattttataaaagccaatattaacaaaatttgtaactaagtttgcatattaatcaaaggccctttaaatggcattgttaaaatttatgccacttataaagacagtaagatttgttaattaaaattaagattaaggaaaaactaagtttatgtttaaaaatcatatattaatgtaaaaaaatcaaaatagatcgtatctttcctgtactccaaactctcagcagactctgagaggcaaggtagcttgcccatgggttcagagggcttaaatatgtagataatccagactatagtttttaaaactctattatcacaatgaaacactaattttaaaaaattattggacaggactcatgaaaatatgtgtgtggacctcagcttgagaacatttcactaattaagagtgtgggccgggtgcaacggctcacgcctgtaatcccagcactttgaagtccccatttttaaccagtgctataatgcctcacagagagcctagatttgtgcttcaaatcacttgggaaatactgcagagaacaaaacaaacagaaaagatcaacaacggtatttctaagtgttgccaacttatttgactttctcactgcataatttcattcaatggatattcactgtacctctgtgacatgtcctgtgctagaataataaaatgaagtgacccggttcccgtctccagtgactgcacagttcccagtgagaccgtttcctaggaaacctgacattctggaggaagacacaggctcctccctgctgggcagcagcttaaatactgaatagttcactagtcagtgtgattctattcaaaatctgttcctgactaaccctaggaggccagccattctctctctgccttggagatttagtgagtcagaacacatcctctccgtctggggaggcagccaaactttgaatcaaaacctttccaggcttcttagtctgccaccaatttaaggaaatcccaaacatgaaaagttccagcttacaaaacagatatattaggcatcaagaggattcactctgtctcacagattcccccaaagattgctttcagcaatgagtgtcccttgggcatttaaattctgattctttctacacccaaaattcagttcctatgaaacaggaagagacctgttatgtagtgggaggtgaacttgtggtgcctttgtacttaccatctgcaacagtctcatgagccttggcaatctgccctagctcctgtatcaagccctggaagcagtccttacggagcaaatgctggcaggataggagatgagagcccatacctggcaggtcctgatggcacaatgagcaggtcattaccatggcctccatctgtccactcttagggcagtgtttctggccagctagtggcagccccataaagctcatgcccatgtccacagccatgcctgtgcccaggactggggcttttccactgatatcctcaggtgagaagcagcgtgtagagcgagccagctccactccctgtaagtgaagcacaaagcagagtgatctacttattttgagcagaaaaaaatcttaggccagaggggccttcgagaacaaggcctcaaaagtccaggccatgttcctctccagagctggaggctcatgcctcagcctcagttcctcacctgggaccaaaaagagagtctagccatctctgccgtggaaaacaaagcgtggaggtgtctgctgtttgtctgaaggcgaacaaacccttcaaaagtgtcccgtacctgtgcctctccttattggtagacaagcttgacctaagtttcaattttggaaaaaggaagaaaattgcattattgacaagtttatgacaggcactttacatactgtatttcaaaggggttgagacacttttacaaattaaataaaaccaagagggacaggctgaggaaacagtgttagagaggctgggtcacgcacaaagacagatggcaaatggcagagtccaaattcaaatccaggtcagtcttctgattctggactccagtctctttttttttttttttttttgagacaggatctcactctgtggcccaggctggagtgcagtggcacaatcacagctcactgcagccttgacctccctaggctcaggtgatcctcccacctcatcccacctcagcctcacaggtaactgggatgacaggtgtatgccaccacatgcggctaattttttgtatttttagtagacagagtttcaccatgttgcccaggctggtctcaaactcctgggctcaagtgatctgcctgccttggcctcccaaagtgctgggattacaagcatgagccaccacacctggcccatactcttttttttttttttttttttaagatggagtcttgctctgttgcccaggctggagtgcagtggcgcgatctctgctcactgcaagctccacctcccaggttcacgccattcttctgcctcagcctcccgagtagctgggactacaggcacccaccaccgccctggctaattttttttgtatttttagtagagacggggtttcaccgtggtctcgatctcctgacctcatgatccacccgcctcggcctcccaaagtgctgggattacaggcatgagccaccgagcccggcccacactcttaattagtgaaatgttcttaagctgaggtccacacacatattttcatgagttctgtccactaattttttaaaattagtgtttcattgtgataataaagttttaaaaagtatagtctggattatctacatatctaccacaatatgattttgggggtagtgttaagagtctaggatttagtacacactaggcagtattacttgtctcaggttaatgagctgagagaggggcagacttaatacacaaataatgtattcttgccacttgaagtctaaacaacattgtggcacaaaatgatgcatgttttacagtacttggaacagagaaaggaagtgggaaaactgagccatcatcattgtggcatatgtttgctgaacttagctacaagagtgagcaccacatttaagtcataatgatagtttagtttagaaaaacatcacatacatgtgaaattaatattattaatttgatggctttgtagttttttacaatttgtaaactatattcagttttatagttgtataacagctaaaagccaaaggaagttgtagctagttttatatttgtacttatttaagaaacaaaatacaaatcatttaattcaaatctgggtcttggtaattatgcaagtttgagaaaaatttcactccagtctgaagtctttaggagccaagccttcaggaaggaggaagggtgatggggctgggagaggccaggctgcctggggtccagaaagatgccactacataaagctatagatagacctgcacttctaattccttctgggcattatttagcagaaaacagccatagcagcagcatgattagagacgaggacagtctctattagaaggttcaagcatgcctgagtttatttcactgggccagtagttctcaaactttttggtcttgggaatccctttacatatgtttactcattgaagaccccaaagagagttcatttatgtgaactattgctatttaccacactagaagttaaagctgagaaaatctattgctatttaccacattagaagttaaagctgagaaaattttaaaacattaattttcataaaataataaacttgttatatgttaacacgaataacatactttttggaaaaaataactatttccttttttccatttatttatttatttattttttgagacagggtcttgctctgttgcctaggctggagggcagtcgtgcgaagttcactgcagcctcaaacttctgagctcaaccaaacttcttgcttcagcctcctaggcagctagcactataggcatgtgccaccacacccgactattttattttcatttttatttttgtagagaccaggtcttgctatgtagcccaagctggtctcaaattcctggactcaagcgatcctccattttggccgcccgaagtgctgggattataggcgtgagccactgcacccagcctaaaaaaaaaaaatcaactactttcaaaaaaattaatttaatgagaagagtcacattgtttctcatatgtgccaaaccctttaacatctggcttaataaaagacggctggactcccatacctgtttctgcagtcaatctgttatatgttgttttgttcacagtatatgaggaaaatccagtctcacacagacatacagctggaaaagataggagtactttaatagccttatcaggtaattgtggatattctttgataccacaccaaaattcaacagtggtagtagtttcttaaatgttatttataaggtagactctgaaccaaacttttcttattctgttatattaaaatctgctgatcttgctctttgaactagtcttttccccaggcacagttttttaacaccaagcattggtcatttggaaaataccagttcaatgacttatgcagatgttccaaatatcgacacatttcattacacaataacaaaaaatcacattctttagaatcacctcgaatctcatcagaaaattcttttaagcattgagaagctgccaaattcatggaggcagcaaaaactaccagaattctaacttttgcttgaacgcttgaattttatcattggcaacaaatactgtcaattcacttttgagaaaatatcggacaaattcccaagcctgaataaccacagtttgtctgccagttattctttttttagatgcagttttgcccttgttaaccaggctggagtacaatggcgtgatcttggctcatagaaacctccacctcccaggttcaagtgattctcctgcctcagcctcccgagcagctgggattacaagcatgcaccaccacacccagctaattttgtatttttagtagagacagggtttctccatgttggttagggtgatctcaaactcccgacctcagatgatccacctgccttggcctcccaaagtgctgggattacaggcatgagccatcgcacccggcctgccagttgtcctttcgtgtaatactgatgtttcactttttatttttttaattattatttatttatttattaatttttgagagagtctcgctctgtcgtcaggctggagtgcagtggcgtgatcttgattcactgcaacctccgactccctggttcaagcgattctcctgcctcagcctctcaagtagctgggattacaggcatgcaccactacgcccagctaatttttgtatttttagtagagacggggtttcaccatgttggccaggatggtctcaatctccagacctcgtgatccacccgcctcagcttcccaaagattacaggcgtgagccaccacatcgtccattatgtttcattttttaaaaggctagtttaacttgcaactcaatagcacaagcacagtttctcactttgatatgtagtaggaatactttttcttcacacagaacatcaaaaagaaatctaaaaaagtacttaagaatttcaggattgagatttaataaaaattgttaccacttcatcatggatggacattcttaaggtaaacttcttttttttttttttaaccggcagatgcttagtggtaaagaatataaggttttgttccagtttggtgcccaaaacatcagcagttttacataacattgctttggcaccatcagtgcaaatgtcaacccagtgaaaagatcaaataacacgttagctttattattaaaattgtttgacctgtgaactccctgaaacggtctcagggaccccccaccccataaggtctacagaccacacttggagaactactgcattagaccttgcatcacaatcctgggaattcagggaggtagcatggctttccaccaccagcaagtactacacagggtaagaatataaagaaacaggcatctcatttatgtcttagaagagcaattgaagtaactccatgaaagtaaatggttaatttaaaggcacagccacacaatgagtttctgatttgagaagacgaagggtcaaatgaccccatttctgcccccttcttatggctgctttcatcataacttagttcttccctctccttcttatctcccctgacctagaagagtgtaggggacagagtttgcaagactgtacttaagccaaggtagtaaattcaaatgcctacaggggctgggcaatctatatgaacgaagtgctttacttaaaagaatgtgggtctaatgtctccaaatcttagttttccaaaacccaggaaattatttttatttacattttaaaatgttaacaaaaagttaaattttaaaacattgccttgccacaaaccacctccttttaacatcttaccacatctatatctaagaaaaggaaaatatttactggagtaccttaaccttgctaaggaatgatggaacaagtcattccacatcacattgggaataagaatttcaaagattgtttgcatgaagggtacagaacaaattatcataaaaataacactcattttagggagaaaatgtgagcgagaaatagtaggtaatgagagtacctactctttgctaggctgtgttatatgtgatatattatttgtttgcttgtttaatgtatgtcttagacatagtcttagggaaggacttttgttcacaattgtacctgcccctcacttgcctggcacctagcataggaacatagtacacactcaattaatatttataaaacgaatgaatgaatctcattattttttcattatacagacaagaaaacagattcaaagagaacatgctatttgttcaatataattcagtgagtaaaaacagaactaggaggctgggcgtgatggtcatgcctgtaatcccagtgctttgggagggcgaggtaggagggctgcttgaggctagcagtttgagaccagcctgggcaacatacaagaccttatctttaaaaacaacaacaaaaaaaacagaactaggaaatgaacccaactttctgtgttctttccattaattttatcctctgaaattaaagtaaaacccaaatatgtaactccttttttctgctattgtataagctgttctcaaagactctagaatttctcttttcacgttttgttactctgagtttaatggcaacaaggttttccaccctagtttccaataaagctttaggaatgtaattgccatgtagaacactctatccaacacaggaaagaaagactcctaaaaattcctaatcttccaattagattatttttactttgtgctgaagaaaacctcgcctgatcctatggatttcccctaaatgccatatatcaaaaactaccgataaaggcaaacaaaaacccccaaggctagggaggttaaaatgaaactggaaactgtacatattgctggtgaataaattggtacgatccttttggaaaaaatacatagtaacataaaatgaatcacaaaaatgttcataccatataatccagcagtctcacttctgggaatttatcctagacaagttattcaacaggagaagaaaaaattatatacaaatgctcattccatcattgtctctaacagcaaagaatacaataagaattttttaaaaaaacaaaatacacaagaaagtggcttaataaaagatagcacatgctgaaaataaattattcttcagctgttaaaaataatcatgaagactgggtagtgatacgaaaaactgccatggtattaaataaaaagaatacaaaaggatttgtatactatgatcactaactttgcagacagctatgtctccatgtatacaagggttgaaaggtaatactcagaaaagaaaatggcatcacagggtggaatgatttgagttgcttatacttatatttttttcagaattttctttactgttgtactgtctattacgtataatttttcaagtctttctgaagtaaattgggatttctgagcttttctctaattctcacttggaaaaaaagcagaaacactgcttcttcccatcttgattaacagtgctctacttaaaaaagaaaacgaacatatttccaaatgtccacatctaaagatggagagcaagaaaacagagctggattcattcaggatgttgctgctatctgaaggactgatgtcgaattcaggaacccagtgaggagagaaaggaagagggatcaccagggccttcttcagggtgatgatgtgttcccaaggccacctggagagaggcctggggcagcaaaaaatcagcacacttgcctgcctcaccaggctgctgtctggtatcatctcttccgttcatttctgaggtattttctgaggccctcacactctgaggaagcccagatgcctgagatgtcacaaagccatgctgtacttcagaagagatgtcacagagaaggacacccctcaggagtcatggccaaaggtcatgtcccatgtgcctagctgggagggacaggtcccctaatgccaaatatctggctgctactccactttgcagacagaaaactcagctttgtctgctctctcagacctctgtcaacctaggaaaagtgacacacactgaacaaacaccacatgagctgtgtgtttaagtcatgtggttgccttttgaaggagagggagctggatagaaaactggattgagccagacaactacccagggtactccctctacaaccagatcaagccattgatgagaagaatgttaggtgaacacagaacccaacgggtagtgctgggtccactctgggaggccttctgttcagccgcgtgacctgagggacagaacgtagctcctctataaccaaggaacctggcaaactatccaagaggagtgtcttagcacccagaaccctacctcaaccccttgcagtggtggtccttattgtaggccccagctctaataccactgatggttccctttcattcccaaggccctgcccagcttacctccattgacagatcatcttcccaaggttaggttccaggtaacccagctcatttcttgtgcacttactggccagttttgatgtcaaatagacgacgatgtcttctttgatctcccctcctattctcaagacccctcttcctgctggtcacatgcagtatgtgattaaggttgatggagggatgaagaccataatgctgtaaggtcagagagggactggtcactgaggtaaaagcaggggatctggagagagaagactaaaggctaggcccaggctctgtacctgaccacctatgcagcgtctgacaagtcacccaattcttctgtgcttcagttttcacacacgtaaaatgaggctggtagtgctgtaccttcaggcagatgtattttgtaaattgccaagtgctctgaaaatgttggttgttatccttgtggactgaagtgttctgggaagaagcagaatataaagttggccttaaaggttgaggaagattcaggacatgtggtcaggaagaggatgggcactccgggatgggaaacagcatgagcaaaggcaaaaatgcaaatgggatataccaggcacggctgcagtagaaagcttgtgtaagggagaggctggggtaaggctggaaaggcaagtgggctatattctgttggtcataaggagctaccgaactttttgatcaagtaaaagaatgaaagtcatgttttcggaatactaacgtggtggaggtgtgaaggatacagaaattggaggagggttagaatgcaggcagagtgaacaaaggaaggtgttgtaaactccagttaagagatatgatgggggcctgaatgaaggcagggcactaaggcttaaacagaggaagcacattggggagatacagaaacaaaaggatagggtgacagtgtagtagaagaagagaaggcttggggacaattttcattatctaggtggacaatggtgccactcaccaagacagagaataaaggagaaggcaccagtgagcagtgcagattgagttctttggatatgtttactttgtctgtagaatgtccaaggaatactaaccagtaattaagtgaccatatgggtgtggagctcagcaataaggatgtgaattgaagccacccaagaagaccatgtactgtgaaaagataaggacaaggacagaaggctgaggaacatcaacattcaaatggtggacaacgctggatggaagaacctgaaaagaagactgaaaagtgaccaaagagtaggaggaaggcaagactttttctagaaaaagacgccaacagattaaagtacaacagaaagaacaagtgatatgaagaataggaagagtccaatttggcaattcgttcattaatgacattagtaagagcaatttcactgaagtcacaggctgtgagctagaccgcagtgaacaatggatgggaaggtgcaaatgggcaggatttgtagactactcttttggggagcttggctgtaagggcaaggacatgggagaattttggaatttttttttttttttttgagacggagtctcgttctgtcgcccaggctgcagtgcagtggcgcgatctcggttcactacaagctccgcctcccgggttcacgccattctcctgcctcagcctcccgagtagctgggactacaggcgcccaccaccacgcccatctaattttttgtatttttagtagagacggggtttcaccgtgttagccaggatggtctcgatctcctgacctcgtgatccgcccgcctcggccttccaaagtgctgggattacagaagtaagccaccacgcccggccagaattttggatattttagctaaaatatattttagctgaagggggcaagacaaagaaaaataaataaatacacgctcacacatacacacagagaataactgaggggatgggattttaaaaatttatttcatttttcccatgggatctattaatagactagcgaggggatgggatcttgaacactggttgaaggaaccgacttaagagcgaagacatgctgctattagcgaagacagggaggtgagggtaagttcatttattcactcaacaatcactagttgagtgtggattaaaaaaaacagtccttgaccacataaggaattaggtctagtagggaagacaaacgtaggtcaataaattacataagggttatactagattgtgtggtggtacaggtggggaagcgagcaactgtctgcattgtgtccaggaaagggtcacaggcgtgttatgtagattctggagaaaattcaaaaatagcatttatttttacttatttacttttgtatgtggagacgagggtctcactatgttgcccaggctggtgttgaactactcgcctcaagaaatcctcccgcctcgacctcccaaagtgttgggactacaggtgtgagccaccgcgcctggcctaaatgtggcatttagaaaaagtatttacaacatctgcattaaaaggaccataaagcaaccaggcatctaagtccctgaagcaatttaagttgctcaaacttgagaggacaaccaaatgatagcaaaagggcaaaagagaaaggaagctgcagtgcccactcagaagtgtgagagcgggagaaggcatttcgggagccgcccgagcttcaggaaaccgagcgagacaccaggtgggcacactgaggattaaagagggcctcgcggttccgcactgcggccgggagacaaaccagtagccactatcaccagccccgggcagaccactaagaactgtggaggtgcgcggggcggctcagggctggcgcatttggtgaggagctcagacaacgaggcccttagggtcggcttaggcggttccctgaccaaggcgccagaaaagggcctggctcaagcaagcacgggcggcgtgcagtacagcacacctagccccgattcttcaacagttctcgccctccgagcctagcacaacgagcctcaccgaaaccgtacaccgccaccaggacactccgtgatgggggatcaccaccctcagaaagaggaagcgactagcaggcgcgcaatcccgcgagaccaggaggccccgcccgaagcccggcctctgtgaccggaagtgaggcgttttgccccgcccccgtggccgatacctcgcgagacttggcgaaggccttcctttttcgtctgggctgccaacatggtaggtgtttcgtttcttgcctcctcttccttgccggcggagacccctaagctgtattcccattgcccctagtcatccactccctaccatggtcggggcttccaggctgcgcatggccgcctgcggggcagggtggccggcgcgggcccggggcggggctcccggagccgtgtgttaggcccgcggttcggatctctaggacacgcgggcccctgcgctaccgtggtgagacctcacggccctgagcggatcggtaccctcagctttcccaaacgctccagaagttaggtctttgacccacaggcttacaggaccatctcggctggcgggcatcgccccctgcccctaattccttaggccttaccaccaagctttttccacacagccatccagactgaggaagacccggaaacttaggggccacgtgagccacggccacggccgcataggtaagtgccggcttcccctcggggtgggccttgggctctcttcgggtgcttagctagtctggagatcggtagcctataagtgggttagaataagacctttttgtggtcaagttgcacagctgttgatttttttctgacgatcctctagtattccagttctaaggaatttcacatcagtggggtaataggaattgagcaggcacggtattgggttagttgaagacatggagtactgtgggaatgctgtgatgtggaacctgaaaagatgtttcacccggaatcctaaagtaatcgcattgctgaaaaccggcatcggtagggtgggaacagcgtaagcgggacacagaagtctgggaaacactctgcttttgtgcgaggaagtattgagatgcatgagaaggctgtgtggtgcatgtagcttttttgtgtgtgtgtgagactgatcactgtcgcccaggctggagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaatagtaagtgtccttggactgcttttattgacacagcttgggaggtaggggcagagagagggctggcttaaacaaaaagtttagaagcaagccttgcctattgctgttttttaccaagttaacacttggtgtgaactgagaacctgtcatcgaggctagagtcacgcttgggtatcggctattgcctgagtgtgctagagtcctcgaagagtaactgctgaccttattcactggctgtgggccttatggcacagtcagtcaccaggttagagacatgcttcacattcacctacccacaaactagtggatgataaattttggctattcagaagacgtttattataggagtatgtagattttccatagagtgctgttatgtgacttgaattttagtctcggccctgcctctgacattgtcggtggtttatcctggttccaggaaataagactagccttttcctcatgatagtctttggtggtttttaaaacagttgtttaagtcaacagatgtatcatatgcctgacactgctctacaccagtgaataatttacactctaatagggggtggtaactataaagatgataaacatagcatcttaattggagtgtgtatgaaggtggttgttacctcttcctagccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcggtaagttaattggatgtttttctgtacttccataccttcccttacaaaactctggcttaatctaatccacttatataatctgtacttcccagttacctaccagacattgatattcttcctgtggtagaattatcataggtagttccctatccgtagcagtgcctactgtcactgcccaggttgtatcaggtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaaggtggttgtcttcttttgcttagcagggggtatttgagcaggaggaggcttatgctttgccgagactagagtcacatcctgacacaactcttgtcctggtgtgctagagtactcgaagagaatctactggtcttgattcactggtgggggcagtcggtgcccccgttagtgcccagatcagaaacatacataccctgcctagggatttagaaagtgggttggcagtctttcctcacgcccatcacgcagttggtacctactacagtgtattgtaaacttttttctctgttcttctagggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattgtactctgaattttacagtgaatgagagaatgtaccctaattgttcaacagggctcaaaaggaaagattccattttgatgggtcacattctaaagaggggcagtgtgataggaatgagatggtcctttaggacttaagttctcagcccaaggtttttccacgtggccccctcatcttttttttttttttaaacggagtctctcttgccaggctggagtgcagtggcacgatctcggctcactgcagcctccgcctcccaggttaagcgattctcctgcctcagcttcctgactaactgggattacaggcgcccaccaccatgcccagctaatttttgtattttcagtagagatggggtttcaccatgttggccatgctggtctctaactcctaacctcaagtgatctgcccacatcggcctccaaaagttctgggattatagtgtgagccactgcgcccggccatggctccttaatcttgatccaaattattgttacatccagaatgtgatgaatcaaaatctcgagatgggggtccagcaatctgaaatttcagtatgccagggcttttctgtatgtcaaagtgggtttgaaatagttaatttttcttctagtctgaaatgtatcgggaaaatttggaaatcctgaaggctggaaattgaaataagtttttctaggatttgtgtctcttgctattggaaaactgatggtgaccaattcatgtttacaaataagatcctcatagatctcggtaaattataatttgctacagttttatggttcttcctgtgattttgagctttttttgacccaaaataatacagtctaaaactatagacaaataagatggcacttagactcctgggttttagttagtggaggtttccttagtgcactgtggggtcataataagccgagaaccatggctgtctatgggacacatctgtcaggacaacctttagaggatgttggggatcaaatagaaggcacagagaagcactgaattggcttacataagaataggctagaattacaagtagtgaaacctcgattcagctggacaattttaaacaaatgtatcatttggcttgtatcttctgttgtgctggagaagttagaaataagggctctccagaccagcctgaccaacctggagaaaccttgtctctactaaatacacaaaattagccaggcgtggtggcacatgcctgtaatcccagctactttggaggctgagccaggagaatctccaggaggcggaggttgctgtgagccgagatcgtgccattgcactccagcttgggcaacaagagtgaaactctgtccaccccccccaaaaaaagtaagggctctccattagggcccatagaggacttgtaatatggaacctgaatccaaggatcccacaataagtggtcagtagttcatgatgaattaaaagactcaatatttggtcttcacccaatacctgtgtgacttttagtcctaatttcctcatctttaaaatttcagtgaaagtgcctacctgaggattgtgtagattaaaatggaaaccgtgcacttaattttttgttttgttttgagacggagtctcgctctgtcgcccaggctggagtgcagtggtgcgatctcagatcactgcaagctccgcctcctaggttcagaccattctcctgcctcagcttcccaagtagctgggactacaggcgcccgccactgcgcccggctaattttttgcatttttagtagagacagggtttcaccgtgttagccaggatggtctcgatctcctgatctgcccgcctcagcctcccaaagtgctgggattacaggcatgagccaccgcgcccggcccaggcacttaatttttgtgtttgacttagtaacttaagtgcaaactattacgggagcagatggagtcaattggccttcatgtgattgtcagtgggaaattggtccaagcagagggaatactggttcaggaaactggtttgggaaggttaggcaaacgggaagtgctatggtggagagaaagattactctggccgggctgtaaaggacggctacaatgggaggctgaaggcagaaccaagaaaatgggagtgagtatggaaaaggtacgattcagacggcataatggacgggacttggagactgaattgtagtgggccgaccacaaaatgataaggcatggaaggaagtagagtttggggggaaggatccctagtcccttaatggctaccttcttccccaggagttgttaggccatccgatcccctggcctgggaaagaaacactgatttcgttgctggcttgttcactcaccagaagctacagctactaacagttctaaaaactgtttcatgtgatgaggaacagacgaaaatagttttgagccctaagtccgccgattccagtgctttcttgaacccgcatttactaaaatattttcatgactgccaagctttgaatagcctgctgtgttcatggaggctcatactggcgatctctagtggctggctaaagcttgaattgcaaaagatctaatttctggtctaatgtatatatgccttaaatatagttgcgttcaaacgtgggagctgcaggtgcaacttgattttatgacaaatggctgccacataatttgcacaagcagtgctcgtcaagggcagctaaatcaggcgagctttcaatcaaaataaatgtactactaaaccctacttagcggctaactagcccaagagcagacagcccacggacggactgcaagtcggaagcgcgggcggaagctgtgcagcgcccacctggtggctccatcggccgcgttcatcagtcagcacgacccgacctcagtggcgtcctcacaacacagaccggaccttgggtcttaccccggcacctgagaaccacttccggtgagtagcttctacttccggagacgatgactcccccgcgtcccagaccggaagaagcccggcggagaccggcctcgctcggccacttccggcaagggcggagccggccagtggtgcgcgagcgcagataactcccctggagaggcgggatgttcaactccacccctggtccttgggcggccgtgggtccccttcgaagcggaggaatggccaacctcgccgcacttcgagcccctttagggtgcgtttaagaacagtgggcgtggcctttacgtaaatcttcgagatgggaacctccagaatttgtctcaattgtctaaaaggtaatgagcgtcagcgacattcaagggcactttgggctaaaaaagaaagtgcttgtacacggatggaaatattctagaagaacataaaaggaatttcctcttaggaggttagggaaatgagcacgaagtatgttttggtgcagttttttgttcaacccaatgcgtattttcatattgagaggcaatataaatggagcgaaagtatcttgagaaaaaaaaaaaaactaccagaacttgccgttgctgaaaagtaatattttctctttcgagagttttcatggccttttaaattacacccccacctccacaggcaaataaatttgttttggaatgcataccacatcatctggctctagaaacgtattttgtgtagctcccctagcaagaatataggttaaagcgtaaatttaattcctggctctattttacatcccaatttttattttcctctcattcccactttacgttgtttcaaataacctagtttgtgtatccctgtaagtcattttggtataaagtaggttataagtgtacatgcgaaaagatgtttttaacaaaaatgtaactgagctgtgactaatcccacttattttcttgggtcgtgctatggtttggatgtggtttgaaacttggcccgcagtatggcagtgttggaaggtggagcctattgggaggtgtttggatcatggaggtagatctcttacaaatagattaatgttctcctgtggggatgagtgagttctcactctgctgggaatggagagcaggttgtttaaaaggcgtctggcttcctcagtttctctctcttgcttcctctcttactacccgatctctttgcacacgcccagctccccttctgctttctgccgtgagctgaaacagcctgaggccctccccaggtattgctgcccaatctttaacttttcagccatcagaaccataagccaaataagtcttttttctttatcaattacccagtcccaggtattctgttatagcaacacaaaatggactaagatgggccctaattccaccgattccaatgtcaaccagagtttgactaatgctgtttaagggcaattcttcaaaatattgctttttaaaaagcccagaatacttatttcaagactacagtttatcagagcatttagaaccgtgtaatgaagtggcctgccctgcattaaaagaactaacttaattacagaatagaggagaactgacactcctataggtgaggggacttccctggtagaggagatagcactgttatccctgagcaactgccccagtgttgtcagaaagccactgtttaaggatactccctctcaatggccacaataccatcttttacaggagtgttttggaaacagtggggtttttttgtttgtttttttaattaatagaaatggggtctttactatgttgcccaggctggtctcaaactcctgagctcaaatgatcctcctgccttggcctcccaaagtgctggtattataagcatgagccaccacgcctggccatgttgggtcatttttgttgtcacagtcatggaggggaagggaccagggatgctaaatatcttggaatggatgagctggtcctacacaacaaagagaaatctaacttaaaatctaacttcatttacacataacccaaaagttggtttgttttttgtttttgcagttttcatatacttctgtttcctaggattctaactactgtttaaatcaggggaagctcatactttgttttgttgagaacgttaccaaaaattgttcatttcagaaaactcaccaataactactcagtaggatctgagatgctgatacaacacttttctccatctgcatatgtagctgttgcattcacagtaattctgtgtacagtataggcatctgattatctcttctagtacagttgtacacaagcatttacatatttaaatattataacaaaatatttctgttttatttctccccttttatattacagttaaggtatatttcggtagcttatattatctttgaatttcatttcagggtagtgaaggagggaattaaagtatttgctattaaaaaaaaaactgttggatctgatagggatgaaaatcattggtttagaggtccagagatcatgtgaaagaacgtggaaagaagccctgagatcatgtgaaagaacgtggaaagaagccctgaatattttttgtaaacctcaagccaggcccactgtccacaccctcctctccccataaggctgctgtgccttggccatggcaatcactctatgggcccttgcagcctattctaagccattatatgccagtactgattttctggattgggaccagagctgcagccacagtagcggggagacataccgctctggtattcacggaagggcatactagattttaaagacacataaaagtggcaaaatttatgaataaggctggatgtggtggctcatgcctgtaatcccagcactttaggaggactgtttgagcccaggagttcaagactagcctgggcaacatagtgagaccccgttaatgcaaatttaaaaaaaaaatttacacatacacatcttgtgatcggatcacatgtctaaagtggttctttggagccatgctgaaaaaggaggggtggagaattggggaggaagggagagagagcgcatgtaccttttagccttttaggaattaaatctggttttttgggttttttttgagatggagtctcaccctgcgcccaggctggagtgcaatggcgcgatctcggctcactgcaacctctgccttccgggttcaagcgattctcctgcctcagtctcccagtagctgggattacaggcaccccaccacacctggcaaattttttgtatctttagtagagacgaggcttcaccatgttggccattgctggtcttgaactcctgacctcgtgatccacccgcctcggcctctcaaagtgctgggattacaggcatgaaccaccgcgcatggcctgtatttttcttattaaggaatctggttctatgactgtcctaagcccaggctgagttaagagcgacgagttctggagggaactacttcccactctgagtcttctggttgtaatccttgtcttttctcttgatctgaactgaagactcatgaggcttcaatctctgtcctagtcctggcaaatggcagagccagaaaatgactttgccttcccagaagacaaaccctccactttattctgtgaggctgacggcaggcccaaaccatggacaggttggggcctgtgcaggcctcagtggagatggggaggaggaagaggggaaggaaacttaggatgggatcatctctcaacagggtggaaggacaggaaaactttactcatggttcaaatcctgtcagacccaaacacaataccaaagaaaatagttgcagcttaatgcctcacttgggagtttgcaaagtctctgctctccgaaggccttggtgggtgaaaagcctaaatcgtccttatttcccaccttgcttctctccttcctcttccatggaatgtaaccgtactttctgtatgaaaacctagggttccaatggaaaaacgattcacagagtgacatgcaagagtcacagggagtaggtcagggctatgcccaagcctgggttggcattagctgggctttactctaccaatgttaggacactcaatgacatcttaggggcttcaggcagaagaggaaaatgttaagatttacctaataatggggccgaagggcaaagagcattctttccatcactggaaacacttaagcacaggctgaacagttgagggaagctgaactactgcaatgactgggtatcttctaactcttaagaccggtcatgcaacttaggctggagaactccatttcaggggaggtcagtgactcacactgaagctaaccccttaatctagtactcagttccctgtgtgatggtgtttcatccctgactggccagtcccagcccattcccaggagagagaactagataacaaagccaaggaacacatgaggctctgggcccaaacaactgtacattgtttattgagaacacccgtagatgggaaggagggatgccctgtaccgcatcgtggccaccactgactgggagccaggcccagagagcactggcagagctgggggtgggcttcccatgacacactgaccatctcggagggtgggaggaatgagaggactaggcctaagaccctggtgccatgctacaaatggggactgattggcctttgcctttcaaaaacagagggtatgggtatgcggactaccagcaaaaaatagaaacttgatttttttaaaaggtcctcctgtacataacaagacagcatctgctctccagggcccgggactggcagcggggacctcaggcaggcaggcaggccgaaggcctccagggaagatcagtggtttggctgagacagtcagctgcacaaaactggccagtcacgagcacccagcgaaacttcatccatgctctggcaggacaggaaagcacccggccccttgggaatatacaaatatttgccatattctctttgcttgttacaaaaaacagttaagaaagcttacagcagattatttacaaacagtatcctgggatatgatgaaggcagaggtgggctggcttggaggataggatctgtgggggcagaggagccacagcagcccagagggtcccaggctgggccttctccccaggcttcaggctctgcaaggcactggactctgctactgagaaggaggcttaattcttcttgtggagaaacttcattttgttgcctgtgggccagagaggacaagagagaatgttcagtgttatcccttccaacctccactccctctcctccttgtagccctaaccctgtcagtgggagaggaaggattaggaagactggattataactgtgatctgatccagggtagtgaaaacacgtgagagctctaattagggcaccggtattaatcactgtgtggttttacgcaagccacttaacctctttggtctcaatttctctttaaacagaaacatgctatgattctctgatctggcgggctgagcaccctgcagggaggggtgcattttgcaggaagggcactcgcactgctgtgtctgcagacctgttatggtctagaggaaagctcactggctctaatggccttcatattcactcaggaaggagtgcaaacagaaagacctgatgtatgtgggaacctgggattcctctttgtaatgcaatatggtaaatacagcctgtcctccatatccatgagttctgcgtccatgggttccatgtttatagattcaaccaactggagatcaagaatatttgggggaaaaaatggatggtggtgtctgtactgaacatatatagactttttttttctcgtcattattccctaaacaatacagtataatatctatttacagctgggcatggtggctaacgcctataatcccaacactttgggaggtcaatatgggagtattacttgagcccaggagtttgagaccagcctgggcaacatagcaagacatcatctctacaaaacaaattttaaaaatagccaggtgtaatggcatatgcctgtagtcccagctactcaggaggtggaggagggaggatcacgtgaggccagaagtttgaggctgcggtgagctaggattgcaccactgcactccagcctgagtgacagagccagaccttgcctctaaaataaaataaataaaatataaaataaaataacaaaatttatattatattaggtattataagtaatctaaagatgatctaaagtatatgggaagatgtgcacaggttatatgcaaatactatgccattttatagaagggacttgagcatctgtggattttggtatccttgggtatccaggaaccaatcccccacagatattgaaggaccactactgtgcaaaatgcccttggaattctggctgagaaccttctagtcactatgggatgtctacatcctgttctgtctacagccccagtataacacctgttgacattgatttagagtattcgggaacacaaatctcccagccccttccttcttgctgaacatctatctcatcagtaacaaggccacttacccaaacctcggagaaacttattcattccactctgctcagtgtctgggagttcttctaagtactgctccactcgctgctcaaaaaggcctgggtaaaagaaacaggcacagggaagagaacagtcattggaggaagggaaggagaggcctacatgaagggaaccatggagcacagatgccaaaaaaggagaaagaaaacatctgggatgataatttgcaggagcatcttactagaattcgggctggctcatcaaggcgatcattagtgacatcttgccggggtttgctgctgccaccctgcctccccatgcacattcccaagctgcactaggtgaggaggctgcttctcagttcagagctgccccaagtggacatctctagcttccttcagacaactctaccatgttgttccaaaaaggttgttatactaaatggatagtattagaggacagaagaagtactaaccctgaggttagacagaaaaattgtgatgagatgaaaaagccctcgaatgagctgatgaaatagcaaaaaacaagataaccatctgccttaaatgaagactgccaccaacctacgacagctggcccaatgctctgtaagggaattcccaaccactgggttctcagaacccccgaaattgctcagtctgctccttttctctggatagaagggctttctcctatctttctctttgaggagggggtgggcaaccaatggcatgctgctcctaggtggagatgagtcctacctctagccatgtggcttagcttgtgcatagccttgtgaaggcatttactggggccggaggagaagaatgctaccttgaagtttctaacagaggtaaagggatgttaagaggcctggccctagctgatgtccaagagcttccatcatagtgcctggttcttcagccctgctgtgggtgaaaaaattagagaagagagctgataaccaagacttaccctttgcccgacactttcttagctccctgtcttggatgaagccagcaaacatctgagactccataaaaacctcaagaaagcggcggatgcttttggaggccacagatttgcggaaggcctctcgctgaaaggccctctctcccttctcactctgtgtcagaaagagggagtagtgcccaacggtctccacaaagaaccggataaacacctccgacaccagcccattgagggtattacattctggaagggaaaagacaatctttgaggttcaggtcaagagcctgcaaagccttcctcaatcttcctggtgtagtcttcctctccccaacaagacttccagccagtaccactcttctgttctggaagctctttttgagaccgagtttcactcttgttgcccaagttagagtgcaatggcgccatctcagctcattgcaacctccgcctcctgggttcaagcaattctcctgcctcagcctcccaagtagctgggattacaggtgcactttttgtatttttagtagagatggggtttcaccatgttagccaggctggtctcgaactcctgacctcaggtgatccacccgccttggcctccccaagtgctgagattacaggcgtgagccaccacacccggcctctggaagcttgctttcttgtgctcatagccttgtaactagcctacgagctgcagaaggccagaaactatgttctgaacatggaagttgaaacataattgctggatgaattaaagtagaaaccagagcaccactttcatcatatccctcaccctaagtgatttttctggcttccaaggaagaggaagtgcctttcatctcctgcaatggcttgaggcaaggcctcagaaggaggaataattagttttctgtcagcagaaagtatctttggggttgccacatgtctttgggttttccttcctaaactacctggggtagaaaagacgctagagtgagaccaaggtcctcatcagccagaaagggtttggtgtgcagaggcagagttctggccctatggggccctgacccagagcagagggagcctggagcagagctgaccgtgcccgggcactattctcaccatcgtcggagtcgctgtcagagtcctgggagatcagctcattcttcctctccagagcctgctccagagctgcctgtaacttcctaggtaacaacgtgtcttcgtcgtccatctgcaggagaaagaaagcacagtgacaatcatagctgacactgagcacttactatgtgctaagacctgttagaagagcgtgagtagataatctcatttatctctcccagtaaccctcataactatcatcaacctcattttaagatgaggaactgaagcacagaaaggttaagaaacttgcccaagattacagagattaaaagtggtagagggtcaggcgcagtggctcacgccagtaatcccaacactttggaaggctgagcgggaggatcgcttgagcccaggagggagttcgagaccagcctgggcaacttagcaggtccctctatctgcaaaacacacacaaaaaaacaattagtcaagtatggtggcatgcacctgtactcccagctacttaggaggctgacatggggaggatcacctgagcccaggcaggtcgaggctgcagtgtcatgactgtaccactgcactccagcctggatgacagtgagaccctgtctccaaaaaaaaaaaaaaaaaaaaaaaaaaaaagggggtagagccagtgtggcattcactggcctctgtgaccaggaccagccaggggttcctgattaggtctccccaattcctccatcttcagctccaggcaggaggcacagttggcttggggcagggggactgtggccagcctgtgtctcaggaatgaagttagactgttgtttcgtctctatactctgtttctgtgtccacatcactatgcctggtacccagggagtcctcagctccgtcattggtgtgtaacagacaataagtacatttccataggggagagcactgggttgtgctcctttgtagagagccaggaggatttccacgactaacaaaggctttttgtagttgacaacaatgattgcaaacctgtacgttacataacaatctatagttatttgtgtaacccccagcaaacatttcaaggcaggtgttgtcaccacctctcctttagagctcagaagaatttagaggcctaagaccatgtggctcaaagggggcaaagtccagtggccaagtctgtggactcccaggccgtgttcttcaaattcccacactgccttctagaagctcatgatgtcactggaaaggcggaccctgctaaggtcaaggattccaagaccagcttctccccacccttgactagtctgtgagtagtactgaacccagagagagagctcaacaaacaggttgtgaaggttgagtagtgtgtgtgatggtgcagggtgctcaggagcccaactctagcaagcacccaccctcttacctgtcggatgaatcggtcagatcccagattcaccatcagcgcctgagaaaaggagtcattagcagagtggctcagggcatgagtcccgcaatgccctctgccaggcctccagacctcccaggttcccagggtcagctaacaggaagtactccagccggggatagacctcccagggagaaaggataagagcctggtaaagaggccgaggggccacaagtaagatcccagcacctgcttccccctccacccttccccccagctggttcccccggtggcccacctcctccacaggcagctccttcagtttggggagggagctggagagcaggccaaccaggaagggggtgggacagcagacgatgtcaatcatggaggccgggaggacaggaatgaaggtgtgctgccaggagaaggggtagagcaaggccaccaccgcgtgggagcagctggagagggtactgatgggcagacagagagacagagtacctgagcccaggcccaggaacttagagctcgctggaggctcaggacagcctttgatcgtaaacctcccagtgcaacaaaaatgctaatggggttcagggaccctgcagactggtaaagtccccgctttcccactgcgtagcgcctcaaggacaacaatgctactctcttagggaaatgtacctgcaaacagccaggaaggtatgcagcaacccgcaggacagtcatctgacaaagatctggaaaagggctgtctcgggtttggggggcacatcagtgggcccgtggctgaggaggcagtaggttttgtaaacccctagggccagtgaatgcagatcgtgggtaccctctcccaccccacatcagaactaggcaagagggacaaagaacttgtggaaaacctaaaacatcagcaacggatcatgagctggctggacctacccctcccctctccagccagaggcagaccccaggcagaacaggaaggacatcttttccaagaccccagattggcagaacttgaatacccggccaggccaagaacaagaccttgggatcgtccctcccagaatggtcctggaatgtgctcagaggcagctgcaaccacaggaaacaatagctgtattcacagccccacgggagctggcctgggggggggcagggtggcaaagaggaagctcagccctgaattagagggtagaaccttcaggaaaagaaacctcatggtccaggctctcttaggggccactaaggtcaggccaggccagggcaccaaagctgggcagtcaggggctttgttggctgacaatgaccatggctggtacacaggaggggcctcttggaactgctgtacccagctcattccagctgttgggctagatttcttcacaagggcctgatgggcccacagaacacctagaagtgtgagacacagaagcattgaggctgtgatgggaacaagtgaggggcagttttcctttctaaaccctggtgctctatggaaaagtcagcagctctggtttttcttcctcctttcttctcctgggctgaggatgggcctgcgttcctgtccctctgaaggcaatcgggagttcatttctcggtttcctctcaactgcttcctcatacatacggaaggaaataccccagggattcaggacttattggaggacaaaccagaacggggattttccttcactgccctcctgtgagcacctgacatttaaggtggcttaatcaatgtccaaatgaccactctagagaaaccactgcttgggatggattctttgaccaaaacaatatgtaacatgttgccaataacccatcctgttgttgtaggacttactaagaaattattttatggagagaggaaaagtttttgtttcctttttttaaaaaaatttttaaatttttatttatttatttattttgagacagagtgtcactcccaggctggagtgcagtggcacaatctccgctcactgcaacctccacctcctggattcaagcaattctcctgcctcagcctcctgagtagctgggactacaggcccagctaatacagggtttcaccatgttggccaggagagtctcgatctcttgaccttgtgatctgcccacctcggcctcccaaagtgctgggattacaggcgtgagccactgtacctcatttcctttaaagcagctcaaaaatgtttcttgtctggaaagaaagccccggctcttagagccaggcaggcaacctttgatatgcaaatgaagaccattagaaattgggtccacccaacatggcaattcccaccgttgtcctcttgcccttgcccctacaggtgcctagcagcatggctgccccgcatattcccacgtgtgtagaacatcaggcgccctacattcgcatattaaaaggctaggatgggaaggccagcttccgggggggggggggggaggggctacatgaatgacatgcctggtcaaaccaatcccctaagccctatgcaaatcaaacaccgcctcctccagccttcttatcaaactggctggtatccacaacacttggggttccctctctcggctttggagcctctctccctctgtctctgtactttcttctttctgcctttctccttcccttcttgcctattaaactctccgctccttaaaaccactccacgtgtgtcggtgtcgttttatctaaaccagcataagaaccaaaaaccctagtgttcctgcactcatcggagccgtatcacttgtgccttgcctgtgtcaccccctaaccaccactgacataaaacttttttcttttttaaaccttggctgtctagaagagctccgacttcttacttcctaaactgcctcacgtccagtgaccatcacttctgccacccctcccatggccaccaccagaccttctcgacacctctacctctaaaatcataaatgccagcatttcagaccaagacctgtgacccatccagctcttttcttactcctcctaaaccagctccccgacttccctggcacctccaggccctgcacatcatctgtttcccggtgtgggctggccagccttcctcacccactctcctctctgcacctcagtgcccccatcacatccttctccccagccctcccattgcccagccctgggccactgcagttgccttctccaggggacaccctccacaggaccctcgctggctggctcagcattcctcacactgtccccggtcagtgctcttgccccttcctcacagcagctctttcctcaaactcagcatcccattgagatggctttgcctccccctccagaagaaatgcaaccatccaccaaaaatctcaatttcttaacctttcccctttacatatcccggcacctgcacagtcttggctgttgcaaaggaagaaatatccctccctctcccctcaggccaagccctccacagggttctcaatcctgccatctgtgtgctcccaaaccctgctccctcacccacacaggggtgctacctttccacctagtcttccatctccctacgcacagccccactccagcactggtctccggcgcctgcttaggctcctgaacacttgctgattcgcttgtgggtgtgccttcccccctcccttctgctttcttgcccggctgggccctacctgagcttatctgccacaaaaatgacccggcgctccagcagcagtgaggcaaagattcggatgagctggcgcacactgaggcaggtaaaaaggcactcaaagtccacgtgctccagccttgagtccatgggccgccgcagctctaacacctgcaggagagcgatgggaaagtgggccggggccagccaagtgggtgctgccctctggccctccacgaagcaactggagctgctttccccttccaacctgctcttttccaggtctctcgtctaccctgctatgcagtaaacccctcttctccatccctcggactacagctctgctctcgtagcactcgaacacccagcctgtgggcaagagggctgcctgtgaaagcggggaaggctccagaaggaaggagttgaggggccatccatcgggacctcaggaagagaggagagctgactgctcttagagatagggagaagaagggaaccacacagccacatctctagggtcctcctgcccacctccccagacaaaggtctaagcccccagtgctgactagaccccactgctctccaggcatctccgcatcccaggactctaatcccagccattgcctctggaagggcaatgctggggtccttgttgccctgtccccctccctttcctgcagaaagagtttccttccagaggctgtttgtcctgctatcctggcctttatctccatcaccctaagtcccatgccagtcacaaggaaaacataagcaaagggctggccattctgcagccttgccaggaagcaggactgtcttatcagggccaggcctggccctctttcctccaaaggctgctcccaaggtgagtgccacagctcagagagccacttctctgggggagtcacaggggtggaaggtagtgagtgactccagcggtgagggcaggaggaactgctgacgctcaggccgtgccaaagcagctgtccctggggtctgcctggcctcctccttggtcccgcagcatgtgtgtgcagcatagatgtgcaggcctcctgaaaactagggtgagaaaccagttctctctcattgccccatggcatcaaaggtaatgctttacaaggagtttttatacccacgtcatctcatttgttcctcagagtctaagcaaatgaaggagttctaactcctaactcagcatccatccttctgggccccagagaagcagcaaaatgggcacagggcatggtaacggtctgtgtccactgtctctcccgcctgatggtgtactcccagaaggcccagtgatccgccagatgctgggtacaccccaaatggtcagtgaacgtggactcacagaaagaagtagcacaatgatgccagagccctttatacctgctccaggccctgtccccgccccaaaattcgcaagctccctgcatgcagcccaacaggctctgctctctagcacccagctccagtccctactgtccctggggcccaaccctcccccttcccccagggattgagaattcacacaggctgctcccactcccggccttgttccctgcatccctgccttcaaggagatcaagcccagggggctgaaggagctgagtagttacagcctgggagtccagtgtcaggacagaggcagatgtgaccaacatctgcacagggacaggcaggacatctagaagggcagccaagctcatgtgggtggggagaggtcagggaagcctctcagagcacaaggtacttgactccccaaagagaaaagaagagaagtgtcttctaggcaaaaggaagtagggttgaggcaacactaagtatcaagtcagaagacgagagcccagtgaggtggccagggccagaccatgaagagctcccaggcatgatgctgcgctataagggaagggtcccctatcctgtgccccacagccaccatgaagcctaaagttcctctaaatgaaggggagaaaagaggcgaggagaaagccctcaagctaggatttgccactgctcagcaagcctggtatgcttttttggtcagtccctctcccactctctacaactaatttatttattcttccctctcctagaacccaacatccacctcttactctcaaaggatgaccttttctattttgacatatgtatttttttgagatggagtctcgctttgtcgcccaggctggagtgcagtggcgcaatcttgactcactacaatcttcacctcccgagttcaagagattctcctgcctcagcctcccgagtggctgggattacaggcatgcgccaccacacctggcaattttttttttgtatttttggaagagacagagtttcaacatgttggccaggctggtctcgaactcctgacctcaagtgatccccccgcctcagcctcccaacgtgctgggattacaagcacatgagccacggtgcccggtctgaccttttctactttgagaaaatcaaagccatcagatgagaatccaaaatctactaagccactccctcctctcctaataaacaccaagccctccatggagcctaacacccacatcttctcagtactctctgctagcccctcctgctcctgcagctcaaacctcttcctctggcagccattcccaccagcatacaaactaccatccctaacaagcttccctagttccacatttcaattgctgccctcttccctatttctctccacagccatgcaatcttgagaagatgtctacacaggctgtttccacttcctcacacccatcacttctcaactcactccagcccaacttctgggcccctgcacttgtcaagatcttgccacgcctcatcctgacctcttggtggttcctgatccggatcacggcttcctttttgaggtgctcctgagccgcagccctctcctgagtgttcctctcctgcagggcctctgcacgttggggttccccaggactgaggaggaccccatactgggctctcttctcttccctatttacactctttgctactaaataccttctcttgggggtctcatgggcatctcaaacttgacatgtacacatttggactcttgctcttcctcctcattacctgcttctccttcacgagctcccatctcagtacatggctccatcatctaccctggggctccagccagaaaactgggagtcagccttacagtctctgtaacaactactccctatttccaatcaaacgcaaagtgctattggtcctaattctaaaatccatctacttcccttcccctgttctaccacatcttaatccaaagctgccatcatctcttacccatagtgccacaacagtatccctgctggtctccccgttttcactccgaccattatctacatggcagccacagtgggctttgaatacatgtatcagctggccacaggtggctcacgcctgtagtccctacagtttgggagggggaggtgggaggattgcttgagtccaggagttcaagaccagcctgggcaacagggtgaaaccctgtctctatagaaaatacaaaagtcagctgggtttggtggtgcacgcctgtagtcccagctactcaggaggctgaagcgggaggatcgcttgagcccgggagggtgaggctgcagtgagccatgatagcaccactgcactccagcaccactgcacaatatgggtggcagagtgagaccctgtctcaaaaaaataaaatgaaatgaaaatatacgtcagatcttatcatacccctgctttagataaaaccccaaatccttaacttggcctagcagggacatcgtgattgggttcttgcctgccaacccacccctctacccccaccccatcaaccctctgaccagcatttgcacttgcccaacttttgcctttgcagatgctggttcctctacttggaataatcttctcccgttcatatccttctctttccatctccctcctcctgcttcatttagttgcccccactcaccacttaggtctctgataaagtgttactttctcagaggagaccttccctggccccttatttaaagcagactcccctgtttcacactctcataaggtcctgtgctttcacttggcttgtaacacatttaggaattatctatttatatgtaaaagtgtttataatagcagtatctcccactagactacaaacttcatgaggacagagccacgtccctctacctctgactctgctctgaggtctggcgcaatccctgattgtgagatggcacacattcagtaactgttcaatgaatgaacaaaaggaaggcagatggaatgcagtttagtccaaatgggtcagggaaggcccctgggaggaacagagggctggacaacatgtacattcctattgtttgctcttttggtccctagtgatggggtacacagacatggttgagcaaggagggaccgtgctctgcaacccccaaagactacgaccttggccagcatggtcctcctgccaccccagcccgtagcccgagagaagagggtgcagaaatccctacctcattgccagcacctggcaggaatgtcttcactttgatggtcttccctggggctgggaagggcgactccatgagacttctcatgaaaggatagaccaatgcagcggagatcccacgccggcgctccacctcatctaggacctgtgcccaccgccagcagcccaaagaggaagggtgtcagggcactgcccttccccctcctggcagagaagagggcagccaagcatctgaccaggctagcccagaagctgggagacgggaaggtggtcttgccatgatctgcacactctacccttcccgttttccttggcactcagtgactcctctgttccctaactggccttgcttcagtccccaagagcggagtagctgggcaaaggaaataccacccaagagtcagctccctgggcgctcctgcttccccaaggactctggctctgcctagggcccagggtgggctgtgacaggggcagacactgccagcacaggagctggggaaatgccagccagctgggtagagaaccaggccggggaatgggagggtgtcagagagctcactggtacttgttcctgcattctgtctcccgctcgctcacagtcacaggtggttttctcatctaagctggctgcagatactcctgtgggagctgtcagctgggggacggggagggaagcctgccagagcctcttaccttggaaaacaagccgaagcagccaaggcggctgatgacacagtacacctctggcaaccggggccctttcccacttggctgggccaggacaaggaggaggaggagagagacagacacagagaatgcatgattaccatttctggctccttttccttgggaacggaggagtaaggactgcccttctagtggaggaagactttaagcctcctctaaacctctctgcaaccagagccctgaaggaacagccaccactctcaggacaggcctcagctctgcagggtctcccagcaccaggtaccaggctcctgccaggctccacacaggctccacccttcctcccaggaggacgctgacgggggctggcaaagggcaaagcagtttggcagaggctacagggtgtctgtggattcatagccctgaggctgggaccccagcagatgggaaggactagggtacatccttaggacaagccattgtagctttttagccccatagggcacattcggcataccattcctttttttgcttcttttctccctttcttgatccacctccattctaagagagcaaactgaaaacaagagatgggagctactgtttatggaacatttgctatacctgactcctgggcttgggactttacaagagatttgtgagagagggattattatcccctttatagatgaggcaactgagttcaaaaagataaagccattgcctaaggccacctatctagaagctgtggagccaggagtttgctttggccctgtttggctgtcttacccctaaagcctgctgctttctgacaggaaggaaagaaaacaaagacactgggtagaggtttgctatggagtaaaggagcaaaagaagaatgggacttaaaaggtaggcatggccaggcgcggtggctcacgcctgtaattccagcactttgggaggccaagggaggtggatcacctgaggttgggagttcgagaccagcctgaccaacatggagaaaccccatctccactaaaaatacaaaattagccggtcatagtggcatgcgcctgtaatcccagctacttaggaggctaaggcaggagaatcgcttgaacccgggaggtggaggttgcagtgagccgagatcacaccattgtacttccagcctgggcaacaagaatgaaactctgtctcaaaaaaaaaaaaaaaaggtgggtagctaaaggggagacatgcactgagagctcccaggcccggagcccccatgcaggctgcagtgccttctccagcaggactcagaggcctggagggcctggcaagtccgagtggggagggagcagagcagcaggtgctggcccctcgtgcaggctgctaagcaaatgcagatggggctatttcagtctccaaacctgctggccacacgtcacagatctaaagagaaggcagaatctgtttttgtccatattaggcctgaaactcactcctgtctctttccctctcccccgcctcccctaaagccccaagtgattaaatcaagtatgtgggatttggatcagaatcattgtgtccaatctgcaggaatgccgagctagtgccagcccccttggcagagacccagcccaggccctctctgagcacgccaggacaaacacgctcttccctgggggcagcagccccactacaaaggagcagctctgctccatctatgttccagcaaaggcagccttcgcaacactccttccaagcctgggaggcccaggcggccagaggcatgctggcctctgcctggctcaccacctggcatcactcctgtgcatacgccctttgcccctccatgggcattctacctccccacgccccctctccccagtccatcctctgggggtgatccaagagtacaaattggtgacaaacgacttcccttctggttctgtatgaccttgggcaagtcattctacctctgagttttgactttccaatctatggatcagggataataataacccatgggctattgtgatcattttcttttaaaagacatacttgaagcatctagcttggaatgtgacaggttctaaacaacatttattccctcttattcccttggcccttccctcctgtgttgaaagtccaatctcctgtaacaggccatctaaagttcctcgagagggagatccatgttaaactcatctttatatgagcacgtgcctgactctcaatagcacgtgcctgactctcaataggtcagggcttctgataagggatgataagtgtttctgaatgaatgaatggccggccccaaatccttccttcagggctcctgcccccttcatctacccctagactggtatctggggaggctttctcttgctaaggcctggaaaccccaaaacattgtcaacaacccagtagctccaagctgggagtgcagcaggggccaggctctgagcctctacccaatctatttcccaggactaatgggaagggaaatggtgagggacttctctttacaaaatggctaacattttcaaaacctaatccctttcccctagattcaaggtatctctctcagattcccagagaaggtatgtctctgtccctgcccaatctccagccccaccacaccacagaaaggcctcctccccactacaggctggccaggtatgggggtgaggaaggttgtccctcacctaatctgatgcatatacacatactgctgggggcgattcgatcctgcaaccagagaccagcaatcagagcccatgatcccaagggaaatgacgaaaaagtagagaaaaactaaaaagacatgaaaacccactccctccccttactccagataacctccgatcctaaggccccctcagaagcaccactctgagccctgctctcccagggtagcctcacctgtgaaagtgtgtgtgttggcagggggttcggggtggcctcaggaagcataacataggatttcatacaagctaaaattgcagaagggcacacacacacacacacacacacacacacacacacacacaccctggcctatcccctgcctgctggcctgaggaccgaatggcctcactcaccagtaagcgcctgcagtagccaaagcgtctgctgccatcttccccagtcagcatgaaagaaaaggtctcactggaacaaagagaggtctggcatcagggaggtgtgagaggacctaggaaacagcccccaagaatagggaccgtcattttcacgtggggtgaagggccaggttgctgtaggagaggatgagactagagcaggccccactcaggtgcccacgctatgggggtaaagaaggctatgctccttcctccctcaggccaggccaggcctcacctgctatactctgacacaggaagccagtccttggcatcagggaagcaaaactggggaatggctttgagcctttcctctgcctctcgcatctgcttggtgggtcggtccagctgcagggaagaaggaaccaggagatgacatggaacctgagggcgggtggtggtggctgagaagcccctcctcccctgagggccctagatgccactgactagcgggcatgatctcagcaacccttgtcccactccgaattcttacagagcccagagtcatcattcattcattcaataaatgccagcggagtgctttctatatggcatctgacacggtgctatgcgccagggctcttggctctcaatggaaaacaaaggggacaaggtccccgaccttacacattctcgtcagcagagtgagatggtcaaccacaacatctcagagcggggcttaaaaaaaaaataagcagggtggccgggcgcggtggttcatgcctgttaatcccagcgctttgggaggccgagactggcggatcacctgaggttgggagttcgagaccagcctgaccaacatggagaaaccccatcgctactaaaaatacaaaattagccaggagtggtggcgcatgcctgtaatcccagctacttgggaggctgaggcaggagaatcgcttgaacccaggaggcggaggttgcagtgagccgagatagcgccattgcactccagcctctgtaacaagagcgaaactccgtctcgaataaaaaaataaaataataagcagggttatgtaccagagcaagctgggcaggggaggggctccatgcaggtgtctggacagacctcctgaaagaggtcctacttgagcagagcctgagaaatgagaaggagccagcagccacgtgaagagctggagaaagcacattcctggcagaggcaatggcagagagagaggggttgagtgtgagaggaagaagagggaggccaggctggctggcgacaagcagggaaggcggagtgagagacaggctggtgggagaagtgcggagtgacagctagtgggtgcagagtttctctttggggtgataaaaatgttctaaaattgactgtggtgatgattgcacaattctgtgaatacacccaaacactgaactgtatacattaagtgggtgaactgtatggtattcaattgttctggattttattataagcacattgagaggttctttcttagtcctcatcctttgaacaagcactggcccaaacccacccccgctgcagccctgtcttccctcctggctgagaggaggcaggttcagggctgtggcagctcggtgaggacgtatgacgaacaagatctctctccttccccagataggcctggcggatagaggatggaagagggggaatatgggcaaggtggggagagagaaggcctcaccttgggaaactggtaggagacttcggggaggtaggtgtttcgcgatggcttcttcttgagggacaccaccacaaagtactcaaaaagctcccgctcctgccactccagcagctccagctccagcgtgcgatagctgggggcgcgcttcagcatcgactggatgtggaccaggcgctgtgtgtgggctggaggcaggttgcacatcagggaatggaccctcacaggcctcatgttaactcctctacccctggctcagggctccattgctgtggagcacttttaagtacgtgagcctagtctgataccatccccagctcacagtgcaggaggaccggcaggcacaaggtgctgacccctgcacaaagactctgccctgacacaggaagctgcgggcctggtcctcctggagcctctggagactgagctggggcaggaggactgccgaggccaggcaaacccagggatgtatcttggcacccactctgtccctgtaccaaaaggactagaatacacgaacatccacgaaggcttcatccttgggcccctagcaggacatgctcctacatccaaagtccacttgcccatttgcctggggatgagaggataatcatccaggaaggcctaggcagggtttcccagtagagaaagcacaaagatttatccaaggaccctggaatgtgaaggttccagaaccttttcaagctcctctctggggacaggggagatgggggactgcagggcctccagagaaacagtttcctcagtctacggcacatttcttgccagaagaggtccttgtaatcttctgtacccctctctgaccctccagatctacaattttttttttgagacagagtcttgctctgtcgcccaggctagagtgcagtggcatgatctcagctcactacaacctccgcctcccgggttcaagtgattctcctgcctcagcctcccaagtagctggtattacacgcgcccgccaccgtgcctggctaatttttgtattattttagtagagatggggtttcaccatcttagccaggctggtctcgaactcctgacctcgtgatctgcccgccttggcctcccaaagtgctgggattacaggcatgagccaccgcgcccggctgagatctacaacatttaccaggcaaatctagcacccaactcccatggacaatggcttgggacagtttgggcaggtcaccacccttacatttggcaaagggagacatctggatttaaccttgcagggctgagctcacatgtctataaggacagacttccctgtggctccctgctctattgttctggtatctggcctgtctgtcacctctccacatcaggccggttagggacactggaaccacacatgcatcggaagggaaggctgattccctgcagccctgctgggagagcttccgtactcatgggagctgtgcctcacctttgaacctgtcatcagagtcgctctcgctctcactgttttcatctggaaaaggaacagcagagtacatacttgctggacctcacagccaatgttttttgctcccccaccaccccagcttttctcacaggggatggatctctaccttctctgggctactctgggcccatggtcaggcatctgcaggcagggagctgagtggcctggggccaggctccttcagagctcacactgcgaatcctatattcaaacccatgagggaagctgagggcctgagttggaggctgagccagaagaggggcctacaggcctggaaaagatggaccctgcctccaggaggtcaagatttgaaatgggaaacagaccgcaatgctcagtgagtctggcctttccttttgcagaagccgattcccacacccacctccctgctcagggcctcacagcccaaagtctgaaggaacccatcccagacctttcttccctgtctgctcctccctcctacgtggccatttcctggcagggctctaccctccacaggtaaattgatgcctctcccgttcctaatgcccaagggccccaaacagctgaaccagctctggcaccaaagcctacctctcagtgatgctgtttcaatgctggacatagacaacttttttaatctcttctttcctctcttggcattgtagatggagttaattctttggacaagctgggtgagaaaagcaggatgggtgaggtaaccttaacaccagctgccctacttccaagaaggctgagtaggagcccatccctgcccttaatggtacaagctttctgcattgcacccgctgggtccaggactggtctaactgcagaaccgacctcaagtggtgactcaccagccatgcatggtagctctccatatacctagtcccccaggagtggtctcctgccccaagacaaggacactaaacttagctccccagaggaaggaactgtgatcaaactagacaggatggtagctcctgggtcccaagagtcattgaaccaactgagacaaagagcctctgagatgcaataacaggaacaaggattctagcctttcccctctgggccataacctggggccccgacaggaagaagctaaattcccaatatacccaagcattgtttgcaggttaaaaataccatctggctaaatcctgctgcgttgggctggggatttgggcctggctgcctatgtgtgaaaatcattgctgaaaattcttcaatgctgagagttataggaagaacccttgtttgagtcctaggtccttgaaagcctggaaatgcttatgtgtgcggataccccaaaattcatacaccacacttactaatggggaacctcggctagactttccttcctctaacatctgagcaccaaggtcagttaatgcatctttattgataagaaaggggaattaatcagatgaaaaagaggccagtgcacggacccagaatttattcaaagggaatcgaggaagcagtccagattagggaaggaaggaagccaggaaagagagagaaaggctggctgcctgcccgcccacctgcccggctccagtgggctgcctctggggagggtaccttgggaatgcggcgggcccggcggctggacagcagctcgctggtggtgctgaggctgtcttcattgaggctggagggtgaggacggcagactcagctgagccagcagcagcatgtcgtcatggctgtgcctcttgggtaatcgtggcagccggtggctcttcctttctgaccagttcccactgcgcagggactggctgttgggtttcagggaaagctggcgtgggggagaggacgtgcgagaggggcttgccacagaggccttggccagtgtctgtctgctgggatggggacacagaggccaagggccggcatccctggatccccgccatcttgccctggaacttccatccctctcttaagactttagctgctaatcagccaggtcagggatagattagatacttgccttccctaaaggaagcttcactactgccagcaaaaaacgaaagcagaggctaaaaacacctgtgctctcatctgagtggaaaaagaagactaagtgggaattttgcgggggtcctcctgagctatgggacaagaattactgggcctgggtgatggaaccagtcttccggacctctgctcccgagccaatcctaaaaggtttctgacagcagaggccataacctactggccagcctgctgggctgggagatcctgcagcctggccctcctaactgctcccatggagaacacaggggctctgggctctgaccaccaaagctgggccaggcaggcctcacactgaattggatcccatacccacaaggccctggctgccctctccccagccctgatctactctctgcctctctccatatgcgctgacctctcatcccagggcaccatccttgtcgcggaccctgtcaggaggcaagtatcccacagacacccaaccactgtctggttctggaattgcctctcctcactcctcagcaaatcctccttcctccacagcccccaatttcctgttctcacccaatcaatctggcaatgcaaactcaggggaagcctgtttgaaaagagtcctaattagagggtaaatctttttttttttttttgagacggagtctcgctgtgtcgcccaggtaggagtgcagtggagcgatcttggcttactgcaacctccgtcttccgagttcaagcaattatcctgcctcagcctcccaagcagctgggactacaggcgtgcgccatcatgcccagctaatgtttgtatttttagtagagatgaggtttcactggccaggctggtcttgaactcctgacctcagatgatctgcccaccttggcctcccaaagtgctaggattacatgcgtgagccaccactcccagctatggggtaaatcttttataaaaacaaacaccttattccaaaggcagaagaaatcatttttatattatcattttatattatctggccaatgctatataatatccaggtccttccatttgcaaagagaattagagttacctggggaggtcagagaagcctctccacctgcctcctgacatcctggacaaggacagaaggagctgaagtccaagagcttcctttggcttttcacctttcctgtcattctgccttctccccatccattccttaaagattcatgcttactctctcccacaggactggctccaggtgtcacagacacctgtctggctctccaaatgtggtttggggacctacacctagccccctaatgccagtactgagatgacttctggcagagttgcagaatgccaagactcccactagggccctgtcttcctgtttcccacagggtgataaataatcagagaggagactgcaagggctcctggctgagttttgcagctcagagcttgtgtaggaagggaaagaagataggacaggatgcccctcagagcaggtgccaattgtccacagaggtttcaacatggtggacatccttgagtgcacagtcctttgctgaggagacctcctttatcagacgagatcgggcacgttcagggtggtatggccgtagaccctttatcaagtactagtgagggtaaaagcctgagtggaagctgggcccaagtcttggaagagcaggcccccactgtggccctcacgctaaccctacaggccgatgtcagggctgagttacctgtgtgggcgggctgttgtacttcctgtcctgaggactccacatcctgtgcaaagagtccaaggagttctcagacagttgctgggattttcgtcctgctcttcggctctttaagtccacatcctcatatggattctccttgggcagatctcctgcagaggaggaagagttagagaagggggagaagggaagaaggaaacacacgaactcacacacacacaaataaacaagcagaattcctgtgaaccaaagagaatggcttctgcctggcccctcagctcatgagtcatgcagctgcccgtctgcagtggggaggctacaaacagatcctggctccaagtccagaagcagacccacccccccaccccccccaaccccccacccccagcccagctcagcctggcctctgctttataaattcagggattgcacaagactggctcagccacccctgcctgtgcccagccagaggacaaagccagcaacaagagtctttccttggctcccttccctctgctgcaaacaccccagagataacacagttcaaggtaggaagggttttcaggtcacatggctgtcccttcacccaactctcaggggatctccctggggacctactttggagggtgggcatggaggaactcacagaaccgtagggagcagggcttcgccaggcccccttctcacctacgatgccgttcaacaagtcttttagggcagggttttgtgttgttcactgaggcaacctcggaacggaacagtgattagcaaggaggaagtgttcagtaatgatctgttcgatgactctcctactgtagtgtctattccctctaccgctgatctcagcaaaaagagaaccatcaacactccccttttggaacaaactctcctgctgtgacacaggggaggtgtgaaaggcttggaaggagtctgggccaaagggtgggggtgaggggagttcttgcttctcaggactagttctaaaatctctggcagcgggcattgtattggcattaccagaaaatctcagaaaagtccaaaacagaatccctgcccttgaagatgttgagtggcactcctttccacaagctgtatctcctgcccccacccctccaacacacacattttctaaaatagagtaacaccatgggccgggtcagtcctagctcaatcctggtggcagaatccgtggggtgaacaggtccctggggaactcagaacacagccctctctgcacccctttccctattttcctgctgcagagcaggactcactccagcacctctgctcagcagcaggattgagcctgggtgccactgagtcccacacttgttctacagatgtctgaatgtgccttacgccccagaggaactcagaccccactcctcaggaagcaggcagaagaaggagctggaggacgaggaacaaaggctgctgagagtgaagctttcctagagaggacacgggagaagagccaatccctatatgcttgcagattcctccatttccaaagtggagctccctccacattgtggcatctacttatgcagaaccacaacgaatttaggaaatgctctaacagagttagggtgtgggtgtgaaggagggatttcagtgacagctaaatagactgcagtgggagcaatataaatctctgtaaacttatgagtcaaagatgggtcactgggatttgggactggattaagtgattcccaactccaagcagagtccccagcaatggaacagaccttttcctgtaacacagtcatgctattaaaatgacttgtctccattccagagccctgactaagcggagctggcccagcagccctgtcgcaagaagccaaatagcaaacccggcaccccctgcatgttttctccagcctaccccactgtggggcacttagggaggtgttggggatggattctctacttcttgatccttccccaacatatgccctgcaggagtgaggaggtgggggaactaagaagggagaatgccaggacacagtcttctgatcccctaaaacaggaccagagcatcactgtccacatcacggcagggagaacatttatgccaagctcaacaaatcgaaactgccttggactgcatgatcagccagggcctttattgtcatccccaacctataggaagccttgtcccaatcccaggggtttctccaagccactgacatttggggttgaataattcttgttgtggtagactgtcctgtccatttttaggatgtttagtggcaaccttggcttctatccaccaggagacattagcatctccttagctataacagccaaaaatgtctccagacactgccagatgctctctgggacggacagagggaaggagggagagagagggagggaggcaggaatggagggagggaagagtgaagttgtcccccaactgagaaccactgctttagatagagctttctaaacttccaatggcttctgagtgtgacatgagtcccaagactagccctcttttttttccatccttccctccttcacctcactccctccttccttccttcttttccctacagtaagagctttgaatattgatacaaaatccaaagctccaagaaaaagacataggatactgaggcccagggaagtaatagatgtacaagcctggtgcacatcactgacaacccaggggaaaacagccagcaacatcaggttctcaagataggtcctgtctctggaaactcaatttcaggaaggcctgctcctccccagccccttgtgccagcctctcttctccagcaatgtttaacatcctgtctaatgtaacaaagccactaatcagttctccagcaaatagacggctggctgcagcccacacgctgcctccccagcctcagcttggtcccttcactgccctaactcatctctcagcttcctggaccattcctgactgccccggaggagctgtctcaaatagattctcccagtcatctctccaggtggacaggggaccaggggatggagatgtacagagacaagtggaccctgagtcctggaccactaaactgaaccagctgagagcaaataagtatcaaaggaatggctcagagttggaggagacggtaggctgggaaatggtgtgcagaacatcctagggaggacagagctaaaggagctaaggctgaatgggagattcagcaggggcatgaatgggagacagggagcctggcagactgcaaatttctacctgcattcctgcccacacagctttcttgggacagtccacatgacccttggagagggacgaagaggtggaccctcttccctgaaggcctggccctcagcaagcccagctggagaagccagaggtctcaacctttcccagcttggatgatgaaataagggacaaaaggcatcaccgagaatttctgctttgcactcttctaaaaggggattatcagagcccaaaggtgtcacacaaatcctcttaaaggaagaatccagcccctctgggccctgctcccactcctccccacaacctcccactcctccctacaacctcccactcctctccacaacctttcactcctccccataactcctttggtcttaaccacacatacagcactcccccagccccaacctaactggaaaaaccagttaggaaaggggtgtgtgtatacgcacaggcactgagaatttctccaaacacagtcctaagcttcctggaccacacccattactagggtcctgggtctgcagcttccctccccaacaacctccgtccggttccaaccagctgtttctcctggttctcagcctttttccctctctcacacaggacagaaagggccaggataagagcccaactccctggcaacagatcagactggggcctctaaggggctggctgttgcccaccctccaagccttgacaccatttctcgacagccccggcaccttccctgggctgcacctcttggctgttttgtttcccactgcaacctccatcccagtgggtgccctctgctccttactgtttcccagcctgggggcaaataagggaagcaaccagagagagtggaggctcaaaagactttgcagtccaggctgactggcccggtccccggcttgcatcccactgaagttcctggaaacgctccctcagcccaggctagctgatgggagtgggaatctgcaggaatgcagctcaggcgccgaggccactccacataattccttaacaagctgcttccttgggtgcatttttaagtgtcaggctcagaatgcaaacataaggcctggtagaatagcagcatcttccaggggcagatgtgagatgggacaggcgggaaatagcagccctggaagcagcaaggcagtaactttctttccgaactccttttctgcaagttagcaaggtaaacctcagtatgtttgggagtaccccaccccagctcctcaggcatcatgcctagtgtaggcaggaggccagcaaaccctccacaacccccattcgagtccactgttcacagacagacatgtttgtcttggggccaactggccctccacctatgacagacaggactccagtccaatcaccaggacccaagatggagatgagcactaggctctctgcctcccaacagctccattcctgcatgcctgcaggagcctgatccagcggggtcagagtcatccttcaccccacagagcacaggctgggccaagaccagagagacggctcccaggaagtccgagccactgatcagtcctaagcaagacgggaaactgccattctgagttcagcaataagacaccccctgaagccttgtggggagctccaaactctcgggcctgtccccagggaaggaaaaggaaacccaccagaatctaacagaaagagagtattttcctctgtatttccctctggcctccctagtcaggtcccagaaattcagattgggctgctatggggacataaaaagggaaaacacgcacagggcactgtcctaactgcagactccggaaaccacccccaccaccccacgaggccaaagcaaaacctaaacatccgatgcagtatattcccaaactggtgcctgggtcgctcccctccctttctcctgcatcctccccctctcttctttccctgttctctaagtgctccaaagatccagaagccaggtgagcagctacctctaccttctgcccacacagcgctgacccctagctgtactcagccacccaagaggcagccaaggtgctcccatattttttttaactcctcatgcaacacccagagtggaagagagtcctccctaatgagtggggaggcagctctgttgccccaccccctccctacctcctgttgcagggtacattctagtttggcagaaactgcaatgtgtcagtttgctgcccaggaccctgggagcacccagtgtggctgctgccgtgggcagagagggctgtgtttttctgatgtcccttgactatgctgggtgctggcaatcctgtggtcctcccattctctattatctgacaaggatttcctgtggggatacgttcttggatcatctgaactgaaataatttgagaaagggacggcttcaaccatttctctctgtccagagttccaccatccagggctctgttcaggattttttggggcaatgtttggggggcagaattttggaagaactgttctgggcaacacagctgttccccaggccttcttaggtcaggtttgagagaagggaaagaggagggcaagtgtgtctaggcctctgcctactcactcattcgggaggactttcttccactctgggatgttagtcttgcataaggaggtgagaaatacaggaacagcactggctgcctcttgggtggctgagtagaactggggtatgggctgcagttggggcatcttccttaactgcccacctggcttctggatcttttgttctgatgcccctagctcttgacctctgctctgggtggcctataggtacaaagctgtcttttccccagtggtaagggaaagggcctccctccccaaactcttttgcggttctagggacctcattcccacagtcttcctgctgtgacccagttttgcatggctacatactatacgctctgttcctgggaaagcagtgtccctgcacatcccagcatggctgctgtctccccagaaacaatggcccagcaagtggtaaggaaacggctgtgaaaccaatggctcagatcaaatgagggaacagatggccctctcttcataagattccaggcttctggctcacgcctataatcccagaactttgggagaccgaggcaggcggatcatgaagccaggagatcgagaccatcctggctaacacggtgaaaccctgtctctactaaaaatacaaaaaaattagccaggtgtggtggcgggcacctgtagtcccagctgctgggaaggctgaggcagaagaatggcatgaacccgggatgcggagcttgcagtgagccgagatcgcaccactgcactccagcctgggtgacagagcgagactccgtctcaaaaaaaaaaaaaagattccaggcttctgataatctggaggtttccctctaccctgggccacttctctctctcatgtattaactaacaccacattcttcagattcaaggcccaagacagaggcaagacagggacatagagagggagccagcaagcaggcagcacacagcctctctcctcctcactgacctacactgacacgcacacttcacttgggcagaatcaaagccccttactgatgaggatgctaatagaattgaaatgaacgccaaaaaacaaaacaaatgcaacccaggctagagcattctatctttcatctgatctgtgaacacaagtttgccaataccatgtcttcccacctgttggaagacaaatcccaatggagtctcgcatttctgcccttcttctgaacaagaggaactgacagttccagactgtattttaaagggtatttatacagcaaacagccttggaagacagagatagtgtctcccttcagggcagaggcagatttgtttcctgaccagagtgataaagataatgtctcctccaaggacaaaggttaggcaggtttgccagcagtctctgaaaagactggggtttcctacgcttgggctccccagctgggacatggacctgcagtgtgtgcagcttccacctgggccttctccacaccgccccatgggacttaggcacaaggggaaacccgtgtgaacacgaagctcatgctgcctactgtgccataagtaataaagtcctttgcgacccaggggtctcgtgtcttctgccagcaccatgaaactggggcaatgaaatgtgttagcttgtacaatagactgaatgtttctgtcccccaaaattcctatgtggaaacacaggtgaggcctctgggaggtgattaggtcatgagtgcagggccttcaccaattagggcccttttaaaagagaccccagagaactccctccgccccttccaccatgtaagaacacagaaagaagatggccatctctgaccaggtagcaggcctgcaccagacactcaatcttatttaattctaacaataaccttatgaaatattacttttttttttttttttgagacggagtttcactcatgttgcccaggcaggagtgcaatggcacgatctcagctcactgcaacctctgcctcccgggttcaagcaattctcctgcctcagcctccctagtagctgggattacaggtgcctgccaccatgctcagctaattttttgtatttttagtagagatggaggctggtctcgaactcctgaccttaggtgatccaccagcctcggcctcccaaagtgctggaattacaggcacgagccaccatgcccggctcgaaatattattactattattgttgttgttaatatagtcacatcatcatgttataagagaaaaacagagtcttcacaaaagttaagtgatttgccttaagggcacacagctaaggaagagggcctgttggacttcaaagccttccaaaaataaaggaaaggaatgatgttgttttctccttctcgtgtccccaaaggtcctttggatttcagttcattcaagagccaggcttttaatcacaaagccactctgtctaagctaaggtgcttcccctgatgtcccattccaggaggagttccagaaggtgggaccatgcctgcccacagtgaaggaggtcaatctaggtgtctcctcctgttcctgttcttctgcagccccctgagatgacccaggtgccacctctgccattgcttacccacaatatcttcataggcattttcttctaaagtgcttttggatccaaacttgggttggttctcagtaccattctcagtgggagaagaggggtacagggactggagactggatgcatcctcaaactcaaaggattttctgtggataacaagagcaagagtcattcctgctgaatcagatctctgctgccttgctggggaatgtccatggcaacagcaaagaccataggccctccttacaaaggcagcttctgaaagagcatcaaggtgggtccaaacttaccatccaaatgaagagacagatggtctgaaaggccccagcctgggtgcctgcaatgtgccttatcctgaataataccgctattagataacaactaccccagcttaaaagcatgctgttccaggtgctgcgtcaaatccacctttacatgtgttatctcattaatcttcacaacagtgccaccagtattgggacatcttgtgaaagaggagatggaagtgacagaggcatgattctcccaggcgacgtctcactccagggcctgagctcttaactataattttggccttgagccctagagaatatcctccttgagaagtgtctgtgattccactggaattgagtgcctggtctgcctctggagtctcacatcctcatctgcatcctagctggggactcctgccactgcactaagcaggtaggaaggctcaacactgggagggtcccactcagggctgtcagggggttggaaaagcagttgttgctgggtggtttgttgaagcaggaagggctgagcccttaaaacaaataagaccactgccaaggtggagctgggaggacaatttgcagccagaagctgcttccaagaccaggcttcccttcagctagcttgctcctttccatcctttggacaaccttcctctctactgtataatttcaagaccacagcttgttgtctcctaagacaccctgagcctacagcactctctgcccctctccttcatgagagaggtacgtccctcatctgagaccccaactgtaccctctccctctccaaggcaagtccccgcaggctcctggggagggaaagaaggaaaggcactgactggatccctcctcccacccatgaacacctccctcttctttggggcaccatcagacctttcagccaataaagccctttttctcttgtttactaacagcttctcctgagagtcctagggtgtaggtaaagggctaaaagtgtcctgaaggctacagcttgttcttagcttgcctgcccctgccccgccccaagcactcaacacaaccgaacactctttatattgacatctcctccgtgtgcctctgtgacacattccctcctggctttcaactaactctctggccactacttttcagactcttgtgaggggttctccttttccatttgccttttaagtgtccgggtctctcagagttctgtcttaaaaactctttctcactctgcactttctagggaccaaatatccatgggccattgccatatctaccatctctatcttgatgactcccagatttctgtctttggcccagagattctcaactagttaaacatccaatggctgagcacagtggttcgcaaatgttggcccaggaccagagttagtgtgagagcaagttttctttggcatatacagtagactcagcatcgtatgcaggtagccctcaagtcagtaaataagacacaaatcatgttcagtcaaattatccttgaaaatcccccaggaaggtgtcacactgaggaccaacatgctgtctctcattaaaactaatagtttctccccaggtttttttttttttttttggctgaatgccagaagaaacatttggcttggcttgcattttacacaaacacacacacacacacacacacacacacacacacacacacacacgcaaatttttttgagagacaaggtcttgtgctgttgcccaggctagagtgcagtggtgtgatcatactcgctgtaccctcaacctcctgggctcaagctatcctccctcctcagcctcccaagtagctgagactgcaggcacatgccaacactccagctaattttttaaattttttgtagagatgaggtctcattatgttgcccaggctgtctcgaactcctggtcttaaatgatcctcccactttagcctcccaaagtgctggaattacaggtgtaagccacctcacctggactgcattttttttaaaataaaaaagtatattaaatataagaatcacacttggtataacagacacaaacttaccatctctactcctcatggaacatgttcactgtgtgaaatggcatacagaacagactgcacttctggaactgtttctctttttccaagagcacagatttaagtttgctaagttaattcttacatgaagggactcctccatatatggtatacgtgtgtatatattatatataaatgcagtgtggggtggaatatgtgtaaaaccttcaggctgatgaactctcccccccactccctttggtcacctagccaactgcttttggctcttctaaatttagctcagcaactccctctatgaggagcctcccttctctcccccatctaactcagatgccccttctctgggtctctgcggcctcctgcactgccatgagtcatggcacgtatgacattatctatgatttatctgtgcaccagaccacgaagtccttgaatggaagaaccatgtcctatttgcctctgcatcctcttgaccagcacaatcttggtgcacagcaggctctagaagaatgtttatagaaatggatgaacaaggacaaagcaaacactcttggcaggccgtttaagaattaaagagccagtgagcattctggggtggactcaaacacgggattacccttagccacgggctgttccggctcgggggtctgaatctttgaaatttcttcctttctgcacatggcaggaaagtttatatatgagatgggatatgttagatgaagcctgaagtgtggggacaaactaaagaatccccagaagtgaaacaaacctgaatacccatcagtcgtggggttagatgagaatggcagtaaggtgtaggaggataagtattcccaaggaagctcactcccagcctaccctgattcagagaacaagacgcctgccagctttcaccaattccaatagctccagctccaagttaccggggagacagcccttggtaatctggggttagaaatcctgagactgaccaggaaaccaacgtgagcctcggaacaggctcattcctgttttactccttttttcatcaatcttcccaataatcccctcttgatataggcccagggttcgtatatggccaggaggccttcaggagagaaggaattgtgttaaatttgccgacactaccatgttaatgataaaatgcagtattcagataatgcttcattcaaagaaattaatttctaatgctggtacttcaggtggtagggaggctaagatcctactactccgcaaaggactgcctgctttacctactcccaacagaagactgaggaagctacaacaggggcaggacacagcccagctctaccccaaaggccaaacccagccaataccttcagtgaccagcactcaggtcccaagtatcctgtaagcattcccactcatgtccaagtatcttgtaagagcagaacaatctcatttttcactaccacaactaccacctaacaattattcagcacttcagagcttacgaagcactaatgactgcgacccatcctacaatctgtgtttgcactgtccatttaaaagaaagccacggtattcagctacaacacaccggaggggcatgcattacctgctctgggacttgcggtgaccacgcatgtccttcttgggtctccgggtgactggcggggctggggtggagggcaagggaggtggagcagcaggtgtgggtgaaggaggtagaccattactgggcttactcttggggttcttgtcagcctcgtattcaaaggtgcgcttgggtttggggacagggttcacagcgggatcgagggaactcttcgatggcagccgctgggagctagggctatttccaggggtcccgggcttagtggaaccactgccttccctctctgggggtgggcccgcctcccccgcaacaccagccactccgactgcccggctgccagcgctcacactcgcgccccctgccggctcctccaaggagcccaaggttccagtcttccttttcccccggtccacgctgtagcagctgctggggagctgggggagcccccggcccggctgctccttcaggacctgttcaattttctggatccggctcagcactgctgagctctccttcctgctgccatgccccctgaggaaggcgctgggctcactccggcccagccgtttctccagccggtagaaagagtcccggacagggagcgcctctccctcctcctcagtctctgggtaggaacactcggagaaggtcctgctcatcctccggaggcccttgaaatcaaaggtcttttcagagctgcagggggacggcaccacgctgggacagcccaggctggggcagccctcactggccgcccactcgctcccagagccctcccgcttctctccacacatgctcatcctgggcgacgcctctcggcgaccttcccatgctgatatcttctcccggatgcccaggctgtgggcgcgggtaccggtacgggtcagcaagacgccccgggggccagctgctggccccgggaatggcgtgctctgggcaagggggaggcaggcagcgacccctgctacatcctgggctgcgccttggacactttccttttgggcgtctctcttgcacgccgaagggcttctgtccaaataaccgaagctggcggtcttgaagggacaggtgggtggggaagtatctggggagggatcttgaggattctggggtgaaggagctggggggtgccggtccttgaggagcacccgggagctggagtggctggggtacctgcaggctgaggtttcactatcactgagcgggtagatgggactccttggtggggagagaactggaggtggagagactgactgagacctgggggcaaaacaaaacaaaggaaaagaaaagaaaatggcagtgagtggctgaccaaccagtggcatcctgttttattcttacagaactcagcatctttttcctggaggactctcaaagagtattctattcaagtaatataccttgaaggctgtcttcaaggagagcaatagctccttaatcacagcaggccaaactcaacaggcctctctgcccaaaccatccccaggcaccctgagtaatgtctgaaacagacacctgttctgtgccaagcgagagcatcccaagagtctaacatctgccagtaagaggacagaaagcccagtggtgtgctgccacatgcttaacaaccagttctcagaaggtgtggtggctcatgcctgtaatcccagcacttagagaggcagaggcaagaggatcgcttgagcccagcagttcaagaccagcctgggcaacatagtgagactctgtgtatggtaaaaagagggaaaaagggaccaaaaaccccaaaaccaaacaagtctgaacaaccggctctctaggggcaacagcagattggtagcacttgccaactttggtagtataaatattccaactatggctgagctaccaatgtgacgtcactggctgtggagttgagaagagatgccactaatcagctcttgtgaactggtgcaaggtggttcttgaacactactccctgaagtggcccccaaatacactcagaccctttgatctttccctttaacaagcctctgtctcccctgggacttctgctactagacataacatctcacttcttcatgttgggttctgaccagaattagaatccctgagggcctcagacaggtcagaagcgcccctcaggaaagagtcttttccactctatcattgaggaagccaatggggtggggaggccaactccttaggcagctccaccctccagcagtggcatcacatccaataattggcatctaccatgtcccagctccaaatccatatgcagatcttggcaactacaaggaacacttctgaataaatgtttttacatatgttaactcatttaatcttcctgaaaagtctatgaggttatcatgtttattatcttcattttacaaataaaaaacactaaggcacagaaaggtttaatatctcatccgaggtcactcagctggtaagtgaaaccaggacgtgaacttccactacactgggctgactctctgaagaggaagcagtgcctctgccactttctgaactgccagggccctgaggcaactcaagagaaatccccacagcactcagcacacccctgccacagcacttgtaagtatcaagggacttcttggtcttccctactagaccatggtttcttctaggcccagggacaaacaaatagtgtctggaaggtgctcggtgaatgatgaagagcaaaaggaagggaaaggtgagcttattgaagagcaccatgagcatacttcctcttgggcacacttttctacttgtctactagagtaaccactgtcaactttcagaattctttccaaacagtttcagttcaaaaacagcaggatttgccaacactgcacagcacaaggcctacctgaccctaaggccgtggccctcagctctgggctgcccagcctctcaggctccggaatgccatgctatccacaggaaggcagccagctgcccctgagccaggctgctgtcactgctcgctcacacacagaaaactggagtttgggtgagtcagggattggctgacaattccctgctgggtcacaggcctctggctgcccccaatcaacaggaaacctcaacatgcttaagttgtttttcaaagggcaagtcaaacaagagccatcccatgtgtatatgggcacagatgagagaaattcagtgccaagccaagccaatgaccaaagaggctctgctcagtgaggaggtgtgaacagagtaagcctccgcactccctggggtagggagcggcagggcaagtcgccaggcttgaggcggggggagatcccaacttcctcacagttcatggaggccttaggtctctcttattttatagaaccataaatacaaaaggtcatcagtctagcccctaagtgaatgagtgtctgtgctacacaaaggactctgttttagttctcaactgaagatgcatttgacagaggacaatttcatttgtttattcattcgacaaatacttagtgagcacctactctgtgctaggcctgttctaggtgctagatacaagaataaacaacacagacataaattcatgtcctcgtgaagcttatattctactgggagatggcaggcacctaatgagactcacaatctcttgggaagcctttttaaactatacatgcctcacctgctcaggcactttgatatgtggttccctagggctgtgtctccccagcggcccaggagagaattcaccagtccatggaaccactgttacttatggtagtgtggggcatggctccttgggataggaaaatgattcaggtcctctggtccatctgatcccagcatgctttcagaaagagtgattctataacttcccttagtggctccagcacgaataaatcctcacaggttaagaactttctctcaatgcctaccctgcttcaactgaggtttcatttctcccctctcatgcagcataaaatagagagtagactggccctttcctctgaaggtcctgtctttggtgtcactgctgacctgggacccacggcttcacgtgctacccttgccccagcctccccacacaggccaggcccagtgcactgtaccacagaggaacctgcctgtgctgacctgaagccccatatcacagagaaggcaccagtcactcattccaaggtctggtaaacaataaagataaggccctgccctcctggggtgacattctcacttgagggtagaattctctgttatctgtctgcatgtttctgattctacctcttattagcaatggactcacactctgaacatccagtttcatttcttcaaaactgttccattttacatcgcagggttgtcatattgagccaatgagaccatggatgcaaaatgctcattatcattagtactgttttttttttttatcaggttatggctagccagtcagtctcaagagagggtaagaacatcacagccttggggttcaagtttcagtgtagccacttataagcttcatgactttgagcaagtaatcttctctccctaagcctcagtttccttaactctaaaatgggtgttggaagatcacgtatctcggccaggtgcagtggctcacgcctgtaatcccggcactttgggaggctgagacagatggatgacctgaggtcaggagttcaagaccagcctggccaacatggcgaaacccagtctctactaaaaataacaaaaattagctgggcgtggtggcaggcaactgtaattgcagtgactcgggaggctgaggcaggagaatcacttgaacccaggaggcggaggttgcagtgagccgagatcacgccattgcactccggcctgggcagcaagagtgaaaacaagagtctcaaaaaaaaaaaaaaaaaaaagaaagatcacatatctcagagaatccctgtgagaaatagtacctgtcgcgcattgagcttggggcctaacacacagtgttccatcttagcttgataattactcatattcacaaggggctggctcttcagagtaatcacctgggaaatttggtcagtttgccactgtcaatggatcctgaacgctgtcggggcaggggggcgggagggcggggagtaaatcaaatatgaccatgaattctcagcagctcaggctatggaaaggtggagtctattgctccgtcactcgaatcttggttgatctcggtgatttgctttgagtataatacaatgtggcagtggaaattgaaattgttcaaattctaaacttgaggcctcaagaggccttgtagtttctccctttacccacctggaatgctgccctgacaccgtcacataaggaagccagtctagtcttttagaggacgagaggtcccatggaatgtgaccgaggcacctctgtcaatagccagcctacaactgcctgactcatgaatgaggccaccttggacccagacccagccggacacagctacatgagtgcgcccaggggaaaccagcagagaaccaccagaaaacccacagaaatgtgagaaacaatcaactgtgttaagccactaagttttggggtgatttgctccacggcagcagtaaaaagatgcaggtgggaaaggccacgcctgcgtatcattggcccatcccatcccaatgcagagccactgccctggccttccttccccacttccccacaggccagcttagcttccatgatgtctggattggatctctctctcactactacaggctctgatgctcttatgggggcaccccctggaagtggagctagttcagccaccctaagaatcagcttccaccagtctttgctcccaggctgaaggagggtcaggagagtctcacctagagagggaacactagggaggcttcaggagggacacaatgggagccaggtgtcaggatgtctagatcctcgtgacaaagagtttgcacagcaggtgtcatcccctggcatggatgggagagagtgctcattcctgggcttcagttcctctctgtctagttgtttcctagttcctcaaactgagactcggagggaaagtaagatcattctcccctgttggacaagaggagaccacggccaagagaagggcagggcctgccttcggatgccaccatgggagcaaagccactgacagtctctagcttcacttcttcatggttcctaggccagctccttgctagccttctctgcatctgaacgaaggaagccacctatcaccaagaccacagtgtgcaaccccaccaggccggagatacattttggctctccatccattcaaccagatatattgagcaccaagtctattccaggcactattttaggctgaggtgggaggactgctagagcctgggaggtcaaggctgcagcaagccacaatcataccactgcactccagcctgggcaacagagtgagaccagagtgagaccttgtctcaaaagaaaaaaaaaaggatcagcagagactaaaaacagacaaagtctctttttctataggttacattctggtagacacacatcaagttgccttatttgtttagagtgagcaggtaacatatcaactctgtgagacggtttgggggccaataaagaagaataaagaaggggaaagggatcagagatgagcagtagagatgagttgctgttttacatagggaggtcagggaagcccctcttgccaggggacacatgaacacaacccaaaggaagtgagcaatgtgtctatccaggggaggaatgttccagacagaaagtgcagtagggcaaagataaccgcatgcctactgtattccaggggcaacaaggaggccagtgtggccagagtggagggaaacaatgaagtgtgggctggagatgagcctgagagacaccagaagccacattatggaaggccccatgggccactgataagacttgggcttacactctcaagagaaggaagctcttgagtggatgtgagcaggacagtgacagaatctgacttcacatcagaggatgacaggcaggggtacaaaggtggcaacaaggagactatttagaatgccactgcagcaatccagacaaacgattattatgatgactcggatcagaagggtactggtagagacggatctactttgagggctgggccaatgcaatttgctgatgggttagatgagcagtgagacacaaacgggaagtctaggacagcatcaggatatttggcctgagcactggtagaatagagtctgggttataaatttcaatatgggagtcattagtggtatatagaaatatttaaaaccatgtggccaaataagatcctctagagcgtaagtgtagctagagaagtccaagtgctgggacgttccagtgtgttggggtctggacaaggaagaagaactagccaaggagaccgattgagaagaggatttagtgagaaaagaagaaaacatgaagagcaatgtcctgagacacttaagaaacagggagtgatcaactgagtcaaacctgccaacaactaagtaagagaaggactgagaaatgatttgaaacatggaggtcactgtgacctgacgaagagaggttttggtagagaggtaggaagggaagcacgactggaaaaattcaagaaaagggaggagaagcagtggagacagagtacagacaactcttttagagttttcctaaaaaaggaacaaagaaatgggatggtagctggagaagaatatggcataatggaagcatctttctctctctttttctttctttctctttctctctctctccttccttcctccctccctcctttcttttctttctttcattctttcttctcttcctctccttcctcttcttcctctccttcctctctctcacagggtcttgctctgtcgctcaggctggagtacatagctcactgtaacccaaaaatcctgggctcaagccatcttcccaccttagcctcatgaatagctgggactacaggttcatgccaccaggtccagctaatttttttttttttttcacagatgggggtctcactatgttgcccagataggtcttgaagtcctggcctccagtgatcctcctgccttggcctcccaaagtgctgggattgcaggcatgaaccaccatgccaaccttgtgactgtaattggaatgatccagtagagagggaaaggttgtcagtgcagatacagagggcacaaatgcaggaataacacgcttgagtaggcaacgaagaggtggggacccaacgcccgtctaaaagggctggccttatactagcacccactttcccatgtgcctgcactggacgtctgctctcacagtctcgtccctatgctgctttacgcttcagttgatcactccctgtttcttgagcgtctcaggacatcactcttcatggttttcttcttttctcactaaatgctcttctcagtcggtttccttggctagttcttcttcctcgtccagacctcaaaacactggaacgtcccagcgcttggacttctctagctacacttaacgctctagagaaactcattccagaggggggagaaaaggtcagagtttgttcccctcctgcttcaagcatctggatccagccctctccccaaacacattgatctacttgatgactatgtcctatcaattctacttcctaacatctctcagatgtgtccccctcctccccatccctgctgctactgctacttctttggtctcttaactcctctttctgccttcagtgttaaagcagttttgatccatcctctcatcttctgacattttcccaaaatgaaaaactgatcatgcttgaaactcctcatatctacagaataaaatgcaaattcactggcattgttgatgaggaccccatgagctggtccctgcctactttccccttcattatcccacattgttttccctccttatcaatcctgtatcccacccttaggcacatccaactcttagctctttcacaccctaccccctttcaggtagagatggcctatgcagaggcctccactggggagacatctgtgatggcatgtataacactgcattgcaccagactgtttcctctcccttactagactatgagtgagcccacctgaaggtggtaacagtatcttgttaatcttgatagccccctgcaaagtgcctagaacttaaaaggaattattatttgtgttgaatgactaaatgaatgaaaatgtaaatagttaaaaacctaggcctcttgtatgcctgctcacaacattgtctgcagacttcctcgcctttctctttgtggtgtatgagctgaagaacaacagagaaaggtacacgaagcactcggtgcagcccagtatcgccgtcagcccccgaagccctctcccactaggcacgaaagctacacactggctgggtcctggtcccatcactttctgggtgtgctcatgggcaagccctctaagttctctgtgcctcaggttctttaaacacagacaacacttactctgagtgtcctcacacaccagctgtgtggctaagatgacgcaaatctctaacagtgtttgaacactataaatcattccataaaggtaaaataaataatttttaaaagtaaatacaaagcagccatcagacacccaagactgctcttatcatctctctgttattctacaatcccagagtatgcccctgggaggcagacactgtagaactgggcacttgtgccgtggccttgtcagcaggcagccagttctgctgctcaacacaggcatggatgccaacactgcagcatgcaactggccaaaaccaacattttaaggagagatgaagtaagatgaacagataaaagaaagcaggggagaatgcaaaggacatttaaaagaaacagagcaccataaatgcacacacacacacaaatatgtaagacacataattaggatggaaagaatatgagctaaggtatggaaagagaaataaatttaaagaaaaagtattgtgggccagacatggtggctcatgcctctaattccaacaatttgagaggccaaggtgggaagatcacttgagcccaggagttggagaccagcctaggcaacatggtaaaactctatctctacaaaaaaaaaatttaaaaattagctgggtgtgatggcatgcccccgtggtcccagctactcaagaggctgaggcaggaggatccttgagcccaggaggtcaaggctacagtgagccatggttacaccatggcactctagcctgggcaacaaagtgagatcctgtctcaaaaattaaaaaaaaaaaaaaaagaaacaagaaaagaaaaagcatcatgtgtatgtgtgcgcatgcacatagacagaaagtgagagttaaagtgcataataaatattccctctggcactgtctcacaggaacacgccccaatccctgggctagtgacacaggcccctcttcagtaacacaggcccctcttcagtaacacaagaagcatttgtgctaaggaatgcctcatatattgtcaggtgccccgaggaacttttctggagggaaggctgtctttagtccttgatgaacttggcatgctccaagttgctctgctttttctggttatagggctactacaagtgttagtaacaagaagggactaagctggagctagttgggaaaaagtcctagtagtcctggaaacagcctgagaggtaccatgagtgccatgagtgttatgagtgccatgaagtgagcctgtctgcaggtgaaggttatacagggctcagtgtccaaaatgcttccatccctactaagcaatgtctagcctgcttcaaatgaaactgcctggaaggtggccggccattcagcattctcgggcttctctactaagggccctgttggcttggtggcatcaccatcctcctgccactcagtgactgccccaattctggggatggcattctcactgcgctaccctaaagccatactcttgagcgtggaggagaaaaaggaggaagagtgcctcagtcagcaagtccaagagtttgttccccagcctagagcagaaacttgcccagtaacaagacatagacatcccattccagaaaagtcctgagaaaaagccaaaggacagggtgatactcacaacttggctttcttgctcccaaagcaagcatctcaaacagttgtgagccctcaacagggtccagggcagcctcagcccccaactggggctatatctaggccaccatctatagagattttccaggtccctacagcttgtcagagttacgtgaaaggtagtgagagtcacagcataaattgagttgccttttcaattccagaaagcacatctaagaatctatggaagccacacctgtctgcccccaagctgatttctaaggaagcaccaagtggaccgctgagctcttctccgggagggaatgatgaactctctaaggagcagtggcaagtgaacacagagagaatactgacactgcagaagccccctctgaggttactgatccctgacaggaacatccccagtgccctagtccagtaaagactgggctgctgtataaagcagagccaggcattagacaaagccaagagggaggcaaatccgattccaggaaaccatgccaatggcacttgtggtagttttaaaacgtggtccccaaattctttgacatgcctccagtcaaaataacccctcctcttaaatctgggctctgttactgcttgattgatagcatacaatacaagtgatgtggtgctacttttcaggcccaggcctaaaaaaatcagcagctcctaattcctgtctaccatgctaggagcaagcccaggccacgtggaaagggtacatgtaggtgttctggctgccagtcccaggtaaagccccagcaacagctagaatcccccagacgtggggttaagacatctccaggtgataccagcccctagctactgagccccaccacaagccttgaagtcttttacttttttctttttgagagacagtgtctcactctgttgccaggctgcagtgcagtggcaagatctcagctcactgaagcctggaattcttgggctcaagcgagcctcccgcctcagcctcgtgagtagctgggagcacaggtgcattccagcacactgggctaattttattattattactagtttttgtagagacagggtcttgctatgttgcccagcctggtcttgaactcctgggctcaagtgatccttatgcctcagcctcccaaagtgctgggattacaagcgtgagccactgcgcccagccagccttgaagtctttttagccaaggcagacatcatggagcaggggcaagccatccctgcagtgctctgtctgaattcctaatccatggagtctgggagcataagaacatgttgttttatgccattaaattttttttttgaggtgggtggttggcagtagatgtctggaatatattttggcgcctgcaagagaggtgctactgaaacaaaatcttaaaacagtgacttttgggctgtcagtaggggcataaaggagagtaaggaaatgctattagaagctagaaaagaaggaacccttatagtgttgaaaagcttgtcagctgtggtaacatagataataggaaatacagctaataaatctgatgaactacctaaggagatttgcaggcaaagtgctgaaggtgccatctgacttgctctagctgcctacagtaaaaaagagaaaagaggtaaactaagaaggagctgtttcgttgttaaaatttaaaggaatcacaaatgagaaagggcttgctggttttcacttccagtacctctaggcaggaaaacattctcaaattaagaaatggcttccagattgtggtggctgggcacggtggctcacgcctgtaatcccagcactttgggaggctgagatgggcggatcacctgaggtcaggagtttgagaccagcctgaccaacatggagaaaccctgtctctactaaaaatacaaaattagccaggcatggtggtgcatggctgtaatcccagctacttgggaggctgaggcaggagaatcacttgaacccgggaggcggaggttgcagtgagatgagatcgcgccattgcgctccagcctgggcaacaagagcgaaactccatctcagaaaaagaaaagaagagaaatggcttccagattgtggtgatggttttattgagtatgtgtgtgtgtgtgagtgtgtgtgtgaaaactcaaactgtatactttaaattatataatttattgtactttaattgtccctcaataaatctgtttaaaaaaaatctaaagtgagactgaaaaaccctttgttaagcccccaaaaactggccaggtacggtggctcatgcctataattccagcactttgggaggctgaggcgggtggatcacctgaggtcaggagtttgagaccagcctggtcaacatggcaaaaccccgtctctactaaaaatgcaaaaattagccagatgtagtggcttatgcctgtaatcccagctacttgggaggctgaggcaggagaatcacttgaacctggttggcagaggctgcagtgagccgagatcacaccactgcactccagcctgggtgacagagtgagaccctgtctcaaaaaaaaaaattttttttttaaattacttaaagtgttgcctcatagaacagacagacagacaaaaggcctcctaagaatcttatgagtgggtcctgtaaatcctctctgaagacagtaaggctcctaagaatcttaaaaacctttgtcccatagcaatctcccaagaaatccaaatcgaagtggagaggggcttatctcttcctttttttttttttctttgaaacaaagtctggcccccaggctggagtgtagtggctccatcatggctcactgcagccttgacctcccaggctcaagcgatcctcccacctcagcctccagaggagctgggactacaggtatgcactaccatgcctgattaattttttttttgtagagatgggggcggggtctcactatgtcgcccaggctggtatcgaactcctgagtgcaagcaatcctcccacctcagcctcccaaagtgcttgcattacaggtatgagctactgcacctggccaaggggcttatcttgaagtgatttgtatgtgtgccttttgctattataatggattataaaatgattcataagaaacccatgaagttttttttttttttttgggggacagagttttgctcttgttgcccaggctggagtgcaatggcgtgatctcggctcaccacaacctccgcctcctgggttcaagggattctcctgcctcaggctcccaagtagctgggattacaggtgtgcaccaccatgcccggctaatttttgtatttttagtagagatggggtttctccatgttggtcaggctggtctcgaactcctgatctcaggtgatccacccgcctcggcctcccaaagtgctgggattacaggcatcagccaccgcacccagccaacccatgaagtttttaaaggaaatgtatcagcttggagtaaaaagagcagagatagtacaaaatgaagaaaagactttgggcccttaacatattatgggcatgaagcagatggagaaactactcacctgcaataatgagctacttctatggaaaagaaaagatgagtcagagagcagaaccaaaagcccagagggtgcagctagagacaaggtaaatgagtcaacacctagtcaaagaattagcaacagctgtcccactgaatataagaaatacatcaaaccagtgactgctgggtacctcttattttcccctttttgaaaagaagcctattcagtggttaccctaagcctgtcccaccagtgtcttttgggtagcagatatacattctctttaagttacaggtcttcacagcaagagaaacagtacttaaggagctgcacacaaggaatgaacctgcgccccaaaagtctcatctacatccagacctgatttttttttttttttaagacagggtttcagtctatgcccaagctgaagtgcagtacaatcttggctcactgctacctccatctcccaggctcaagaatcctcctgccttagcttctagaggagctggggctacaggcatgcaccaccacacccagccaacttttttatttttggtagagagggggtttcactatgttgttgcccaggctggtcttgaattcccaggctcaagtgatcctcccaccccaatctccagagtagctgggactacaggtgtgcaccaccacatccagctaatttttgtactttttgtagagatgggttttttccatgttgcccaggctggtctcaaactcctgggctcaagcgatctgcctgcctcagcctccccaagtgctggcattagaggcatgagccaccgcacccggccctatctgtacctgattttggtgacaagattccattgtaatagacttcaagctgatgccatgaataagagaagacctgagattttaggggagagagtgagtgtattttgcatctgggaaagatgtgaattgttgcaatcagagggcagactgtattttccaaagacaggaaccacaacctatcccattccacataccttcttataaagagatgttgagattcctctcagcaggtggtggaaattatcttcctttctcttgaacttgggcagccctttgttactgtcttaatcaatacagcacaatagaagacaaactatctgacttttgaggctagctcattaaaatgccacgcatttttgccttgttctcttgggattcttactcttggaacccagatatcatgctatgaaggcatgctgccaagtgtggaggtgacgtgcaggtgttccctagctttagtcccaactgaccgccagcatcaactgtcatacatgtaagccttcagatgatttcagcccctagccattgagtcacccataactttcaagctacccccagctgatgctgcaaggaacagacacaagctttccttgctgagccctacccaaattgcaattggtgggcaaaataaatattattctaagccactaagtttggggtcatttgttatgtagcaataaataaccagaccagtactgacagcatcatggttggattctaggaagcatctcgagtaacaggggctgaggccacagggcctcctaaggggggcctgccacggccaggacaggccctgcagcactatcttttacccacagctactcaggagatttttcttctctttaggctcttagcttcccccgatctaaggcacagggtccaaatctgtgcctacattggccatggaacctcaagacatctctggatttcactgtatcacaaactgaggccaccctctgcataaaaacctgcaaatatgagttgaaattagggctccactgccaattagctgtgtgggcttacaggttcctcatttgtaatgtaagttactgagccagatatatctcaagatcccttccaactctaacatcccaacagagaatgtatcgggcctccaaagagttccagctgagtaggggaaataagacccacacaaatatccactttatgagatactatatgataagtgccatttggccgttttgaaccaaagattctgagtgaatgcagaggagggagggatttgtcttagttgggtggtcaagaaaaacactgggagagaagtgaataattgtatccagattggcagaaatgtaaggtttgcattagagaacagtgaactattagggcagaaagaaagaccagggccagatcatgaaaagccctgcaaaccaggctaagtttgactttatcatggatagcagtactttgggggcaggaagatcccaggagtgctcataggaagggaatgtgttgggataataaaataacagaaggatgaagagaggcaggcttgagtacctcttcctactagttttgtatccttaaggagtacctcctcttttctgtgcctcagtttcccaatctgtaaatcaaatgggttggactgaatgagctacaaagccccctttcagctctacctttctaagaaactacagactagatgaaaacagagtccaaagctaagatgacccattaggaaggtactataaggactcaagtagtacaacagcctatgctctaagaggctgctctcccatctatctagttgactaatcaacaaatagctaatggcttctacgtgccaggcattgttccaggctctaggcacacagaaagacatcaaagtccttgccctcaagaattatatattctcacacactcagattttcagcacccaccacaagcaaaagttctcaaactcaaggctgatacagtctgttatttccaagttgcaatgacccaggtgctggagtttcatagtgaagaagctgtggaggaaatcagcaggtcttcagagaagagcccctgctgcctgccaggtcttactgcaaaagtgaaatctcctgagagcagtaagtggcaaagttcaccctatctacacagctgaattagctctaaacataatacttccttttttgcaagttaccaacctgcttccagtcccaccccaggtcatcaacaccaacacagtaaaggctgacctctagaattcagaagaggtttgagaatcccaccccagacccccagagtgggatgcagccatatcttgtgagctgaaatgggaacagcctgtggggagagtgtatctggcaggtaaggatgaacagtatgctcattcggcctcatcaacaaaagcgaagacaaggaaacctgctccaggagaccaagatacagcaaagaacaaaactgaggcagtcacatgaaaggcttagattttcccctcctacacattcctgccaaatcaagactaagctgcaaaggaaaaggaagggaataaattagcaacacacctgtgaaaacctagggactggaatccagggtctttaacccagacaggcttggtggtagcaccaggtgaagtcttacacaaattaagggtacagtccttcaaatacacaccttgacagttacacagggtcccatctgcccacccccgccagttttccttgaccagacctccctcttccaccaaagctggatacaaatgcgtcttagaaccactgggttcctctgccttcatgtggatgatgtggaagtccccgacgtagccaaagtgtcaaaggcccagctttccaaggccccaacaccctcccctccccaactaaagctctggtcacaccgaggagtctcctccttggattcatgtgctggcaatgataaaagggccccaggtcactaccaaacacctattgaaaggtcaaactaagaaactcaggtgccaagatcatcaatccaagttgtaaataccttggagaaagagaatggatcatccctctttgccctccagtgcccagcacagagcctggcacccaggagaaccctctgagttcaccgacaatgccttcctaaatgaactggtgatttactgccttagcccaaagaacacacccagatgtggccaggggtgaaggcagccaaagaaaccaccagatcacaatgtctaaataatacctacaccccaggggtagtctctgagagaagggtgtcactagccacagaggcctgcaacttcacaccaaaagccaggctcccaggaaagaaaggggggagggaaggaaggagagaagcggaaatgtggtaggaaggaagagaagacttagaagggaggcaggaaaggtgctttttttaggcacatctgaggctcagatatttacaaacaccatctagcatgttatgatggcaagcatgctgagaagctaaaggaagagcaatttctgaaaacacttagaagtaagtaggcatttactccaaatagaaactgcagcacctgtcagcagtctcgagtctgctttgaaacttgatgtaaatactgcccctcccacccctctaccccattcctgtatggtggaaattagaaggaaaaaaaaagaatatttaaaggagttgagggttgctgggaatggtaatctccatttcaggtcctaaatatacaatttctttaaaattacaaataaaatgacacaatcacatatatttgtttcactcctacagtagtgtgatattctaaaaaactggaaccttagttttcagccccatctgccagctcaatcatggtaagaatgccactaggctgacaagagcccaacaacatggttcccaggagcaggcaatgggagataaagactctgagaccttgacttgtttctaccttggacaccaacatgttctggaggaggtcagtttctccacctgctttgcccaagaagctgttccttgccactcccagcctcactcagtacagggaagctggtatgccaccaagcccagtctaaatgagagggattgcctgggcaaggggtgttcctatcagtcttgctgctgcaagtggatagtcagtttgcttggctaagtcccaggatcttacgtacttaacaagtcagagtccatcaaaccctgtttggcatagtccatccagactgtttctattgggacaaagtcctgtatgtatggtgtggggaacccctgcctccttcatgacagtcactccccaggggctacatcccgtgcactattctaccaactatatctggactccagttctgaatgaaccaaatgtttaccaccaactctgaccagaccctattggactcagcctagcactgcacagccagatatccaggaatgaactagccctatccaaaccaaagctaagcatccttctcatagctatccatcttagaggcagaggccccaaaagccaaatttgtccacctgacattcagcagaaagggctatgagaggtacacagctttaataaaaaagactaaaggttcttttaagatatcagtgtccagccttggccaagaccagagaagccctggtgagagtactgtgcatctatctgtgcatctgtgagttctggaagctttgatctcatcctcaaaagggggttaaaatttattgagtagctttatgtcagccataatgctaagcactgacatatattatctcatttagtcctcagagaaactctgtaagataactactattattattttatagatgaaataatgaagattttatagggcacagggaaacgttctgagagctcgctatttggtaagtggttagaacctggatttgaaccaaatccatgattccaaaatccacggtttctctaaactcctataaagcctaggctgctgcttggagtttgtgctaatatgcgtaactgcctctctacccttagcccaatgtggtcagcctccctcactacagtgcagcttagctcaggcacaggccccaagctctccccaccatgggaaaaggttacaagccagaagaacatcagctgcttcttgctggccccatccttagaatgctagacacaaagcaaggcttgttttagggttactgtttgctatatcacatagaaacttacagaactagaaaatatcttctgcctaatggtcagcatgagctggcctagaccagtcacctggatgactgtcagtcaagatgatgactatttacattttggagggatcccacccaggacctaggtcccttgatgccacctcccacaagtgctcccttacccacctgctcagagtcccccgaggggctttagtgccaccagctccgtgggtgatgctggaattcttgttggcagtcatggtcatttcggctctctgcaaacccagagccctgcaaagacgacaatgccggtaagccaagtttctataggcagccaaaagcaccttgaacatcttccagatgacctccaaaagtgccaagagggtgtctgtggcaggtagtagaaactgctttcccacttaatgtttaactccatgtgttacagcttaagagaccccaagaaacccctggcctggaatacggaggagtgtgagctaatttgattgtgagtgcaccaatcagcactctgtgtctagctcaaggtttgtgaacacaccaatcagcaccctatgtctagctcagggtttgtggatgcaccaatcggcactctgtatctagctaatctgctggggacttggagaatctttatgtctagctaagggattgtaaatacaccaatcagcactctgcatctagctcaaggtttgtaaacgcaccaatcagcactctgtgtctagctcagggtttgtaaatacatcagtccacaggctgtatctagctaatctagtggggaggtggagaacttttctgtctagctcagggtttgtaaatgcaccaatcagcaccctgtcaaaaaggaccaatcagctctctgtaaaacagaccaatcgactctccgtaaaatggaccaatcagcatgatgtgggtggggccagataagggaataaaagcaggctgcccaagccagcagtggcaacccactcgggtccccttccacactgtggaagctttgtcctttcgccctgcaataaatcttgctactgctcactctttgggtccacactgcctttatgagctgtaacactcactgcgaaggtctgcagcttcactcctgagccagcgagaccacgaacctaccagaaggaaaaaactccgaacacatccgaacatcagaaggaacaaactacagacatgcggcctttaagaactgtaacactcactgcgagggtccacggcttcattcttgaagtcagtgagaccaagaacccaccaattccggacacaatttcacagaaaacaaaataaacaaagaagcccaagaaactccatctccatccatctctcctcattccttaagttagagtttccttaaacttctatcattctatacagtccatggtttttgccatatttgcatatctcctgacatactatttattcaatatttttcttgaatatacttgaaactgacttccttttcttaaaaagaaaaaagtcacctcattctaaacaataaactattcattcaacaaatatttactgagcacccatgtccacggcaaatgtgatccagtgaagagtaatacaaagtctctgacctcatgcagcttacatcccagtggggaaaaacagacaatgagcacacatgaattatcacgtgtgtgataataagtgtaccttcgtgtataatatgtaaggtgatggtaagtggaataaaaaaaaattaagcaaggttgagccgggcgtggtggctcacgcctgtaatcccagcactttgggaggccaaggcaggcagttcacttgaggtcaggagttcagaccagcctgggcaacatggtgaaaccccttctctactaaaaatacaaaaatcagccaggtgtggtggcaggcagctgtaatctcagctacttgggaggctgaggcaggagaattgcttgaacctgggaggaggaggttgcagtgagccaagattgcaccactgcactccagcctgggtgacagggcaagattctgtctcaaaaaaaaaagagagaaaaaaacttaagcaaggtagagggaaagagagtggtgaagagggtatcttattttaaataagatgttcagggaaaaccattacgataaagtaacatttgagtacacatcatgaaattgagagctagaagtgctcatcattttttctaatacccattaaaataaaagtaatatacattaaggtatttaaatatttaaaagtaaaaaatgtctgttcatgtaccatatattcttagctaatatatcaccatggtaaatgcactaccctttcaggaacactattttatgccaagtaataaaaggaatatgaagattaaaatttaagggtacatttgggttggaaagaaggaagtaaaattatttccatttgcaaatggcatgattttgtatgtagaaaatcctaaggattccactaaaaaacctattaaactgctgagtgacttcaagtaaatgtgcaggatacaaaatcaatattaaagatcaattttgggccaggtgtggtggctcacacttgtaattccagcactttgggaagccaaggcaggcagatcccttgagcccaggagttcaagaccagcctggccaacatggcaaaaccccatctctactaaagatacaaaaattagccaagtgtggtggtgcatgcctgtaatcccagttactcaggaggctgaggcatgaaagtaacttgaacctgggaggcagaggttgcagcaagccaagattgcaccactgcactccagcctgggtaacagagcaagactctgcctccaaaaagaaaaaaaaatcaattttatttctatatactaacaacgaacaatctgaaaatgaaattaagaaaataattctattaacaatagcagcaaaaataataaatcacttagaaataaataaaaggaatgcaagacatgtatactgtaaattataaaacatcattgaaagaaattagacataaaaaatgaaaagacataccatattcatggatcagaaaatttaatattgttaagatggcaattctccctaaattgatttacagactcaacagaatacccatcaaaatgccagctagcttcttttcagaaattgacaagctgatcctaaaattttatggaaatgcaagggatacaggacagccaaaacaatcttgaaaaagatgaacaaagttagaagactctgagttgccaattaaaaaaaaatactaaaaagtaaccaagacagtgcagtactgacataagaacagaaacagagatcaacacaacagaatccagagtccagaaataatcccttacatttatggtcaacagattttcaataaggatgccaagacaattcatggggaaagaagagtcttttcaacaaactgtgctgagaaaactggatatccatatacaaaagaataaagtagggccccacctcataccatatttaaaaataaagtaaaaaatgtagtatagccctaaatgtaagagctacaattacaaaagcaacgctggaagaaaacagaagtaaatctttatgacattggattaggcaatggtttcttagatataacaccaaaagcgcgcacacacacacacacacacacacacacacacacaaaggacatgaattgtactatgtcaaagaaaagaacttttgtgctgtaagcaataccatcaagaaagtgaaaagacagcctaaataatgggagaaattttttgcaaatcatgtatctcctaagaaaattgtatccagaatatataaagaattctttcaactcaataataaaaaagtaacccaattaaaaattagacaaaggatttggaacagaaattctccaaaggtataaacttggccaataagcatacgaaacaatgctcaatatcattagtcattagggaaatacaaatcaaaaccacatgagatattacttcacatccactaggatttctataacaaaaaaagacagataaaaacaaatgctagtgagactgtagagaaattggaactttcattccctgctggtagaaatgtaaaatggcacagccactctggaaaacaatttggtagttcctcaaaaagttatactcagagttaccatataaaccaggatgacccactcctaggtatctgttcagaagaaatgaaaatatatgtccacacaatcacttgtacataaatgttcataacagaattactcatagtagccaaaaagtggaactaacccaaatgtccatcaactgatgataaacaaaatgtggtatatatcaacacaatggaatattattcagacataaaaaggagtaaagtactgatacattctacaacatgaataaaccttgattccacttttgtgaaatgtccagaacaggcaaacctacagagacagaaagtaaactaggagctgcctagcactggttgagggtggcagaatgggacatggctgataggagtacggggtttctttttggggtgacaaaaatgttctagaattagatagtggtaatggttgtacaactcttgtgaatatattagaaatcattacattatatcaatgaattttacagcatgttaattacatctcaatatagacgttaaaacttaagagctaaataaatctttttaagtgccttggagagtgggtgtgagtgacaacacaaacgacacatcaagcatatttccaatgtcaaggtgcaccacagcctaggcgaacaccaccatcacggaagctgaacagtttacaaacagtagttctctccctctgattggtatcctccatcacattggccaaaatgaagtatatctggatgtgaaagttaaacatatttatttatggccactgatgaccttaatcctggagaccatcttacttattactttggtgcaaataagtgattggttttgatgataaaaataagtcaagtcctaattcttgatagcatttatacttccttcctaatctcaagatgaaatgtactagctctaattttaacttcgcataagctctcagggttgtggttttagtgatggtgatagggagtggtatgttaactggaaagagaggaagcagccagtaggcaggggatgattagctgatggtgacagcaatgaaacatccctccaaggtgaatacggcagatgcttctggaaaaaggaaaccaactctaagcctcacttttacccttcataaaatggagttggtccagctaacttttttctttttggtagagatggggtttctttatgttgcccaggctggtctcgaactgctggtctcaagtgatcctcccgcctcagcctcccaaagtgctgggattacaggcatgagccaccatgcttggccctataaatttaagtctatattaatagcataacattagtgatggtgatgatgatgatgatgataaagtcaatcttgcccccagggcatctacgcacactggctctagtgagatactctctacctgtatcagcccagtgccaagtaaagtgcttggcatatcatattgctatatgtacaacagagaagggagagaaaaggcaacctctggacattttctcaggccagttttcagggtcctcaggaagcacagtgctataggaatcaacttgctaagcatcagttttcaactgtagcaatgatcacagtaaccatcaccatccatgaaaacaacatttgacctgctctatcagttccagggcaggcccttggagaaaaggcaaaagatttgtggcatgaccagaaactgaaacatgttaaaaaaacatgatgaaaaacatattctttctttccctgaatttctgctttcaggagggtagactcactgctctgaaatgctatcatgcagttgtatatgagaacacagagccaacttactaagaaagagaaatgtagttgactctgacatctgggtggctaagaagaaaaatcctgtgaagatgtaaccaagaaagaagcagaacaaaattgcttccaggcccatgacagggacccttagtcacatttctccaagagtgcagctgccattctcagaagtggcctgggaattcaggcatcttgagctggcactgctgagaacctcacaggggcgcactaggttagaaacacagatgcctactcaccagcctccccaccaactgctctctctgggccaggtctatcaggatcagagaataatttgggacttgaggagctgaaggccaggttaaccctttacacctgaagctcaggcttgaggactctcagcattctggcttcctgggctacaccatttctccccacctcctacaagcagccccaggccctcatctatgcttttagcctgatatcctggctagtcagactgcagggagagaagacactcctaaagcagaggaaatgcccatgggaatggagcagagactcaagcatgatgagaggcttctttgctagttcccaggccctcaatggcaaagtctaggcagaaactgcatgtttagaaaaggaaattgttcaattagcatataccatccatccaaagttcctcaaaaacacagctctgacaaattatagacaactatctgaagagtaacaatccagagaaaggaatagaataaggtacctctggaacttttctacaaactgcatccagacaaacaggcacagtcgcaggccccgaggggcagtggaaaaacacctgccttgagtccagccctgcctctgacaactgctagttatgtgaccttgctccagtgagtgtcaaagactcactttgtcactataacagccataatagcaatatgacctacctcccatgattgccctgtctggcaatagaagcttaaaaaatgtttgttcttccagatcacacttccctaggtatttggaagacaacctctccattcccaagtctgagtcatctttcagactccctagtactatcattccattcactgaccctatgtgaggcactgtgcaaggtgctaggatattaacatggaagacacagtccctgccctggagaagctaactgtgaagggagacaagaaagtaaaaagtggactccaggaaggcctcatcagaaggtgacatttggattaagctttaatctgttacccacagtaaggggacctaaggaaaagcaaaggagcatttattatgagacacgctgctagacttttaaacatgtaattataacagctaaagttacaagcacttcatgtgtattaagtcatttaaccctttaacaaccctgtgaggtgggtactattaatatttcacagggttagttacactttaccaaggaaaccaagatagagagcagttaattagcttgctccaagtcacacggctagaaaggggcagggatttatgaccaggtggcctgcaccagctctgggccaggaccctgtactgcctccaactgtcttctaatttagttctcaccattctacaaggtagtgataatacagtctccttttttctgattaggaaatttaaattcagagaaattaaatgactggaccaagatcactcacctagtgaaggaacagagcaggaatgtagacccagctctgtctcactccattgtccacttattttctttaacattgatggggtgctttaaaatgcagagtcccaggccccacctactgaacgggaatctgtggggatggggcctaggaatctgcattttagtaagcgctttaaatcaagcttatatgcccttaagtgcaaaaacttgtgtcccacagcatgttctctagggacttaatggagtcacgactcaccatcttcccaagaatctgcctagctatgtgcaactaaaagatggcactcagcccctcttcctcctacccccatcccattagcttcttccaccacacagagaaccactggccctcaaccacaaaggaacgcacacaccacgggatccagtgaaagcattaccaatggctcatctaagccatttcgtcagtctccaggtgtgctccgtcttcctgtattttgaaattactcttcctgccacccaccctgatccctttgcttgctttctcctcatttctaagctcctgggaaaaagagtttatatcagtcatacactggtggtctgcagaagcaaaaacatgtctcacttggccttccttttatttttaaataatttgaattagttgtcaagcttaagaaagcaggtgaatagaaagaaaaattcagattctagcttcttttgaaaaatgagaaaatttaccatcactgtgtgcactcctatatgacaacagtgggccagagctgagcacaagtggcccagttagatgccgcggctccctccaccgcagcgctgtgcctcctcatccatggcctccacctggtccactcggctctaacctgacctcccaaccagcaggtaagtgtcgcagctctctagcctgcatcccagcaggaagggttaggaggcacggcattggcaacagccacacaaaacctcctggacggctgggcaggagcagtgcagggcacagcctcctggctgcttgaaacccccatcaattcccctcactgccacaggaggacagacctcccggaaggctgacagcttttgctcagtccagccttcaccagacaactctctaccatcctgagtgccctttctccctctgacccgatcccatcacctgatccacagaggctctctcaaaggtccaagaagggaccgatgagaggtcagtctctgaagggagctctttctgaggggtgccccacctctaagaatggaccttcctatcctagagcaaaaaacctgtctgtccttgtttaggtgacatttctaaatgtctgtctgatacttttctgcaggcataaatgtggatgtgacagtatgccttgctcttgaagcaggagacagctgagccctgagtgaagaggaagaaatgcaagcatttggaggaaagcctcccattctgctgaggttaatgtcaccactgagaggaaacgtaaacattgcccagcactctgctttatagccgaggtaagaagtcaagatgcccgaaaataggaaacctctcaaccacatgagagaatttctgctacatctatgttccactactctcctaagcaattctgctcacgtggaagtcaaagtttaggcagcagcctaaagggacagagaaggtgggaatgggaacagagctcttgtgtgtgttctgagaacatggtgagagccaggaaagggccagcaatacagtgacagtatagtgacccaacagtgtgcagctgtggcctgattgccctgggaccaacctgcctactcatcctgcccagcaaacatctcctcagaccctctttaccttcttgccaactccttcctgcacctctcctcatccatgggccctggccaaggacatgaggaacagactggcagctccccagaggagggctgccaagagtctcagcaaccaatactggccctcagattctaaggagcttaacaaatgcaactaaatcaggatgatccttctccgcatgggacttcaacctcaccctcagcacttgtgtcttctggatcctcccatcagcccctgttcttcctgaagcagcaaggcctcctgctaaattcctgtggaaaagctcccctgcttcctagaaagagctaagctcaccaatgctataagcaaaaggcacagcccctctctgcctaacctcccgacagatcgacgacttgcctggttctctaagggataaaagggctcctagaaacatactaagaacctgagcccctttccttctatcttctcagtgctgcctccattctctccctgccatacctcccttcccctgacctgcccacacaacccagagccgctgcaagcttcagtaaccttagattaagttccttgtaagtacccaaaccaagattctcaaaaatgtgagctttcgcctgtaatcccagcactttgggaggcagaggcaggaggattgtttgagcccaggagtttgagaccagcctaggcaacagagcgagaccctgtctttactaaaaataaaaaattagcaggaggttggtgatgcacacctgtagccccagctacttgggagcctgaggtgggaggatcacttgagcccagaagtccaaggctgcagtgagctataatcatgacactgcactccagcctgggtgacagagtcagaccctgtgagaagaaaaaaagagaagagaagagaaaagaaataccaggaaggattttctcaagactgtcccattccctacaaaacagtaaacccttttctccttcactacttctatacacattgtaaatcttagatcttctccattccagccccaggtccagaaagcccttcaaggaaaaatgtaatggggatagtgagcctggtcaagtggagaggaaccaacatttgttttgctgggaggtcagaggataggtgggtgtttttacaggcccccgtgaggctgaaatctccctcaatcagccacaggaaagacaatttttttgttgttgcataataatcagaaaaaaaagtaagaactttttccatctcttcactgtccacttatcattcccacatcctccttcccaaccctcctcctcaaagaaagccctttaagtctgctttttcaacctcaaccatttttcaatcccttttcctgccagatggtccttctccacttcagtgcagatcctgcagaggtttaaagctgggtttacacacttcctgaaagcctgaattggagtgaggtcttgttaggcaatttcaggccaaaggaaatctagttgtttctcacatagttttaaaaacctagacatggctgtttctgccattctggaaactcagcctctcagcaagtggcttatcctagctctgtcaagactatggcacctactctgcccaatatcttgtcaccacttggaaaaaggaggcagattggaagcctgatccataaaaaaccctgctcctggggaccaaccactgccctctttcgctctggcaaggagaacatggtgggtcctgcaatttcgatgatccagaggccatagtcctatcttagagcagcaccttcactctggccagccacatctcactggatgacatttcctgcacatgccaggaatgttcatgccgccaagcttttgttcaaccaattcctttgattttcagtgtcccttgccccccattctttcttaaatatccagttcaagtgtcaacttcttcctgactctaagtcctgacctccttctcacccttcccacgctctctggtctagctgagctcaacctgactgatggcaagctgcctcctctgctctagaagaaacttatcatccacaagctgcaccttctccgagtaagactaggaaataataaaggctaaagggactgggcaaaatcctaatacctccgttttaccacagatagcttacggagactactccacctctataatgagaacacaaagaacaatgagaagccatctacaaagaacagtgggtactcagagcccagtgctactggaagtctccgggctggggtttagctttccctccagctctcaacttcaacacctcctccctcatcctcactcttttagctgcctctgcttccgattccactaagaacagatcctcaatgagctacactcatcacatgtactccccaccagcatcatggctcctgtcaccccatctattcaaaactctcaaaaccatagctcccattactcaaagtaaaaaccaaaatctttacaatgacttataaggccctccattgtctgggtcccttttataactctggccccatttcaactactctttctccttcactgtctccactccagccacactgtccgataccatgtgctcaaacacaccaggtgtgttcctaccccagggccttcacacctgctgtaccctgtaagtagaactgccctccctagatagggtgaacagcagttgggctccacagtccaggcccatctctagttacctctggccttcccagtgaagggtctgacccacttacagcaaccacaaccactcagaaaattcaaaagggggcctccccctgtgaaaacccaaacgattctgggcaggagtagcttcagcccaagaactcaactaaaattgctctctgaaaagcttataagaccaggcccagtggctcatgcctgtaatcccagcactttgggaggccgaggcaggtggatcacctgaggtcgggagtttgagaccagcctgaccaacatggagaaatctcatctctactaaaaatacaaaattagccaggcgtggtggcgcatgcctgtaatcctaactactcgggaggctgaggcaggagaatcgcttgaacccgggaggcagaggttgcggtgagccaagatcgcgccattacactccagcctgggcaacaagagcgaaactgcatctcaaacaaaaagtgataaccataatgaaaaacactgacaaattagactacattaaataagaactttgttcatttaacaaatgccatacagacagtgaaaagcaaaccaacagagtataagacaatgtactcagtagaccatccaaccaagaactcatatccagaatatatgaggaacttctacaaataaataaaaaacaactcaaaagaagaatggcacaagtagaacagatacttcaccagagaggatacccaaacagtgaagagatatatgaaaaggtatccaactttattagtcatcaacaaaatgcaaattataactgagatgtgatacccattaacatacccactggaatggataaaatgaaaaagaaaatacctactgttggcaaggatgtgaagcaactggaattctcaaacactgacagaggaagtgtaaatcaatactaccactttggaataacgttgggtattatatactaaagctaaatataggtataacccatgacccagcaattcctttcttagttttatacccatcagaaatgcatacacatgcatactaaaagacaagtatgagaatgtgcataacaacactattcataatggctataaactaaaaattcaaatgctcataatcagaagaagagaaggcaaattttggtattttacataatgattactatacagcaatgagaatgaacatctgcagctacacacaacatggataaatctctccattattctgaataaaagagccagaaaccaagaatacatactagatgagcctatttatagaaaacaataaaacccaaaaataaatcaatgctattagaagtcaggagagtggttacccataggaagactagagggagattctgggatattgataatagactgtttcttgatctgagtgttggttacatgggttcagttgtaaaaatttgttgacttggatacatatatacattcatgttgtatgatatacttcattaaaaagtttaatatagcaagcaggatacagagctcagcagatttgggaacactggatccacagagcaaagttattaagaagcagtagagaggccaggtgtggtggctcaagcctggaatcccagcactttgggaggccgaggtgggtggatcacttgaggtcaggagtttgagaccagcctggccaacatggtgaaaccccgtctctactaaaaatacaaaaattagctaggcatgaaggcaggtgcctgtaatcctactcaggaggctggggcatgagaatcacttgaacccgggaggcggaggttgcagtgagccaagatcgcgccactgcactccagcctgggcaatagagcgagaatcaatctcaaaaaaaaaacaaaagaaaagaaaagaaaaaagaagcagtagagggtagagggtaacactggaactacagatcttagatcattagggctcaatttccctttggaggaaaacccttttttcctcaaatttggaagtaggagaagaaagcacacctatatagccaggctctgctggttctatgcatgtatttatatttagcttgtgtaatcttagttacaactatgtgaaatagatgccattatctccattttatggatgaagaagctgaggctgaaaggttaagtaatttgcctagcgtttcataagcagcagaccccagagtctggagaggttggcatgaggctctagaagtgataccagagcacattagtcctttggtctctgtcatatcttgtggcaggaagccaccctccatcccaagtacacccctgcagccccactctatctggataaagaattagaaaaggggctgggcatggtggctcacgcctgtaattccagcactttgggaggtcaggagttcaagaccagcctgaccaacatggtgaagtcctgtctctactaaaaatacaaaaattagctgggcgttgtggtgggtgcctgtaatcccagctactctggaggctgaggcaggagaatcgcttgaacccgggaggcagaggttgcagtgagctgagatcgcgccattgcactccagcctgggtgacagagtgagactgtctcaaaaaaaaaaaaaaaaaaaaaaagaattagaaaaggatattagcagaaggtccaacgcctggcccctaaattctggttgtcaaaatcccatttttctttaagccatctagttcagaaggctctgagtcaacaacaaataagcgtaagagatgcctatcatcattcttccccatctagggaaaggggctcacacacacagaccctggtcaaacaaagaccttccccctaacaatgcagtctgctggagctgagactgcagagaaagagtctgtccatccacctgcccaactcctttaagggccatgatgatgaccgaacttgcctcttcttcctcctttaaacagagcaagtgctacttggcagtttcaggtctgtgcttctcagactgtgtgctgaggtgccccaaagccccatgatgaactcacagggatactgctaaatattttaaatctttgagggaaacagagcaacactcaacatttgttgaacaccccatgagttcacagcttcaacaacagactgcattacattcttttcgatgatgtcatttctttctgaggctgggttttcagcagttgctgtgataaaaagcaaataccatgtgaaaagcaatgtggaacaggaaataagcatggcactaatcaatctggttccaaggtctgatatgctatgcagtacctagtacatcccattagtaagtgtggttaagaatggaatataaatatttttcctttcaatttcttgtatcatttttttttcagatggctactcagttgttaggatataaatactcaattgtttaaacctacttaaggccaggcacagtggctcacccctgtaatcctagtactttgggaggccaaggcgggtagattacctgaggtcaggagttcgagaccagcctggccaacatggtgaaaccctaattttactaaaaatacaaaaaattagccagaagtggtggtgcctgcctgtagtcccagctactagggaggctgaggcaggaggatcacttgaacctgggaggcggaggatacagtgacacaactgcactccagcctgggtgacagagtgagacttcatataaaaacaaacaaaaaacctacttataaaagaaaacttaggtatttattttgggctatggacactgtaaaaaaaaaaattactgaaacactaaggcccatgaactaagaaagtttgggagtctctgcagcaggtgtttttaagtctctgttcatggagccaagaggagttcccagggcaggcccaacccagccccagaagtgggcaggagtcaacattcaggcctgtggcagcacactcaggcttcccagagtggctggtagaataacccctctgcctgaacagaagtgcctgcacaccagttatccctcagcccaggcgcctgcacatccacatcagcctcaccctaggctcccaggcacccctctgaactccctccctgaaaagctctattcagctccaacctcatgaataaaacccaaagacagcccagaagcctgccggccagcaggggtcttccacacacgctcagacttgggcaatgtccacaagccaaatcattaatccaaagagacagggagcaatgggaaccaaggagagggcttccactgacagaccatccactgaaaggccaactcaggctttctgggtgaagatctgcacgaaaataccttctttgttcccacggggtttcttgccagctatgcgccccacctccattcttccttgaagtcataatcctctgttggtgacatcacagctgttgatacaatagtcaactgttgtgatgtcacaggactcaacttttgtcattttaggtgggggtgctgggttggagaatgtgacagaggacaagaatagaatacagttatagaactggaattcgctttttcatgctaatttccctggtaatgaagggcagtgactcagaaaaggaaaggcaagcctctggcagcaaggctgtgtgtagattcgtctataccaagggaaggatggtggggaggcagggaggagacaaaagaaaagaatttcgaattccaggattggccaaatatgaagatgatctcagtctggccaagtccaggaccttctctttccctcacctatcgcctgagcccagagtaaggagaggctccaggctggaacactccctggaaattaatgcgtgggaggtggtattctgttgtggactcccaactggcagagggacagactatcagtttggactgagtcctaaggacagtgaccaggatggagagggcactcagaagcatgtcacaggagaaatgacggaaggaactgagaatgtttaccctggagaagagaaggctgtggagcggggagggtgatcattggcttgggaattcggaaaggctctcgtgtgaaaaagggattagatgtgttttctagggtcccccaaggagacctcagaaaatgagagaccctgagaggccaaaatgaagaagaagttttaattcttaaattccatttggagactatcaattctttttaattccttatttctcaattacagaatacgttccagaggacaaggactgtgttgttcatcacagtattccagaacttaaaaggaactggcacataattggagcttactaatattcgtcaaaaaaatgaacaaatgaggcaatgacagtggtcttgtgaagctgctgctatttacagggactcactcattccgcaagtattttttgcacctcctaccacactccactcagttacatgctgggaataccacagtaaaggtagataagattagtctaccccctcgcctttgagatgggcatgggtggcacctaaggtcgctttcaatactgagattcctagattcttagagttgactaaaaagtttaaaactgagaggaaagagtaccccaagggccacagattaaccctcccttctactatcaccactagagatctggtaatgaagggcagtgactcagaaaaggaatggcaagccactggcagcaagggtgtgtatagactcatctataccaaggggagttgggagaacagggagggacaaaagaaagagatctagatcgagctgttccttctttctgagctgggagaggcctctcggtgagaaagcactgccagaccggacgagagcaaccaggctgggcacttatccaagtacccctccccaccctgagacagagtgggctccctcaacccagcaataaaatctgtatggcccagttaggtaatataaggtattacatatgacctcacttccctcaaggatctttaatttatttatttatttattatttagagattaggtcttgctctgtctcccaggctggagtacagtgatatagtaatagctcactgcagcctaaaacttgggctcaagtgatcctcttgcctcagcctccagagtggctgggactacaggtgcatgtaaccatagccagctaagtttttaaattttttgtagagatacgggttttgctattttgcccaggctggtctcaaactcctggccttaagtgatcctcctgcctcccaaaacactggcattacaggtatgagcaaccgtgcctggccaaatgtgctattttctaatgtggtttgtaaactggtcaggaaacaattcccaaagaggaatcaaatctaccatcaggtgagcagacccctttagtagatgtgactagcaggctatggtcacagcttatactttctcccttttcccaaagtcctcaatctccctgtaggaagcttggggaatgtgcctcctgccctcttctggactagtcagcatgctcaccaagcacactaaagccacccaagtcacagctgactcatgccattgctctttgtaatgaggtatgacatgtttctaagctcttgtatattttcatatttgtagcctacaattaggcatttttgagggatgtagctgactaggggttctgttcagtgacctataattatacactcaggcatcatggtcaatccaggcaactctcaggcctgcaggaacctcatggaagaagccacttggctctaagaagctccagagaatactgtagtaatgtggcttagaagggccacactgcccctccttgctgctcttggaggcactccccctatgtccccttcatctcccttatcactcactgcctgactcagcaatgcctgccaagcccaagtgctgacacatttgtgtatctagtgccagcagagaaccactttgagggacacagtctccactgccaaggtaacagcaacgtaaagcaacttctttttttttttttttgagacaagagtctcactttgtcacctaggctggagtgcagtggtgcgatctcagctccccgcaacctctgcttcccaggttcaagtgattctcgtgcctcagcctcctgagtagctgggatgacaggctcccatgcctcaggtatgggaggcataccaccactcccagacaatttttgtatttttagtagagacggagtttcactatgttggccaggctggtatcgaactcctgacctcaactgatccacccgcctcggcctcccaaagtgctgggattacaggtgtgaaccactgcgcctggtcataaagcaacttctaaaaactcccataagcgtctcgtcttagaaaaaaggggtcacacacctgctgctcatgggaccctgcagtcagctgctgtgcctccgctctgagccagcctttttgccacctgttgcagtggccacactgatcctaatcctcccccatgcaaatgcctaccacccagctttaccactgttcccctggctgggaaagaaggactggtttagcacaaaaaatctgtcccttatgacatttcacatatacatttggccccaataaaactcatttcttgggccaagtgcggtggctcatgactgtagtctcagcactgtgggaggccaaggcaggcagatcacctgaacccaggagttcaagaccagcctgggtaacatagtgaggctccatctctacaaaacataaaaaagaaagaaaggggcaaaaaaagatttcttgatttttttaacagcagctcaaatcctggcatttaatcaaagagactgccagtagcccaccttgtgtagctgtgaagggcaactgtggcccatgctcagagcagcatctgcattaagtatgagcccagtatctaaactacaattactttgcaagtttcccttcttccccaatgcaaagtactttagagtactttatacttttcaaaaacactttcacgtattatctcatttgagtctaccaataagcccaataggattaaatgcaaaaggtatcttctccatttcacaaaggaggaggctggggctcaggaaggctaagcatcttgccctcggttcactcaattagtaagagtagaaccaagtccagaattgctctgcaatcttcataaatcaacaattagtagtcactacttcatagagacattataaggataaatgaattaacatatgtaaagtgcctggaatagtgtctggctcatagttaggactatgttatcattattaacagtataatcaccaccacccagaatcctcaattccaaagctacagctcttttccttctatcctgctgcattttgctcagaaaatagtttcatctcaccttgagtgagtccagacctaatccctatagtcagtctatggaacccagaactcactgggctttttttcttttttctaatttatttaaaaaatctttttatgagcagggtcttgctctgtcacccaggctgaagtgcaggggcatcattatagctactgcagccctgaactcctggctaaaatgatcctcctgcctcagccttcccaagtagctgggatgataggtgtgcaccactgcacagactctatcttgccactccacgaacgactccatacttgtgtgcacagggaagtacgcacaccccaccttttctgccagtctgacactcatctcctagcctctctgatagcacttatgccatgttagacacctttctgtggtttgccctgcctgcagtacatgaccttcacttagatccaattcttcattcatttagtttctttcttcaacaatcatttcacaagcacctaccctttactaagccccatactagaggcttttcctcgaaaacatatcaaatgaaatgtgcaagagcagcgggatgcacaaggagctgtggcagcacaaagacgccagaaagtaaccgtcagcaggcagcacaaaagatttcagaggaggcaaagctaaaatgggttttagagcaactagagtgctctcagcagacaaggggagaaaaggacattccacgctatggggaacagtatatacaaaggaatacaaagcagaatcatatagagtatggggtatacaatctcacactaccagcatgcaggggctgtgagtgtgtgtgtgtgtgcgtgtgtgcacatgtgtgttactgtgagataaatatatctatgtattccatatataaaataatgaatatatatagatatctctctacatataataaggaatatatatatgtgtatatatatacagagagagagagagagagagagagagagagagagagagccttcttcccagttctgggcacagcttcaaaaacccttggcatttcctgagggatgggggtgagaggagcctactttgtgattcataacaagtccctctaccatacctgaatttatgctaatgaagtgaggatttatttcttacggttccagaggcttggaagtcttaagattgatggctgaatctggtgcgggccttcttcctgcatcatcccatagcagaaaggcagaagggcacaacagtacacacaaaagagagagagggcaggagggggccggacttgtttttatcagaaacaaactctagcaatgacagcattaatccattcatgagggtggagccctcatggcccaatcactctgaagggtcctacctcttaataccatcacaatgacaatcagatttcaacatgagtcttggaggggacattcaaaatatggcatgccgacatagtgaaacttccataaaaacccaaaacttctgagttcagagagctcccgggttggtgaacacatcaaggtgccgggagggtggtgcaccctgagagggaatggaagctctacacacacacacacacacacacacacacacaccaaaattttgccctatgcatctcttccatttggctgttcctgagttgtatccttaataaactaatagtaatataatactaatagtagggttaatagtaagtcaactgtttttctgagttctgtgagccattctagcaaattaccaaacctgaggagggggttgtgggaaccgatccctccaactttatagtgagttggtcaaaagtatgggtggccctgacttgtgattagcatctgaagtggggacagtcttgtccccacttaatctatggagattatgctagctccaggtagtgtcaaaattgaattaaattgtaagaaaccccagttggtgtccagaaagtttggcaaattggcaaatgtgagagaaaaaaccccacacatttggtgtcaggagtgttgtgagtagcaatatatcatactaatagtagagtgagtgtgagagtgtgggtgtgtgtgagagagaaggaaacagagacagggaaagaaattagatatgggatggtgcaaaatgaggctagaaaggcagggataggcctagagtgccatgaccaggggacacctgggcggctccagcgttccagcaaccttacacactgaagcctcaagggcatctccctccaaactgcctgggggtggcaggcagctgggacaacaaacatcaagcctgcctttccaggggtgagtggcaatcccaactccttgggtatgcttacagcgcaccaattttcaatgcaaaatcctttaacaactgttttctctctctttctgtctttccttcccctcctcctaaagaagagctgtttatccctcttctcatttctgccccgctctgagccctgagttttagtgccagtgcttttacacaaatccagctttacatcttgagtgaaatataatttcataggaatgtaattctggaatgatctcattgaaaaagcacatccagcaaaggccatgagcagacttcaggccagcccattcacacccagagccaagaagactgcagacccctttcccttaaatggagaatgtgcctgggacccaaagcaaagcacaccagctacctagggatattctcctgcctacagccagccagcctgcctgcctgcagaccacggccagggcccacagcagcgaccaccatgagccactctggcaccatacaaggacagactcgagggcatccaagcaaacaggcctcaccccagagacgctgcctctgaccctcgggagggctctggctccatgccatcaaacatgagctgaaaatattaacactcccctgtcatagccccatcagagacagaagagtatccagaagcccagctgctaaagatcctccccacacctacctgccttcctaactctcggaaacccaattaccatctgaccctattgagacagagtcagaaagtggggcatttgactctgaaactagatgtcaaagccaggcccagcccagtccagcagagctgaggcagagcagaactggggaagaaataatgtagtctgatggacgctcaaaaaatcctactgaaaaaaattaccaagttggaatctctggaaaaaatgtcctcattccaaatctgttccccacccccaatgaattctcataaaatggaccagaaaaggaggaaaaaaaaaattaatggcttgcagggtctatgggaactctctgtctctctgtactatctttgcaactgttctgtaaatctgaaactattctaaaatgtaacatttataaaaaataatggcttatcacagtttcctctgtaagaaacaatgggaaaagggtgatctttgggtatgaaactctgcctctaccagctatgaagctttggatgtgttgcctaccctctgtaagcttcagttttctcatctgtaaaatggagagaacagttccaaccacgaagtgctgttgtacagattgagtaagatagtgcatgcaaaggacttaccactgctaaaagtgctttctttctgggcagcagcagtttctctgctcagtcagccttcacgttgggttcttgacaactgcagctggagaccctacctccacccttcagccctacctgtctttatgactagcagtctcttccagaaacggcaggacactttaatcccaaagcacagtaatcacctgaaaggctgaaggctgccttatagcaagttctgactagtgaaagcacacctttgttgacagaaacatgttctccttcctgctttcccttcctccattagaatctagtgtcactgccattagctgaatgactttcctaagggttacagggatccatcagaaggaaagccagaagctgacagagttgcgcttctgacagagaggaagtgtgctctcaaaatcgccacagaagattcttccccttcagtagcaccactaccatccaccatctcatcaccaccaccccaactcctggctgtgccctgctcccatcctggccccacatgaagctgggctgataaactacaaatccacaagtcaaggggcacagcaagttccccaaaaccaagacatatgtctcaaggctgggcaggaagttgcccccaggccctgaagcccaaccccggggcctcagacaccttgcctcttgtctataggatgatgttacttgcttctcccctggggagactgagatgagtgggcagtctaggaaccctatctaggtcttcttatttttttcgttttttttttttaattattattttcacttttttttgagacagagtctctctctgttgcctaggctgcagtgcaatggcgtgatcttggctcactgcaacttccacctcccaggttcatgagattctcccacctcagcctcctgagtagccgggattacaggggcccaccaacacacctggctaatttttgtattttcaatagagacggggtttcaccatgttggccagggtggtctcgaactcctgacctcaagtgacccgcccgccttgacctcccaaagggctgagattacagacgtgggccactgtgcctggcccccatctgggtcttataagtggatggactagagaccaaggaaagaatcaggtgaagaaaggtatagctctgatgtcgtgttatctccttgaaaatcactcacaagaatgtcaaatacttaaaaaaacaaaaaactctcccaagacaaaagagaagtccaatctcaccctgaaaatttactgtccaaataagggagcagtcagtgctagaacagtcaggctgttccaactccaaaaagccctgggagagaggcagttcccgggcttcagattccactgacaggttgtaacccctcaaagccactaatgggcacattctagtggctaattcctctgaccttccagatggctggggtggggacacaccccagctgagacccaaggacactggttcctggcagggagcatgcaaaatctcagcagctccaaccaggccagattaacagccccatgctcaaggacacgctgccggaagcaggacccaggaggaagacgtccttggagccatttcttctttaaccaaataagagccaaatatagccaaatatgaagaaacaatgtcatcttctttgaaatttttctccactttatcacctcatacctagtttactgcaatggtctctggttatacagagagcactttatccagtgccagcccataggaggcactaaataaatgttaaacagtattattgtatgacaagctcccctttattcttctacctccagtcctctctgctcataagtgacagactaagcatcctggaatgtcagtatcatcatgtcattcttctgggctccttaaccgccaatcacaccagactcaggttcccttaattggttccaaccaatctcactttccaattcttccttccctcttcagccagccctggccctaccaccctccccagacctgcccacacagagatacacagacttgcacatgcacacagacacgcacgtgcgcgcacgcgcgcgcgcgcacacacacacacacacacacacacacctacctctctccaggcaggacaccttctgctccaaacatgtccacgtgtccatttctgccccatgtttctgggctcaaatcactggcagcctggagtgctctccttcttcctctctgcttatccaactcctagtatgctccaaggcccaggccaaggtcccctgaagctcaggctgagaagccattcaatccacaaacaatgaccaagcacctgccttgtgcaagacactagcccagtcactgaggacacaggaaggaaaacaacacagtcctacaggctcctgaccggtgggaggggcttcaacatgaactgctctgctcacctgaaccatgcaggcagcagagtcaaccaccagacatcgcaggcagcttgctgtgccacttgtaggggtaaggtgagggcagcacatgaaacccagctagatggggtcttcttacctttcaagacttcaacctttcaaagaagccaccacggcctagtggcttagaatatattctattataagaaccttcattctctgtgaccaccttgggtagcactgccccatcttgctttagaattttatcagctaggctgggtccaacctcattcaataatagccatggtcaactacctctccttagtgccaggcaaaagcctcacatccctgccctaagccagggaacagagagagaatgatctccttaggggttcctaggcctgatgctacttgactacagagatgatgggggtcacatgggagccaacccttaggcctctttagggaaaaagggtaatctgcaattctgaccataggagtaactccacccttccctctcttatttaagaaagcttatgagagagtgaatgggcttgctattattataggtataatcttgcataccttctaaattataagaataggtaacccatttaagattactttggtcctttaactcctgtagtaacaaatgccacgtgatacatgcctcacatctagtcctaagctgctagtgagttacagtgcctggagagaagcagctgctatgagcttccagtgtgccacccccacccaggcaccccaccttggatagccaagagggctacctcggtaaaaaagagatcctaagacagacttgtaagctcaacccagagggtaatcctaattcatttccccctgcccaggggagacaaatgttgctatatcaatgactggggaaaaggcccacatatttttcatgtctcaccctcagactggagtggcgtctcactgcttctagaagattggaactattactgacttggtattcatatggaccaaaggtacctcctgttggacattccttaggcctgtcacatatggtccaagaaagcagtaagatggaaaagagagaccagctaagagctactccaaatgcccacaccatcagatgatcatcccaagtgtcagagatatctgtgaatcaagtgctcaaagctacacacattgggagtgctctaaaattcctatcaatacagttattctttttcccagaaccagaagaggctctcttgatgtaatcttagataccagggaatataatgttcaacccagggaaaaaaaagagagaacacctaacccatccctacttatatttccagcagtggagactcacagtcttcctcatcatccatcctccctgtaatctacctgaacctcaagtctctgaataagcttatctcacatgtgacttagctgttgctttttatagcatgaactattcagcctcctactaagaccatcttttccagagaggctgaatgggtctcagtctctactaaggaagctcacatccttcaggagcttacccaaaacaacagtcacatatttaggcatgctggcttgtacagctcaggtcagccagaaaggccacagcagctgctgaccattataccacatgtgagcactaacggggatcaatgagtcaagccttgaaagggcagaacagaaggaaagaagttaccattggcccttggatcaccagcaactagctcgaaagagtctgcctaatgaggactgcatccagccataacgagcacctagtctttgaagcctgtggcatccagacagtatcacttcctacttgactgctttcagggggccttccacacagccaccccttacactacacccatctccaaggctgaagagaagacctagtgcacactatcttgagaggcttagccacacatttcagtccccgtccacatccaccctccccctgcccctgacagctcaaatattcagtctccacatgtgtctatgtgcctgtgtgtctgtgttttatttatactacccatgtctgttgttagcaacagaaacaaagtactttaaggcagaaaaggcaagtctgccaattggcttgctgctccccgcctgcttccagctcagggaagggctggtaaatgatccctccagctccaatctaccatgtgtgcctacagctcccacgtacccgggggctgggaggcatggtgccagtttggcccacattagtcactgctgcatggggtgccggccatcacctctctctcttcttccctggagggcacaccctgaacacctgattctgtcacctgcctaaatgctgattactgtcgaaaggcagagcttcagaagccagaattcaagaaacccatggtaaagatgaaagggcagttcctccccagactcaagactctggagaactagcccaggctaagttctactttcacgtctttccattcccacttcagtttttctgctactgataatcttccaagttccaatagcaggctccctaataacattgacagtaattattgatcaccactttgttttagctgagagaacaaaacatgagatgtgattcttacatgtggggagctcacagacgaatgtagggcactgagacacaacagcaaacgatgcaagtgtgggacacaaactagaaagacaggacaatggagtggtggaggggacagagcagctctggacggggcttctgtgggagaggaaatgtgagccagactgtaaaggacaaacagtagctggacagaatgagacagaagactgtttgagatgaagaatgagactatgactcaaggtcccaaggcagagagagtggcaaatatcacacccatagcgtttttctcacattcaactgaggctcagccctagcaggtatggaggaaggaaagtggtgtgacttggtaaaaacagaaccctcccctctgggttaccatgctctccagcctctctgcacctacctctgccaaaagcatgctcggggtttcctttttctttcttttctttctttctttctttctttttttttttttttgagacgaagtttcattcttgttgcccaggctgcagtacaatggtggaatctcggctcaccacaacctcttacctcccgggttcaagtgattttcttgcctcagcctcctgagtagctgggattataagcatgcaccaccacaccggctaatattttgtattttcagtagagacagggtttctccatgttggtcaggctggtctcgaactcctgacctcaggtgatccgccccgcctcagcctcccgaagtgctcggattacaggcgtgagccaccacgcccggccaaggtttccattttctgtgctactccaaaatcctctcccttgcatgtcatggaatgcagccagcctaacttcctaaactcaaaaacatcccattgaaattcctggtactcaaggctcctgctcccacggtaggacaagcttcaggctcccccaggtgcagtgtgggccaggagcttgaactattcctgtgttggcctgggtcaagctgtgagtctgattcttttctcgctagagcaggagaaggggggcagtatgaaattgtaactatggttcctggaagccaggacaaccatctttcctccttccattcatacttacagtcatgcatccattcagctaatatacaccaaacaccaaccatgcataagccaatatgtttagtgctgtttggacaccaaatgcatcaggtatgggtccatcctcaaggagcttccactctgtagggtgaatacaatagacatataaatctcataaataccaggaagactattttaagtgccattagaaagatgaaattaagtgccactagagagatgccattagagagatacaatgttgaagcttaggtagaaggagattacttccaaataaaggatcaagaacactttacagagagggtgacccttgtgctaggcctggaagatcaaatggcaaaagaatacaggggtattcctacacagatagaactacatgcacaagggcttggaagcaggaaagcagaagacgtatgaaggacaacaaagtgtttgtcagtctgatgggagtttaattgaaagtagaccagggagaaagagagttggaaagacagagacatgtcggctcttagaggcctctgagagccaaatcagggatcttagtttttctctggggaatcacagaagttttctgagaaaagaatgatgggtcagagattatgcttctgaaagatgaagcaatactcagaggtctaggggctacggcagaaaaatctgttcaagtggtccacgagggctaatgatcacaggagggacaagggagagagagaactgaggtaagcagcaagtgcaggatgagaatttctacctttgaagctcaggctgaacagaaaaatcagtaggcagtggccagggtggctaagaggctacacaggcagagaagagctggagagccagctcttgggaggggacagcgaaggagtgggaggtggaaacagacaggagaccagggaagggaagggaatctccgagttcagcatcctaaaagtgaaactgctccaagtgataaagccaaaggtacccgaagaggaataaagacgaagtccttagagttggaaggatggagggactgtgaggccggagcattgatggattctcagtatgaatcctcaaatcctaattatgccaaaaagaggacatatgaagaaggttgttaacagttagcctgaagtcaataggcaggtaagggcaccaagagtgagcagaggagggactaacttctcatgggaaaggttgccagcccgggcttggaagcaacgtggggagttcagagcgagagttgggaggaggtgaggtggcttcattggagagggtcacaaggaaagtaagatcttcagggaaaagccagcttttggctataacaaagaggtaggaatgttctaggaaaagccaccaaagaaggggcaataccactttttgtctattacactgggcaagatgataaaactattcccagagtcaggcagggtgtggcaagctgggcactctcatatactgttggatgttctgtaaaccagtataatttttctggaaaacaatttaggaatacacacacacacacacacacacacacataacctcacaaggataacctatacaaagttaaaagataagccacagacaggaagaaaataattacagagcacataactgacaagtgattaaaaatcagaacatattaagaacttctaaaggaaaaagacgaaaacccaactgaaaaataagtaaaagatatgaacagagaattcaaagaaaataaaatattgctcaatctctttgataaattgggaaaatgcaaattaaagtgatgagatattatatcatacttagactggaaaatactgagaagcatgggatctccaagtgttagcaaaaataaggggaaatgaacacttatatacattggtggtaaacacataacaactactatagagaacaatctggaattacctagtaaagctaaagaatcatactccccaccacatcacttccattcctaggtagctggcgtacacaaactcttgcacagtcattacaatagtgtctgtaatacacaaaaattagactttaaccatttctcactgccatataatggtgcattatacaccaattaaaccaaatgattttacacatgaaaactttttagaaatgactttgaatgaaaaaaaatcaacctgcaaaaggtttgcctgcaagaatagtatcatgtgtataacattttaaaacacaatactatacattatttatggacacatgtatgtaaaaggataagatatgcacagtaatgaggcttttatcagtatcaggaggaggaaaggactgcagaaagctttagtcatatttgtccaattttttttcctgagcctccaagcatgagtacatatttgtcaaacttaaaaaaaatttatgttaacagatctgaagccaatatggtacagtgttacatttatgaaatttggatgatgggtacatagatttttattatattaacctttcacttttccatatacttttccaagttttaaaagatattgttggccgggcgcagtggctcacgcctgtaatcccagcactttgggaggccaaggcaggcagatcacgaggtcaggagatcaagatcatcctggctaacacggtgaaaccccatgtctactaaaaatacaaaaaaattaggcgggcgtgggggtgggtgcctgtagtcccagctactcgggaggctgaggcaggagaatggcatgaacccaggaagcagagcttgcagtgagccgagatcacgccactgcactccagcctgggcaacagtgtgagactctgtctcaaaaaaaaaaaaaaaaaaaagatattgttaaataatttaagtatattacatagctttcgaaccagtaattccatttttagaaacttctagcaataactatcctgaagttatacaagtaggcacagctatacagatatgtagatatttgccaccacttaccttttttttttttttttttttcccaaagagatggggtctcgctctattgcccagattggagtgcagtggcacaatcacagctcaacatagcctccaactcctgggttcaagtgatcctcccaccttagcctcttgaaaagctgggactacaggcatgtagcaccacaccagctaattttttacttttttctagaaatagcatctcactacgttgcccaggctggtctcaaactcttagcctcaagcaatcctcctgctttggcccacatagctattaataacagaaacaacccaaaagtccatcgtcaggttaactaaataacaattcatccatacaatgtaattctatgcagcattaaacattatagagtagctctgtatgtactgtctgtggaatatatccaagtaatattagtcagaaaagtaggttacaaaatataagtgaaaaatgatggcactttgggggaaaaagcaatatatgttaacacatatgaagaagatcccaaaggacaagatacaccacaaattaacaataattatgctataggggattatgtgacttttactttcttcctaatattttttgttattgtccaaatattcctcaatgagcatgtatttcttttattagaaaaatcaataaagctagttaatttcacgcaaaaagaaaataaggacaatctggtaatagcagatgagttttacttgaaataacggaaaaggtaagcagaaaaagagggagatatcatagacagaagtataacaaaagctctaccgaaacgaagagccaggaggaagagcaaggcttagaggttttcatccaggttgggcattttcagcaacaagaacaaagaaggcaagagtgaggaggacagctgggagagctgtttgtgactgaagagcagagagtacagacagaactacacagttctcaaattccatacaaaattttaatacgtttttcacttcacagattctgaacctgccacaggaccagctcctttggtgagcgaagtgtgtgagcgaaggaaagattcttgggtagaacttcataaagtctgtcataagatcagccccagaggaggagacttttcagatcccatccctcatacacattcagaaggccaaggaaacaccctcaggattgaactatgataaagaaggtaaccaatagcctggacaacacagggagaccccatctctaccgaaaaaaaaaaaaaaaaacattagccaggcatggacagggaggtgcatgcctgtggtccctgctatttgggagtctgaggtaggaggatcacttgagcccaagaggtcgaggctgcagtgagtggtgactgtgccactgtactccagccttggcaatagaacaagacccagtaacaaaaaaaaaaaaaaagggtgtcaaaggagacaaaagcaatgacatcacagtggccttagtttagcctacacaaccagcaactctgtttctctagaattggtgagataatgagaagctgaagaaacagatgggtaggtgcagtggctcatgcctgtaatcccagcacttacggaggccgaggcgggtgggtcacctgaggtcaggagttcgagaccagcctggccaacatggtgaaaccctgtttctactaaaaatacaaaaattagctgggcgtggtggcgcacgcctgtaatcccagctacttgggagactgaggcaggagaatggcttgaacctgggaggtggaggctgcagtgagccgagattgtgccactgcacttcagcctgggtgacaaagtaagactccttctcaaaaaaaaaaaaagaaaagaaacagagtgagaaaaaaagtgggctggtaagccagcgggtaatcataagccgatcttgtgtttaggcaaatacgaaacatctacaacttgaaactaaacagggaagtaatggctctgtggccacctatgatgcagcatggaagttctactggcacgtgtcttctttctggatgtagtaccccctctaacacagccgccacatggtagagtagttgctaagaagccacaggaaggtacaacatctaagatgccacgggtgtccattgaaattaagccatccttttacttttacccctaggcttttggacttggacctcatccaaggagctggctgcctgcactttcacagaccgtcagcttcatccccaggccccaaatcctgaatttgccgtgtcaatgaaaaaccatcatcagcttttctttacattaaaaactgattgtgatcatagcagtttttcctgttttctgggatcactgctgcgaagaggaaaagtcaccagaggataaaatgacacacacgcaaactcttctgtggctgaaattcccctcactcttcctgcctctaaccgaaaaggaggatacagaccaaggagcacttcatgaaggtagtcgcctccctgccctgctgtttttcaccttcaggaagaatcactccctcccaagtaggacctctccctggtcactataatcccatgatttgtaatgtgggcttcattccgcaaaagcccagggctggtgttatctaggagtgatggcagtcatttccagatcatgagcagtcgcacagataaggcaaagggcaactcctgcctagcatgtgtgacccaagagatgacagagaagagaagggaggaatgcactccttcacctggtccctcagcactgagccagcctcccatttgtacatggaaggaaaggccaatacctgatacttaagaaagaattaactgttaggtcagcccccttccctcccaggctagtataaggattaaacaaaataatgttctaatagaagcaagaatacaagttacatggctctaacttggctccaatttctagctggtaggaagtcaatccttttacctgttttccaaagtctatgggtctgcctttagttggaaatacagaatatagaagctattacagaactcggggtcttgaattactgtccaactcttcacaaaattccatctgaaagaagtgatatttaaggaagactgtctaaggggtatgatataaatccatgcccctgcatattttaggctccattttctagcagatcacctgaaagctacacagatgtcattagctcagctcctcacagagtggttttcactaagttgcaatttcatgtaaaacatctgcattttgtctgcagtctctgtgagagctatagaaaaccaagactgcataagcactggttataaaaatagcaaggaaactgtcgctgtagtggtaaaaacaagaaaaaaataaataaataaaacatacttcttggtttaaaaaaagtaaaaattactattatatcattcaatattgccttacatatccatataaatttcattaaaacatgaaactcatttaaataactttgtcctttgagaaagtggtatgttgactgccaaggagaaggccattcacagcaatcacgttaatgaacaggattaggaaggccaggcatggtggctcatgcctgtaatcccagcactttgggaggccaaggcgggaggtctcttgaaaccaggactttgacatcaggctgggcaacatggcaagaacccatctctacaaaaagtttaaaaattagctgggcatggtggtgcacctctggagtcctagctactcaggaggctgaggcggaaggatcacttgagcccaggaggtcgaggcttcaaggctgcagtgatcttgactgcgccactgcactccagcctgggcgacagaccaagacaatgtctcaaagaaaacaaacaaacaaacaacaaaaaaaaacaagattagaacagctgcatgctctccttttcttcggtgctgatgttatttctgtttctatgttattaacatgactatggcctctctttaccagttatctactgtgtgccaagcattgttcccaggtgttaattatgttaattcatttaatactgtaacacaatcctatgaggtaaatgttaccaattctattttaccaaacaggaaaaccaaggcccaagtcatacagctagtaaaaggaggagccacaattcaaaccaggactgatttcaaaattcgcattccttccactatgccatggaaagtacagtagggtgtttttatgtcaactgcagccagacacatcaattttctcctctgagaggacaggatataaatctgaagaaacaatgtatatgaaaatatgctctatgctataaggcaagatttatatgtaagtaagtatcatcatcctcaaggagaagatgcataaagcagagctgacagttttctttttcatttttttttttaagagacagggacacgtttcccagcctaggctggacttgaactcctgggccaagcgatcctcccgcctcagcctgctgagtagctgggactacaggcacatgccatcatgccaggccagaactggcatttctgctgcacacacaccagtaaactcagcaggaagtgaactctaaacatagcctaagaggagaacttttctctcaacactaaaactcataaaaacacgtaagcaagtgtgtcggtcagtcactcccttaaacacaggtgtctggcaagatagtgagaaatcatcccacgtctaacgtccatgggcacagactcctgtttgcttcagaatccaggagatgctggcatttggccaggtaggccttcttttctctcaactcccttttaatctcatctccttcagtgatgatcattctcaaagaattatttcaagagacactatctttgagaagaagaattatttcaagttttaatttctagctcatctacaaatccacgactttttgaaatcaaagctctccaaaactctgacacctacaatgtgcttctttcctctaagtttgatggctattacctaggagacatgcatgccttccctggtagtttagagacaaagtttggaatatgatgtgctcagaaaaggggtcactctacctttagtcctgggcatcaagggctttctagatgtttaagagggaagtggtcgccagcagcaagaaaatgctggggtgggttctctggaccactgcttcactcagggacggccaccccttctctactcaacccatccaaaccctgtaagtgaagtgtaaagaatgcaacacagatcttcacaaagactacctaccaaaacaaaccccaaccagaaaagcattggggttactatgcaaagggatccctcagggataaaacaggaagaggggctcactgcatttcctctcaagggctcctgcttcaaccccacctatgtatcacaattcttttcctcttcagtattaaccccctacctcattaatttcctccactccaaccagtgggcagcaatgtccaacagagcacaatacatttaaaactgtttagaatggttgtcttgcacttttctcaccttgtcttcttccaccactggctaagctttcaaccgattccacagtgccccagctctgcagtaaagcaactaccccacatcttcaaactcttcacagaattgtgcaccatctcctgccctcacacacaccaggctctccctgagggcgctctctccaccctggcaacttcaatagctatgtggatggatccactcaaaactcttagctcacaactgattccctgacatcaattccacttccacttgagtcacccacacttttgcacaaaccctgaacctggcgtacccatctcaaaaccttgccctctactgtctgaccacaatttcccttcctgtctatcttttgaccattcactacctgacagctgctctctgaacttggccaggcctctgttcccttaggcctttttcctagagtatatcagccacctcttggcctttccttctgccaatccaggctgaaatccatgattcatcacaaatggatccatctcaaatccacagctcctttctctttccactgtacctacctaaaaagctctaactatggtattctccattcctttgtaagcacacctaaaaattgctagtcagataccacacatccaatacacttctgaaaggccttttggagatacattctgaagcatttatggaggaaatggtatgatgcctggagtttgcttcacaaaattcagtggtaaaaaaggaagagtactggacaagaatagaaataaaacaagctagttcatgtgttaatagtcatagttattagttaatagttacagataatggttgaagctggatggtggacacagcagtagtcatctattctctctactttggttatgcttggtattttccataacaaaaagtttaacaataaaacaacttacgtgcaagattaatggggaacaatgccaaaggtcacacacagattacctgctagtcacaaaatgaaaactataatttcacgatggagaaatttagctgatcctaccttaaccagtaatcaaacttagcatcaataataatgggccagccaaacatcatgtgcctctgatctgctgcatcattcataaagggttgttttctccctaaaatgcttaacctaaatctaatcaggtctctagatctaagttacagtttatagaatacacagggcagagaggaagaacctgaacaataccccaaagaaacaatcagacaaatccataatgtgaaaagtgaattcatgttaagaaataagaagtgtctaaaactgaactcccagcctgggcaacacaacaagagccccatctctacaaaaaataaaaaaataaaaaaatagcagatttagcagagtgtggtggcacatgcctgtagtcccagctactcaggaggctgaggcccccaccatctaactaaaactatccaagaagaccccgagcaacaaccccagaaccaggcaagtattgtggttttaagccactatgttttggggtggtctggtaggcaggacactggtaaatccagcctttcaagagccagccctgagacctgtctctggagtcttatcttgacactcctcaatctaccctgccaaggacaacaaacacgaccaactgggacttccctgcacactctacacttacagcttcactcctgtctttgtgcatgcaaatccttctacctggaatgcccctccctgccctgtctccttataaaggaactatgcctccttcaaaatctgtaccagcaccatttcctctgtgaaaccatgccctccttttccccactctcctcccaccagtaactcaattaatcctttcctcccagtgaaacatctagggtggcataaactgcaatgcagtatactggcttttcatatgtcttgtccattaaactattaagttccaagaaggtaagtgctatatgtctgtgcgctggtcctgcaggggcctaacgaatgtatgctgattggaagtggtttctcctgcttccttacttagcctatttctactaaaaacatttctgggccaggcacagtggctcacacctgtaatcccagcactttgggaggctgaggtaagaggatcacttgagcccaagagttcgagaccaacctcggcaacacggcaaggccccatctctacaaaatttttaaaaattagccaagcatggtggttcgtgcccatgatctcagcttctccagaggctgcagtgggaggatcacttgagtccaggaggtagaggctgcagtgaggtgtgatagcatcactgcactccagcccgtgcaacagagcaaagaaagagagcagtctcaaagaaaaattctgtttaagcccctggctgatggagcagaaatgatgctcgctaaatcctgcttttctcggtctcctaaactctaacttttcttttctgagttcgcaagttcacaacccttggaaaaacaaccccaggttgatccagcactaaaagctgccttttaaaatacagttaggtgggacctgactagcttagtgtctgggacataagtaggtactaaataaacattatttcttttccttctctcacttcaaaaaccttcctgaatctgttcccaaagcagctccatttcctcacacctttcaagctgctcttctccaaaagccacaccctttctgggtcttaatacctgcttagactttggcctactgcctctcctcagtaccagctgcccacctgctgccacctcagccagggtgagctcatcaaagcaggtaaaatttttaagggagaagcttctacgtcacaagatctaggtccagcatgtcaatacaattgcacataggaagcactggaaagttttgcaaaggggattcatgcaactatccccaaacattaacaaaagaaatctggttgtatcgtatataggataagagaaaacaaacaaaaaacaggattaggaatcagaagacttgggtgaaatttttaatctgcctctctcactaaaggctttttttttgtaaacttaatcagaaatattcttttaagccaggcacagtggctcacaccttgtaatcccagcaatttgggaggccgaggcaggcggatcgctcaaggtcaggagttcaagaccagcctgggcaactagtgaaaccccatctctactaaaaatacaaaaaattagccgggtatggtggcatgtgcctgtagtcccacctacttgggaggctgaggcatgagaatcatttgaacctgggaggaggaggttgcatgagctgagatcatgccactgcactccagcctgggctacagagcaagaccctatctcaaaaaaaaaaaggaatatttctttaatgtcacagaaaatgtttttaattgttatggtacatccttaagtgaaaagaagttcacaaatttttagtaaagaaaaaatttaatagaaaaaaaggttatcttaggttttcttatcaacaaaatgtaattcctgctgggcatggtggctcatgcctgtaatcccagcactttgggaggccaaggcgcgtggatcacctgaggtcaaggagttcaagaccagcctggcaaacatggtgaaaccccgtctctacaaaaatacaaaaattagctgggcatgatggtgggtgcctgtaatcccagctacttgggaggctgaggcaggagaattgcttgaatccgggaggcagaggttgcagtaagctgagatcgtaccattgcactccagcctgggcaacagagtgagacgctatctcacacacacacacacaaataaagaaaatttagttactacttctctccttacagcaaaattaattacagtttaaatgtaaaaactggaaccaagaaaacactaaaagaaaacatgaataaatttttttttgtgattctgacaagtgaagaagatttttccaagtatgacagaaaattcaactccacagccgagaagcgagatgaggggaagcaccttgaaggaaaatatttgcctaaataaaaatgtaaaacatgtgaaaggcaaataattagcataaacaaagtcaaaaaaaatttttattgggggaaaaattatcagcaacacatatggcaaagagtcctaatgccgtatgtatgtaaaagctctcacaagtctacaagataaaatagtgaccaaagagaaaaattaacaatgtatttgagcagaaaatttacaaaggaataaaatcaactaccagaaagataaaaagatgctaatttcattaataactgaagacatcctaaataaagtaacaataagaaatcctttttcacctatcagattggcgaagagtaaaaaaatgtataacacctgtgttgggccagggcgcagtggaaagaggcacctccataccctgctgatgagaagtacactgatgcaacctctttggaaggcagtttggcaatttaacatttataatgagcacaccctttgatcagcaaatctttccttctaggaattctgcctaaggaaataaaatacaagtactaggacacatgggcaaagacagctggatactgctgttcattacagtactgcatataacaggaacaactgagaaacaattcaattgtccgtcaaaaggggcttggttaaataaattatgatacatccctctgaagaaatgcaatgctgctccttaaaagcacatactgaggtagaaaaatatcctaggtaaattacaagtgatatgtttttcagtacagtataatcttttctttccattttttaattgcagtaaagtatataaaattccccatttaaaagtgtacaattcagtggcattaactatgttcacaatgttgtgcaaccattaccactatttcccaaacttctccaaacagtaactccgcaatgattaagcaataactccccattctcccctctccccaagctcctggtttacctctaatctattttcctgtctctatgaatttgccttttctagatattttatataagcagaatcacaaaatatttgtgcttttatatacggcttatttcagttagggcagcattttcaaggtttatctacattgtagtatgcatcagaacttccttcctttcacagctgaagaatagtccacagtctgtattactgtgtttatacattttctttgcacattgtttgtacattttgtttattcgtcagtcagtgaacatttgggttgtttccaccttctcgctgctgtgaataatgctgcaatgaacactggcatgcaagaatctgagtccttgttttcaattattttgggcatatacctaggagtggaattgctgggtcatatggcaatttggggctttttggggaataatcaaactttcccacagcagctgcaccgctaacactcccactaacaatgtatgaggattctaacttctctacattctcaccaacacttcttactttccatttttttaaattaagagcataaacttttcgtgtaaaactaaatgtacataaaaatgcatcatttaaagaatctttatggctcaaggatgttagtttaaatatataaataaaaaatataaataaataaaaaacccagtgctacccaactgttaacaataactatttttctggggcatgggtttatagaagatgctcatattctgccttacgtattccccattttgcaaaagtttttagaacacctggtgttgcttttgttattttaaaaaatgtcttaaacaaaagttagccagatagacggtttgatgcctgcctgctaatgtgaaacacagtttcagtgttacatacacagcaaggccctaaatgggcagaggtgagaagacctgagtcccagtccccactctgccaccctgagcactctgtattctcacctctcaactcccaggcacctaggactgaatccaagttcccagtgagcatccgcaaaatagacgacagctgtgtggacccacccacgtggtccttccaccccggggacagcactgaggctacaggagccccaggtgggttgtctcaggctatgtatgggtagccgtctcccttcctacattgaaacagaattctacagttgtactgaactaatgaaggaaggtaagaaaaggagagctcggggaaaacctgcgagtcatggactatgaaggaaaatgaaggccttccccgcaaagaaagaagcaagcccagaaaagaattcaagaaatgatgatgccaaggaggacagggcagctgacattgactaatgcaagtgtctcacctgaagccacaggtgctgaagtagacagcaaagggcagtgcctggagccacactgctctgtgggaaccatcccaaggtcacctgctcaggcagcaacaaggagaaaacccagcctctgtgggaagaggcactgaggcctggggaagtgaaagtcaagtgaaatccttcccctcttccaggtgttctcagcctttcggctgccaactgtggactttgcccttgaaattcaactcctggcctaaagagataatctcccaggcatgtcctgtgtaaatttggctaatcaacagaacacattctgtgcagcccctgctggctgtccctgaaacagccctgccagccagtagtagtgctgactggcggggggaagcttttcctggcagaaatgccaccaatcctaatgaaatcaagtgcccaggatgggcattttccaaaaatcagacaagcatctgtttaaagacgagcacatacctggaaatctcatccagaagtgatacggatttggtgagaagagtcattgagagcatggacctttaccaggctttgttgatgttttagagtaagccacctaagaacatctaaagtaaagctttgtagacatgaaattctgggtcagtaaaagaaagcaagccaattaacatctggccctcatacccttattggcatctcagctgccaagcctcttaagcagtggttctcaaagtggggttcccagccaacagtagcagcatcacttccaaacttgttaaaaatgcaaatttttactaaaaaatttctactaaattggttaacaagctctccaggtgagtttggtgcacagtcaagtctgaaaaccactgctctacgggctctagaaagctctgcaatctggagttctgatcccgcccaccctgagacttcccttactttctgctctaaatgaattttgagggactggaatatcatcctccagttacagccaataaaataggcaagtttcctcccactccatttccatcttctacatggtctcctaggtttcttttctacaaatcatattcaaatgtgtttccttcctgcttcctggggaaagtgattccccgctttctggatggttcaatcccttaaagatctgacctcagccagtctttccagcctcatcttccaacccatctgtgtgtccctgctcatggcagatgaccattcaatgtctgctcattgtgaatcagtgatgaagaccatctgaacaacaccctgtaaaggaacctttcccaactacattatctttccttcagaagcaagtctgttactgaaacagactgggaaggggagacaggaaagcaaaatccagtgacttaccaaagaaattcctctgttttctagcaatctatgctaaatctgaaattcagtctcaccctgctctgcccttcacaaactattccatctaagcaggctgattgggctgaccacagatctcatgaacaccaaggaatgagagtttataaacactgcatacattttcatttcagaatcccgggccttcactactgatagaatccaaacaggatcaaacctttaaaaaaaaagaagtatggaccggacacagtggctcacgcctgtaatcccagcactttgggaggccaaggtgggcagatcacctgaggtcaggagttcaagaccagcctggccaacatggtgaaaccctctctacaaaaatacaaaaattagccaagcatggtggcgtgtgcctgtaatcccagctacatgggaggctgaggcaggagaatggctttaaccaggcaggcaacggttgcagtgagccaagaccatgccactgcactccagcttgggtgacagagaatccatctcgaaaaagaaaaagaagtatcaacccatagaaactagtcaatgttcaatttccaagaagtgaaatttgtggcctgatacatttcttttctcaaacatttccaacaaacttgaagactctagaagagatctgtacgctaggaaatcagggtttatttacaaacactagtttactgacaaattacttactttttccaaaagtaaattccatcttcttatacaatagggggaattgcaatctaagacatctaactacttatggagcgttaaggagaaaggccatttttttcctgcccagagggagagatgtaagtcaggttaactgcttccaagtcttgccacagccccaccctccccagttgtttatatggactcgcattctcagtatttaaccaggtacccctttcagagaaagctaaaaaaaactcattcaattctgcaaacattcaaaatgtgaccataaataacacatagtgatacaaaggaaaaaactcattagatgttctagataaccaaagaagagctgcatttgatataccaaccagagtggaagtgtggcaagaacacatgcttggaatcaaacagccttagatttagattttaagcaagttagctactccacatccctgcagatgttacaacatcaacaaattaactcacagatcattgtaaggatttactaaaacaatgaaataaaaatgcctagtataacacaatgcttagaacagagtaaacattacactaatgtcttaccgctaacctaaaatctgcagaaaatttaaaaatacatagtgcttgatcccaagaagtatgcagactatattaattcgacttccttagctaagcaggtatgtctatgcccacttcagatcccttctgtttcctcatattcttatccccttcccccttcttcccccttcttcctccttcttcccctttcttccccttcttccctcttctttcttcccccttcttcccacttccctcttcccccttccccctttccccctttcctcttctcttctcttctctgagacagagtcttgctctgtctcttctcttctattcttttctctgagaaagagtcttgctctgttgcccaggctggagtgccatgatcatagctcactgaagcttcaaactcttgggttccagcgatcctcccgcttcagcctcccaaagtgtgggggttacaggcatgagccaccatgcccagcaccctactctttttcctgattcttctccatcagattcaatgttcctctctctccctctcaaatttccataccttatcccaagttgtgccaccatcctccaccccgacacccccttgctccctacattctaacaatgatgacttcctaggtgtcctttctgcatgtcaagctctttcctacctcaggagctttgacagctgttcccttttccagaaaggaactttccccaaatctgcacattaacggcttcttctcatccttgagctcacagttcaaacgtcattctcagaggccttctctaacctctcaggtccctgttactctctcttttacatcaccattatatccttccgagctcacagcactatcttgatctcatctattgatttgtttacttgtttactgaaatgcttccccactcactacacgtcaagctccatgacaacaaggacttcaatgtcttagttatctctacctcctcggcatacagaacaaaacctagaacagaaggaatgctccataaatatttattggatgaataaatacattcagtttccgaagcaagagaggcagagttagattccccctcactccttcgctttctctaactggtgacagtagaagatggaatcccagggaaagattgtaaattaaaaagagaacagactgaggattaacttttggggaacaccaaaaaataaaagccatcccaacccccccaatgacaaaacattaagggctatcagggacccaggaggatggcacaggtgttgcagtctccaccgcctttttttgtttctacagctttccagaagaagctcagcttcttcctgcaaggccatgtagacatctggccttcggtgtttttcagatgaaaagaagtctggatatcactgctttgaaaacccatctgggcacataagcagaataggcacctacatctaaatggagggaaaaaaaacccacctgggtttaccaaacagttgtgggtcctgcaactggagggggtaggaaagaaaataaaaaggcttttctatttccacttaatgagatttaaataaaacaacaatttccggttgctttttttttttttttttagacggagtttcactcttgttgcccaggctggagtgaaacagcacaatctcagctcactgcaaactccgcctcccaggttcaagtaattctcctgtctcagcctcccaagtagctgggattacaggcaccggccaccacacccggctaattttgtatttagagacaaggtttcaccatgttggccaggctggtcttgaactcctgacctcaagtaatccacccacttcagcctcctaaagtgctgggattacaggcctgagccattgcaccctgccctggttgctttctttttaacctggatccctgccacttccccctgggtacttattagagttcagttgacaaaaccaatagcccttcttacctccaatatcttcacaactggctctcccagcacagccaagccaagagcaaaccctgagcatcagtgatgactcaaatgcagagaggcagggactcggaaaggacagtgctacctgttccatttatgtttcaacccaaagggataagtcaatcaggaggttggagagaggcagagaacataagaaacttcagtattttctttcctttctagattcaaaagcctcaattctcagaacataccagccagagtccaagccacagactgcaaaccaaggtcactgccattgccaagcttgtctcacatgtcctagctattttcttctcacactcatgtaccatcctcctttttctcttttttttttttttttttttttaagagacagtgtcttgctatgttgctcaggctggagtgcagtgtgtattcacaggtgtgatcattgcgcaggacagcctcaaactcatgggctcaagcagtcctcctgcctcagcttcctaagcagatgggactacaggtgcccaaaaccagagcacactcctttatagttgctggggtcattcaagttccttaatttcctttccctactggcattcctttttgctaagtggcaaagtatatacacacaagtcagacctttttgtcctaaggtctttgcaaatgagtacaaagttccacgtgtagtgtctacagtcctcagtcttcaccatgtatttattattattattattattattattattattattattattattattattttagagacaggatcttgctctgtcacccaggctagagtgcagtggcacaatcatagctcactataaccctgaactccagggctcaagcaatcattccacctcagcctcccaagtagctgggactacaggcatgtgttaccatgcttggttaatttcatttattttgtagagatgggggtctcattatgttgcccaggctggtttcaaactcctggcctcaaacaatcctcctgccctggcctcccaaagtgttaggattataagtgtgagccattgcattgtgtccggcctttaccatcttttaattactccatcagaacacatattaggtcacaaattgctaataaactaaatgggagggagattccagcataactctgcaaggaaacttacctccactaaggagtacggggcacagttttgggagctctatgcaccatcgaggctaagcttctcctggttctacaaggagctactgtcgaatctgagcccctgcctgtggaagcctgcagaagtaaaaaagctgaagaacaggatgtttgaccatcatctagagtttggtcttctaaagcaaaaataaccttacattgtaaacaccctcactcaaagagaaaatttgtgaagcctctactcttaggaactccctattctgccctaggcctgtctgggctcagcaggcccataaattggcactgttgatatgacctttccaggctgtatttcaacaagagataacaacaaagctcagagctttggtagcactcaaagaagatttgagggacttaaaacacattgctaaatttggcagcaaaagttcctgttccctgaagttgcaaaagaaaatctctttataatttacacttgtagataaggagctattcattctctttagaaacagattagaacctcctcatcccaatccaccactcctctgaaagaggagtgagactgctggggcaagtctcacctggggctgggatcaggctatctcttgggaagatgaagtaccaggaacttaccttgatgcctcttactgccttagccacaaatgcccagagacatttgccacttcactatctagagccgtctatctccctcaccctcccatcagccttcccaattcccattctgctctttgacactgggtctgccatgtccctatccctgttgttcatacaacacatattactcctcagagaggggcccgctcagcctagaggctcttttgattcagccagactccccttctggtttataatttctttacaaaagcaaggtacaggagctccgatctatatgctgactgggggacgcttatcactgctctgctgataccgtctgcccaagacacagaagaaggggatagggccttgcatttctcagcagaacaaacccaacagacaagccacaaagaaataaacacagctgcctggcgtggtggctcacgcctataatcctagcactttgggaggccgaggcagatggaatgcctgagctcaggagttcgagaccagcctgagtaacatggtgaaaccccgtctctactaaaatacaaaaaattagctgggcatggcagcatgcacctataatctcagctactcggtaggctgagacaggagaattacttgaatccggaaggtagaggttgcagtgagccgagatcgtgccatttcactccagcctaggtgacagggcaagactttgtctcaaaaaaaaaaaaaaaagaaagaaagaaacaaacaaacactcctgaggctgggtgcagtggctcacgtctgtaatcccaacaccttggaaagccgaggtgggcggatcacttgagctcagttcgagaccagcctgggcaacatgaagaaaccccatctctataaaaaaaattataaaaatcagccaggtgtggtgcacatttgttactccagaggctgaggtgggaggatcgcttgagccagggaggcagaagttgcagtgagccaatatcgcaccactgcactctagcctgtgtgacacagtaaggccctctcttggggaaaaaaaaaaaaaaaaaaaaaagggccgggtgcagtggctcacacctataatcccagcactttgggaggcctaggcaggtgtatcacctgagatcaggagttcaagaccagcgtggctaatatggcgaaaccccatcgatactaaaaatacaaaaattagctgggtgtggtggtacacacctgtagtcccagctacttggaaggctgaggcaggagaatcacttgaacccaggagatggaagttgcagtgagccgagatcgtgccactgcactccagcctgggcgacagtgagactctgtctggaaaaaaaaaaaaggaactaaacactacttggtttacaagagaataataaacaaaacaataactgcaaacattttgttcagcaaggaggcaggaagtactattctaggcactttacatttggcatttaggctttgttacagccccatgagataatgctaccactgcctcaattttacggaagaggaaccagggcacggacaagtaacttgtccaaggttacagagctattaggtggcagaggcagaatttgaacccaatctgaccccagagcccaggctctaaacattactctcctattggatggctcttcccctaagacacagatttgcgtctgggcactaactggctcaccctaaactctaaaggagaggggattgctcagaaaacactggcatttttcgccactgagaaaaggaaacagtgatggaaatatttattcaaagacctggtctaaggctacagagccaaacaaataagtaccccaaacatctgttaaccaaaattttcccagggcaccaagagaaacctaccttcttacttactaaaggctgaggcctccttgtactgccctacgcattggagaacaagcttccagcctccgagttctgagaaccaagtcaaaatgcttcctagaatctggttgatggggttaaagaaaagttactcaaatattttttaagcaccaactatatatgttagccatttggggaaataaaaagtataaaatattatacttgatttcatacaacttcaaggaatctagttgaaaacacaagatatacacatttgaaaagtcaagtcagggccaggtgtggtggctcacatctgtactcccagcactttggaaggccaaggcaagcagatcacttgagggcaggagttggccaccagcctggccaacatggtgaaaccccgtctctactaaaaatacaaaaattagccaggtgtggtggcgcacatctgtaatcccagctactggggaggctgaggcaggagaatcgctagaacccgggaggtggaggctgcagtgagccaagatcatgccactgcactccagcctgggcgaccgagcgagactctgtctcaaaaaaaatgtcaagtcaggatgtcaatgagaacactgaatccatgccttctactttctggaagaggagactgaaccctagagaagtcaagttacttccccaagatcacccagcaaattagagacagaaccagaactaacatccagacctgctgactacctggctgggactttctaccgctatatgtaggcagagaaattcacaggaaggatggattattaacaacagcagcagctaacatttattgagagcatatttgtgtctacaactaagtcgagtgccttacataaattaacacattgaaaccttacaataaccctttgaggtgggtaatattatcactcccaacttacagatgaaaacagaggtttacagagatgaactcaccagaggtccacagatagaggaaaaaccagactatggaccctcagagctggctgcaaagcctattctatgctctaagctgcatctggaagggtacaagggcagtatttgtggaagcaggggtaaggagggctgaggcagaggccggggtctggagcactgagagcagcttgtgaagggcctccaataccacactgagaaagacctcaggggctccacctaggctggccagcaggaaaggggcaggcgagaagcagttctggatggacgggtctccccgtctgtgaggagtgagcatcccacagcaggaggaaagagctgaacctgtgaagctgggttgacaaggactacctcagactcaggacttctggcctctccagtgtgggcggctgccgtgtcctcaaaatctcattggcccctactccttcctcttaaaggacactctcaagtaccttcctaacgtgtaggccaggtctgaaagggcagtcctccttggctgctggtgactttccaaagcaattgtctttctctccctaccttgtccatggctccctgtgccctttctttgatcattctgcctgatgcagcagccataagacatggggagctgtctgtcaagtggcaggaactgaacacaagcagctttgagaggtggggaggaaatcctgtgttattaggaaatcttgtattattacacacccaggactgcacagaccccagaccagactacctggggtcttgacagaaagatgaacgagatgcaaaatagcagctacttctttttttttttttttgagacgaagtcttgctctgtcgcccaggctggagtgcagtggtgcgatctcagctcactgcaacctccgcctcccaggttcaagctgttctcctacctcagcctcccgagtagctgggattactgatacacaccactatgcccggccagtttttgtatttttagtagagacagggttttaccatattggccaggctggtctcaaacaccgacctcaagtgatccacccacctcggcctcccaaagcgctgggattacagacgtgagccactgcgcccaaccagcagctacttctaaaagaagaatctggtttgttcccagcgtagtaacatcaacctgtttgagagacaccagcccactctcttcaaaatgctgctgtaagttgataataatatactggaaagcattggacatttactatgtaccaggcactggcctatttacaggtatcatttcatttaatccttaccacaactctatcaagtcaagtactattacatccattctacagatgcctcaaagaaggctgatgcacagagagattaaataacctgcccaaggtcacacagcaaggtcaggctctaaagctaggcctctaagacccctgagctatagctgttcatcactgcagtgcactgcaatgcatgtcagatactcatattaaatgcaaatggttccatcagaattgctctaaggcagcaccacgcactcactgagtacctaagagtcactgagagttgaacaaacacaccacaggctagttcattttaaaaccatctacaatactcagttgtcagaactccataaggtagcctgtgttccaagtcacaagcacaccaaaagtcagttcctcgaacaaaactagagttttaaaaatagctgacttgatagtttttttccaactttcccatttcccctttcctatgactccctcccacatacaccatcctttgacactgtcaagagaagcttcaacacaggcctagaatcctcaccctcctacttccagtccttcagttggctctcttccttcattcgaatcgtgcttgaaatcagtctgttggaccctcctcctttttcccagcctaagagcatgagatggtcattaaccctaccatcaaaactcagaactgcagcaggtctatgctgcttctctcttaatcacacagacagagtgggggagagaggggaagaaataactacaacacaacgtctattataacatgacatagatgggagtaaggcccatacttgatacttctgcgttcctccccagctcttggcccagacactccgtattcactgactaaatgggtgaacagaccaatactgcatagatgggcaccagagacacctctgagccaagaacaaacaaacagaggtgttaaccctaatgccagccacccctaccccctccagtgcttctgagggcctgcacgacactgtcaccctgagctccctgggggcagtctggccttctgctaaattgtgtaggcctccgaggtcagcccttctctcgattaccacctgctgctcctgagaactgcctccgcccagggccccttgcccagtgcctcactcctgcttccttccagtagtcttcctcctgcctcagatcttgtctcccgtaaccctcagtttatctcattttttcccagttccaaataatcctccatccactatgtgatttccaacagtccatctccagctcacacacaacccctttggtgatgacaggtcacacagaggaagagtctggagctttgagaaactgtggtggtttcgtgacaagcctgtaggaataggtctgctttggttaagaaggcttcatacgctaactgcatataattcactcttttataaggacagtgaaatctaacattcaggcagttttagatgagaagagtatagtgatagtttcaacaccctccccaacaacagtacattcatgacatcagagccaaaaaaataagagaaggggtctttggagaaattcttcaataaggtaatctagactcatttaacaccctcctctcccttcaaaacacacacacacacacacacacacacacacacacccaggagagctttctggggcctatggctagaaatagagagctcaggtgtttctatcagcacaatattacgtggcatattcctctaagacagatgcacccagtagttcctccgacccacctactgagacagacacacatagcacctcccctccaggatgaaacaaatgcctagcctccccagcccctgcctccccaggagaaggcacacactaatgcaagttttcccataggctttaaagacaaatctctgcagactatgccagatggtcttttttttttttctttttcttttttcgctctatgccctcctggccccttctccactttccatggtccctccaactcaaagaactcaattatctgcctgcagatttccccttcccctcctcgcagcctgccctaaacacaccctcctcccaagcccatgcagaggcacagaaggaaggccaagccagggctcggaagggctgctgccaggcctcctccagcctcaactatgtgttccccgggcttggctgcctcggccgactctcttaggcccaacgatggaaatggggacgtttccagggcaatgacagttaacagctaagaggagtgacaggaaggaagatgtattcttcaatccttcagtcccaactgccccacagggaggtgcttcagaaggcccaggcctcagagcctcccatctccctgaggtgccaggtggacctcccgtaatgcagttcttagaatcagatgcggtggggagtggggcacagcctctcttaggtctaggctaccagtggggccatgatacttggattgccctcctgaatctgtacaccccgcccttcattccagggaaagaggctgaaccagcagaaccaagggtgtccttggcctgttctccagtgtatttcaaagtttcatcttcccggggtgactgatatctaatttgagagagagagagcccaaggggagaaggtacaggaagcggagtagaaggaggaaagagggagtgagaacaggaatgttactttttaatccttaaggaacatagacagatccaatttgtgactcagctctgggaagccggactgatgggagtcggggaacagctgcagccccaatctaagctgtgggcagcttctccttcaggccttagaggctgttgtgacatgactcaactagaaggggagctgcttgttttgtttcatttttttaatctgcctactatgggtctgctcaagggcttcttcccagacaccactccgggatatggctggcaggtcttccccatcctacagtaaagctggggctgtgggtgacgcgctctagtatgccatacgccctttcgactcaatgaggacagacctgggactctccttgcctggagtctcccttcccctgctcttccattccttggcacagtcccatggcatatcaagaatctctgcccttggaattcccacttccttgtttctttttctttccccataagctgtggccttatgagttcctgaaagacctgcccagcccccaagaagcctttcggagcaataacactttctcccagttagaaccctgccttctaaacccagaatgaaggagaaagacccctttgcccactgcagagtgtgcccagcaggacccagcaggatgagggaaccaggcctggcctcttttccagctgctaaagtttatggtgccacaactctacaggcagctgtgggacacaggaaaagcgacgggtcttttggaatacctctcctctatactatatataaacacatgagtcaggtgaccaaggaaagcttcctccctgcaggatcgtctatgaggctccagttttatggcaaacatcactcttatgaaacgacccaacccaaggaaagcaacatttgtttccttaaacatcctgaagaagtcttttcagatttttctcatgtttacttataaatgcagaaaggaagaaggcactttataaaatgagagaaccagaacagagaggcaaagtgactttccagagagagttgggtcattcctcaagcttcaattcacaacacggttcgttagataggacgtgacttgtttcaaactactttcatggaagttatcccactggctcctcccaacagtcctgtgaagttgttcttattacctccatctcacaggtaagaatctgaagctcctattagttaagatacttgcccgtggccgccctatgggaacagaatctagccgtcgactcaagtctagcaacccaaatccattattctttctgctataccaacagaaggagcagcagctcctgaaactgggtctctgctagccctcttcacagatgtggggatggtaaaattgaagagctccaactacacacacaagtagaaaagaaggctgaggttctggatttacactgccaactgaaggggccactggctcagtgttatgccacatccctccagcaaaatgtaggtttcaactaagcaaaggatccctggagtgtatgtagcaagaggaataacttcagaagtggaccgtctgaggtccagggccatggagttcacccttgtggaccctcaggccacaaccacgatgtatacatgtactcattttagggagccggaactggggacatggccagtgcttgcattggcaagctgatccgaagttaatcagaatgccccctcattgtttgccagaatacaaaagacattctgttcagaaagttcaagaagaaaaactgaagaaccaggacagcagctgttccctcatcccacagagaaaccaaaggcatttgcaaagttccctgaggccaagaagtgaatttaagacataacatggctcaagtggaagcacaacccctgatgggtctccgttgcaggaagtgtttgctgcattcatcctcctcataatattactgacaaccccactaccctatcacctataaaactgcctttctgggagggtctcctttccaaggccacacagctcaccatgtaccactcctctaggtcagaacaagttttaccaaaacttaggacaatcagtgtaggagtgcacagcgtggacactgcgtgccctgagatttggtcaaaatgtaaccaaaggaatccacccggcacaactacagtgcctcatgttccccagctcttagcagctgctgctgagagctcactctgggacatctggatgagaaacctgtttgcaggccccccaaccccaagccagccccctcctccacctcttaggaaagtctgtgatcgaccttttgatgtgggaggacagcttgattcttaccaagctgcctggaagagagagagtgcaaaaccccagctcaggcatccctgtgacagtccctctgtcctaataaatgctctagagggacttggaactcaccacaggctcctggctgagcttaattagccttttttttttttttttttccattacaggtcagacatagcagcaccaagagacaaaacagacagtgttcactaggacgaacaagcggctcaaaaggcactggagtttccctgtaagaactacaaacaccacgggagtgatgttaactcagatttttccatataaaagattcttcctgtaaaaatatcctgtgcctttgtgctaaataaaagtaaaatgatgctttttagagtgaagtctaaacacctcagattcagcaagagtgagatcagctagatttgcaaagtcaagaaaattggctgtttccctcctccttaagctaatagaatccaactgttggagcatgacatcattcctgagccccaaaccccgagcagagactacagacactcgcctgactcccagaaaacagccggagagaagggccaggaaaggaggccaaatgatcccagcccggagctgcccttacctgaaagtcccgctgctttcctgcccactccattctcacaccgcagccggctagggagcccagggcccccaaatccactggcttaagctccgatacctgctgcgagcttcccacagctccttcctctgacctttcgtggcgctcctcgcagccaagtgagcagagcactgctagccggccaggccggttgtcatggagaccctgtcctcgctaggcgggcgcgcgcacagcggcgcgctcttggcctagcgcgtgcacaagggcgctctctttttctttctttctcactgtctctctctctctctctctctctctctctctctcagttctgggaggcttccatgaaacagcactgtcttttgatcagctcggtttttgcatgcattccactcctcctacctcccttccagtccaacaggggctctgaactgctcctgggaacttgcttgaacagctcagaggggagaagggagaagacagtgagtggacttgttttcttcccctccagtgtctcattttttataacttggaagaatccctgccaggggggagggagctagctgaagcgcttgaaggggacccagcttcctctgggtcctggagctcgggtaggagggaccctgatgcgctgccttgacttgtttgtgcacttgggatttttccgggcagcagttggggcggaaatgcactcacatcccaggagctcgcctggactggcctctctgcttaccttgctgcctgtccaggttgtggcgatggctttaaccagtgcagggactcatggtactagtggtggcgcctaagcagtctctcatcttcctgaaatggagagcaaagacaactcggtcaggaccaggaagaatcctgggcaagtcgagagtcacaacccagacgacaaacctgatacaaatacagccttgtctctctgccctgctaaggatctgcagctaaggtgcaggcttagtgggagctgctgtcacagtcggtaataatattgctcctgtcagaaaatgagcacagtccctgggacacggcagaccccctaagtttagtcccatccccatccccatcctgtcccttcctctcccccctacccagcatacatttctgctttgtaacattctttttacatgtatcattttgtttgatcctcataaccttttgaaatacactgcacagatatttttatgaccattttttcaagtttatttattattcttcttaaatttcttttagagacaggatcttgctccattgcccaagctggaatgcattggtgcaatcatagctcactacatcatcaaactcctgggctcaaacaaccctcctgcctcagcctctgaagtagctgggactacaggcatgcaccaccacgcctggctacttttttaatttttatttttatagagacagggtctcactatgttgcccaggctggttttgaactcctggcttcacgcaatcctcctgcctcagcctctcaaagtgctgggattacaggcgtgagccagcatactggccttatgaccattttatagatggaaaaactgagactcagagagattaaacatttgatctgcacttatacagttaggcagtcaaagaactaagagatcagccaagttcgccctagtccagcacactttcaactaaagtatattgccacctgatttcaaaaactgtcaactttttgataactggttatgagataacgctgggctcccaagggaaggtggagaatccttgtaagttgtggcgagataggctgactaccatcctttcagcctaaagaccttaagacagcatctctaagatgtaaaacgtcctgatgcacagctcggagaaaaagccctaccctacagctatatgtgaccttgcacttttctaaacgactctcaaaatcttggctcgtctgttcaacatgacaggtctgaaagttaggattggcattattatactaatttaacagattttttttttttaattctacaacagaagtaaaattacttgccccaggtcatggaaccaggaaataaaatctagaaacaatccccaagcctttcaagtctcttgagtacattaagcacagtggttgcaacagcaccaggggtcagaagaccttggcagtgcctgactccaccactaacgggccatgtgccattgggcaagtcccatgacttccccctttccacctacagagcctactgacagggctgggactgagcatcggaagagatgctgtccgtgaaagcactctcaagtcaggaactgaactaagaactttactcctcttgacaactcctcaccaaaaacaaacaaaaaacactgggacagttaataccctccccaggatgaggacactgaggcttaaggaggatattttccaatgctgctcccaaaaacagtgctcccaaaaaaaaggtcctgatgttatttatttatttatttattgacacgaggtcttattatgttgcccaggctggtcttgaactcctgagctcaagcaatcctcccacctcagactcctgagtagctgggattataggtgtgtactaccacacccagcctgatagaatctttaatgcaacatcctatgcagaatctagtgggtttttttcattaatttccagcatatcacaacattctcaaaacaagattctgattgacttgagtttaaaaggtaaatatataccagaagttaaggtaggaaagtgttataaaatccaacaggaaatgacagaatggcacaaatcctaaatggggggcactactgctttagtgaagcaatcagagcttgaaagggagtgaacctaatcacccactataaatccccaaccccacccaagccccagctgaagaatcccaagtctacaaagaaagacaaagaaagacaagacagaagggcaaatgcagtatcatcaaatcactaaatttccgcctcttccttgtccaaaaggcatccctctgctctcctcctgatcctcaaaatgcacattccacttgcccagtctccatcctgagaaagaaggggtgatcccacccctttctataataagataatattaataatacagtagtaacatcagttaacacttgttgagcacctaccatatgccaggcattcttttaagcagtatgaggggccaggggtcaggactgagtactagaactgatacaagtcagttcctgaagtaatccaaacttaagaagccctccaaaccagacccagaatgcgggccatgctccccctagtggcatgctggagttatggaggttccttagggccttgtcctgggggaagggacaaaggaagggccccattactgagagaactggaatccctgcttgggtaatgctactgtgtacacactccttgaactgggcagagtcagggacagctgaatcccaccactgcctctgcaaggctggatttagaccaatcctacctgacccttctgaaggataaggatttgacaaccttatataagctctctgctgtctactgagaggcctgcaagcatacatgtgccagaaacctgggagacatcctcaactctcccttcttatttctgcccacatccaacccatttcccaactgcaaacaattctacttccaaaatatatcttttatctgtccacttttctccacctctgatgctacccatctctcaccttaattattgcaaaaacctcctaattgccccagcttccactctcccctcacaaagtcattagagctgtctgaatcaccttttttttttttttttttaacaccagatcaggtcatttcctgcttaacacacttcattgacttcccactacacttaagataaaatctaacttcttaccaggacctacaaggcccagcatgattctcctcctgccttctttcagcacacttcctgcccttccctgtctgtgcatcagccacatacaactgcttttagttcccctgaggtgtcatattttttccaggttgtttcccgttgctgggacactcccctaccaagcagtctttgcctggatagctcttactcaccttgcctcaccttgactctcctgtctcttgactttcacaatcctccaatctaaatgaggctccccacacttatccttcagagcactcaccatgctgtgtaattatgcatttatacagttatctgcttaatctcagtcttccctcagaagagttccttaggatacgaaccttgactattttgctaaccaccaatattccctgcactttgtgcagggcccagctcacagctggcactcaataaatatctgctgaatgaaatgcataaaaccccatttcttcctgtccgacaggaagaagaaacttagagcagctatttcatgtcactcattgcctcttttcatcgacttacaaactataattacatttcttttcctcatgtgccttgcctgtgggcacaaccaaaaattcctgtaaagcctccctgtggtttgtttcccagaactttcctggtaaggtcactctcctggggctgccctccagggttttacagctgctcccattaccagtgcccactcacaggcctccaccaccaccgggtcattgccagaccactgtgtaggaatggcccagctcccacgatgacaaggttctctcaggccagcagctccaaggacaaaacacctcctctcccctccatggtgcaagacactgtgcttgtaaaaaaatacatttttactaaaaaaaaaagtcttatgtttcataatttggagatggttgtaaaaagttcagaaaaaaagggttctcttactaaaaagaattttgaacactacagtctggtggaaaaatgaaggtctaagtaacaccaacagcagtgtgactacatccaacgttccctcttctggcctacgctcccacccaaatctgaaatcctctggcttcatctcttgcccacacctcccctgctaccaaccacccgattacaggcacaaccacagtgcactgcctggttctttgaacactgcctgcattttcctctccctccctctatggctcatgctgttacctttatctgaatgcctctccttcccccactaacaaaatcttactgccttcaaggtccaactcatttatcacctcctctgtaaaatatttttcaatctcctgatagaatctgtttgtctcttctgcaaatcaacagcagtttaaagatgcctttactatagcgttgatatcactttatcactgttacttgcacacctgtctcccccacagacctgagctcctcgaggtgtatccactttagtatttcattcaatgtatgcaataagtgtgtgtgagataaacgaatcattgaaaagactctccaaacaaacaaacagaaacagctatttcctctcttaaggtgagggaatttgagtggatggacctacattgtacaagaaaatacatatatgtaaatcggattttggattaggtcactagaggggtttatagtactttcttgtctctttaaagacaactgaaattctgaacctgaaaacacaggaacagagtaaatcttttcaagtcattccttactttgggatcaaagaaattcaagtaaaatgggctgttctttcaatattattggttggatcttagaatgcctaagaaatggcagtctaatttcaaatgcctctgggaagcctagtttctaatgccccccagactggggtccagtggtattcccactgaaaacatccagttctaccaaattaatgggtgatcaggtcaagtgcagtggctcacacctgtaatcccagcactctgggaggctggggtgggagaattgcttgagcccaggagttcaagactagcctgggcaacataaggaaaccctatctttacaaataataattttaaaaaattggctgggcatagtggcacacgcttgtggtctcagttacttgggaggctgaaatgggaggatcgcttgagcctgggaggttaaggctgcagagagacatcatcgcatcactgcactacagcctgggtgacagagcaaaactgtgtctcaaaaaaaaaaaaaaaaggtggggggaatcaaacatattcctctccaccaattctcctacactgggttctagctgccatttatagaagagcccttaagggctttacagttttcctcttctgcctgtgaatggcaatgtggtcaagagggaagcttttaaaattcaagagtagacagctagcaggctggagcccagtcctggcttccagctttctggaatggtaaaatcctaggcaagtccctgtctcccttaggggcctttgctttttcctccacatgagagggctggactagctgttcaagcatccttcggcttgactgtcctactgcatcattctacgcagtcacccagtcctactgctttctaagtccaaagcagcagaaagactcctttcagcagagccccgggcttggggctttgggatcagacagaggtccatcaccaatgaacagtagccttttttagaagaaaaaaaatggaagactcaggcttcctgcctaaggagggctggacagagaagaaaggtgctaaattacagaatggggaaattaggaaatggcctggaagaggactaaggctcctgctgaggtccttgctcagactcacccctatccataagtctgagacaaagttgcctttacaaagcagacattgaacagctgacaatacctaagttctcttggaagacaatctgtctactgcaaatcaagcattctctacctgggtgctatgagggccttcagatcaacaaaacaaatgtcttcctcaagatggcaatcctgggccccctccacctggaagccacatctggcaggacctgcacagtgttgaccactgccacacaaactttgcttgcacagccttcctaggaaggcagagaaatacccattctgtggtcaagtcctagtgttttatgataggaagttttcccaggtccttactcctgacctaattccccctgcctctcctaccaccagcaccccacccctgaccttaaggctctgaactagggaagtgtggaattcagtctataattcttctagaccccacagccctgcagtgaagcagctaccacacaccttcatgctaggttgcgccccctctccttcagtctgccagtcatccagccctagttcacctccgctcagctcacaaccctccgtataaagctcaatgtccagatactcacaacataggtactcacagcttgcttcagtttcttggagtctctgtgataacgttaatatataagccaattttctgaaatctctcaaatccacaggcccctgaccactgtcccttattaagtcggagcatgttaacactgggccacataaacataggcttccagccaggaaagactggatcaaggaagcaataccctagatccccatgaaagcaccattttacccttctaaaataggctttctggccgggcgtggtggctcacacctgtaatcccagcactttgggaggccaaggctggcagatcacttgaggtcaggagtttgagaccagcctggccaacacggcaaaactccgtctctactaaaaatacacaaactagccaggcatggtggcaggcgcctgtaatcccagctactcaggaggctaaggtgggagaatcagttgaaacctgggaggtgggggttgcagtgagctgagatcacaccaccgtactccagcctgggcaacacagtgagactctgtctctaataataataataataataataggctttccaagcttagctagctcagaactctgagttcaacaatgaccttaacctaccatgattaaaatcttcaggattgcggaggcaaggtgcaaagtggagggaaagggaagaggtagggtattaagaggaatgtggactcaagctgcttttctatgatctacccaagaaaataccttcagcctgggaaagaagtacccctaagagtaagatctgggcaaggctgtaggaagtgtgagcccagactgtgccaacctcctcaatcctagctcccctcattctccccggctagactgattctctagccctaccccccagtactcctcagaacaggctgccactccaatgccagccatgccccactgccttgtgtgactgcaccaaagctcattcagcttaattctcctgctagctgtaatattctttagagaaagaactatgtcttaactctgaattctagcttagggctgtgtaccacgtacaattaataaatttttaaatgaatgaactaataaaaccaaccaactaatcaatccaactaaaaagggtattaataatgtcaccacagaacctagaccatttgatgcttaacacctcacagtagtccagagtgtccaagatggggtgtgtatacaagatgattataagtggtatatggacaaactttttttaagtttttaatacttttatattacttaatgtatagaagaacaaagccagctactaacctcattattaccaatctcactgattagatcaatactaaagaagttacgttttttgtatgcttttagtattgttttatagcaggtagaagtttaaggagaggcggggcttggtggctcatgcctgtaattccaacaatctgagaggccaagacaggaagatcgcttgagctcaggagtttgagaccagcctgggcaacatggcaaaacccccatctctacaaaaaataaaaaacagccaggcgtggtggcacacagctgtaggcctggctactttcgacactgaggtgggaagctcacttgagcctagcaggaggtcaaggctgcagtgggccatgatcatgccactgcacgccacagcctgggtgacagagtgagaccttgtctcaaaaaaaaaaaagtttaagataaaatgggatatttgtgtaacctcaaagtatctctcccagagtatttattaattacaaaggtagaaataacctcacggtggagaaatggacacatatcaccttaatcaagtgatcaacgttaacaccacaggcaataaagacataatgacaccacgtaccccgataccatgtgctgagaagggcatttcacctctgtggtgctcttcccaaatccatgaccttgatctaattatgagaaaacatgaagtaaacccaacctaagggatattctacaaaatacctgaccagtactcctgaaaagggccagggtcatgaaagacaaggacagactgaggaattgtcacagattagaggagactaaggagacgcagcaactaaatgcaacatgggatcctggatttgatcctggaatagaaaaaggagtttcgtaagaaaaactggtgaaatcccagtaagtctatatcaatatcaattttagttttgatcattgtactgtagttacacaagattaggagaatttgtactgccattgcaacttttctctaagtctaaaattatttaaaagtaaaaagtttttaaaagccaaatttaaagataagtaaataaaagtatatacaatacatggttacaggaaaaaatcataaaggtaggtaagactgactcaagtttgggaagcactaaagtatttaccctacacccaagaaaagtcgcccccagaatgagaatcactgctgttgaagaatatttagtaaaatagggaaatgttcactttatattacttgggggtaaaattaataaatcatccctttctgttaaaaaatatatatatcacatatattacccatagaaaacagtctgtgttaaaataaaaataacctatgctaaacaaagcacagatgacatttattaaatagtaaatgggatatggcttttggaaagtaacttatcaattaaaatgctcacagactttgactcagtagcctcactcagggagaatatcctaagagaaaattcctaagtatgcagaataaatgtctgtttccagcactatttttaataattttaagaattagaaacaatctccatatcagtcattcctagattagtatttttttaaaccgcaacccaataaagaatgttttacattgtaatctagcatatgcatgtgtgagagggtgtgtgtgtatgtgcatgtgtgtaaaaaactgaaccaaaaaggtttctcaaaacaacactatctttactgtatgtgatgctctctgctattttcaatcctaatctatgttattaagaaattaagaaaacgaagtacatagagccccactaaactgatttcctgacccaataatggattatggcccttggtctgaaaaactgcactagatggactattgtgcagccattgtaagagatgactatggctgggtgcagcggctcacatctgtaatcccagcactttgggaggccaaggtaggtggatcacttgaggtcaggagttcgagaccagcctggccaacacggtgaaaccccatctataccaaaaatacaaaaattagccaggcatgatggcgcatgccttaattccagctacttaggaggccgaggcatgagaactgcttgaaccaggaggcagaggttgcagtgagctgagatcgtgttactgcattccagcctgggcaacagagcgagactctgcctcaaaaaaaaaaaaaaattaattaattaatttaatttaatttaaatttaaaaaatttaaaagaaactactataaaccacaaactggtagcagcaatttgttctaaggagaaaagagggtgggaggaaaacttgcttttcactgtatatctttttgtaccttttgaatttataacacgttttttatttaaaaattaactagctggctcacaccagtaatcccagcactttggaaggccaaggtgggaggatctcttgagaccaggagttcaagaccagcctgggcaacatagagaccttgtctctaccaaaaataaaaaaaaaaaattagcacaagcctgtagtccccgctacacaggaggttgaagtaggaggatcacattagcctaggagatagaggctgcagtgaacagtgatcacgtcactgcactctagcccaggagacagagagagatcctgtctcaaaaaaaaaaagaactaactttaaatggcaattacgaagactttattagcatgggagacaacgctaattatgcataataaagctataactacattaaaatgtaaagacatatgcaagtgaaaaaaatttataccaagcaataatcatgttagcaatttttttcctttttactaaattctacatattctacactgctgctattgtagatttgttttgttttgttttgtttttgaaacaaggtctggctctatcgcccaggctggagtggagtggcaagatcttggctcactgcaacctctgcctcccaggctcaagcaattctcccacctcagcttcccgagtagctgggactacaagtgtgcaccaccacaccctgctaatttttttattttttgtagacagggggttttgccatgttgcccaggctggtctcaaacttgtgaactattttctaccattcaacatacatttattttcttaaattaaatcaattactggtaaggacacaggagattttaaagttaatagtagcattttctttcttaagctaggtggtgggtcacttaaactatacatataaaaatagacattctacatattttaaataatttctcaattttttccaactttactgagttatgattgacaaaagttctatatactaaagatgtacagcatgataattagatatactaatacactgtgaaacaactatcacaaacaaattaacacattcattaccatacacagttaccattttgtgtatgtggtggggagaggtgaggacacttaagacttactctcttggcaaatttcaagtaaacaatacagtattaactatagtcactatgctgtacattagattcccaggatttatcttataactgaacgtttagcaacatttttttaaagaaaagatttcaaaagtggactctttcctgcaaccttccgctttgacctcggactcacggagccactccaacaaggtactgagataggatttaaaactgtcagtcaactggatactttccacctctgtgaagagaatctaacgtggactgtaccatccccatggcttctaaaggtttccctttcgaactctgcaggtgggctagtttcggcattccattcacactcaggactgttcttttgtttttcctcctttccctaccaagctattgttcattcccttacatttttaattacatataatctcttctagcatattcatctttgaatttccagcaggctgtaatgcagtactttctttgtacatagcaagtgctcaaaaaatatttcttaatcaatatcataggcaaaactccagaaaagaatatataaaaagtggcaaggactcagagaaggaagtattgatccctggagattaagtacaaatcgcatcaagagacatcattacttttagttaatgaggttactatataattattgtagggaataaaatagataatacatgtaaaacactcagcaatagctagtaagtgatccataaataacagattggggacttaaaaagtaatatccatacatatttacacaatatatatttgtatataatatatatatcataaatgaatacacacatatgcacatacatatggcaaagaatgtcagggacataatttatctggacttcagaaaaatctctcttgatctttaaagaaaaaaaaatcagagatgcaccggcagctggatggactggtaactcaggacagctgggtccaaacagtgctatgaaatgaatctgcatcaaccaggaagaggagctctggaactcctagaagtttaggcacatcccatctgtttttatcacatttattgatttgcatatgttgagccatctgatatggtttggctgtgtcaccacccaaatctcatcttgaattgtagttcccataatccccaggtgtcatgggaaggatccaatgggaagtgattaggtcatgggggccatttcccccacgctgttttcatgatagtgagtgaggctcatgagatctgatagttttataagctcctggcatttcccctgcttacactcattctctctcctgccaccctgtgaagaggtgccttccaccatgattctaagtttcctgaggcctcccagacatgtggaactgtgagtcaattaaacttctttctcatataaattacccagtcttgggcagttctttatagcagcatgagaatggactaatacacaatccttgcatcccagggataaatcccacttgatcatggtacatgaaccctttttttcctttttttgtgacttgaggccactgctcattcttcttcttcttctttttttttttttttttgagatggagtcttgctttgtcgcccaggctggagtgcagtggcgtgatctcagctcactgcaacctccgcctcccgggttcaagcgattctcctgcttcaggctccccagtagctgggactacaggtgcccaccaccacgcccggctaattttttgtattttcagtagaggtggggtttcaccgtgttagccaggatggtctcgatctcctgaccttgtgatctgcccaactaggcctcccaaagtgctgggattacaggcgtgagccaccatgcctggcctctttttttttttttaagttcaggggtgcatatgcaggtttgttatacaggtagacttgtgtcatgggggcttgttgtacagattatttgatcacccaggtattaagcctagtactcattagtatttttcctgatcctctccctcctcccacccttcaccctcaagtaggccttggtgcctgttcttctcctctatgtgtccatgtgtactcaatgtttagctcccatttataagtgagaacatgcggtatttggttttctgctcctgcattagtttgctaaggatagtggcctccagctccatccatgttcctgcaaaggacatgatttcattctttttttatggctgcatagtattccatgctgtatatgtacattttctttaaccagtctactgcgatgggcatttaggttgattccatgtctttgctattgtgaatagtgttgcaatgaacatacatgtgcttgtatctttataatcaaacaaaatttttttttttttttggagacagagtcttactctgtcacccagtctggaatgcagtggcacaatctcggcttgctgcagccaccacctctcagattcaagcaattctcctgcctcagcctccgagtagctaggactacaggcgcacacctccacacccagctatttttttttttttttttgtatttttagtagagacacggtttcgccatgttggccaggctggtctcgaactcctgacctcaagtgatctgcctgcctcggcctcctgaagtgctggaattacaggcatgagccactgcacccagcatcttataatcaaatcatttatattcctttgggtatatacccagtaatgggattgctgggtggaatggtatttctgtttttaggtctttgaggtatcgcaacactgtcttccacaatggttgaactaatttacactcccaccaacactacataaacattcctttttctccacaaccttaccagcacctatacttttttggctttttaataacagccattctgactggtgtgagatggtatctcattgtggttttgatttgcatttctctaatgatcagtgatgttgagctttttttcatatgcttgttggccacatgtatgtcttcttttgaaaagtgtctgttcatgtcctttgcccactttttaaaaatgggttttttttttcttgtaaatttgtttaagttacttatagatgctggatactggacctttgtcttattagactcagtgtgctgttgaattctatttgctagtattctgttaaggatttttgcatctatgttcatcagggatgttgccctgtaatattcctttctcttcccatttattctagatctcatcatggttaccctttttatcaatgacttggataagacacaattatcaaatatgtttatgataaattaattgggagggataatgaatatactagatataatcagagagaaaagcctccacaaactggaaccataggttaaatacggcaagatgaaatttttaaagggtaaaatatgtaattttacactgaagcttagaaaaatactgcaagacaacaggataaagatggttattagtgaaaaagacctgaggaaaggttcaatatgagtcaactgatgagcaaatgtgattttgagtttagctgacaaaacacagggcccagatcaaatgagattcatgtcctactctgctccattctggttagaacaaaagtgtttccaggggacatatattatatttgcagtcccggggtaaatggagtcttgaataacatttcagacaaatatattgaaagaaaaaaaggaaatcaagtcttttggagccccttaaactgagaagataacacgtctgattcatgaggttgtaagttctcctgcagaacaagaagatagaaaactaccgcttttatccccacggagtcatctctggggaataaagaacgctcacagaaagaagagacagctgggccctgcctgacctgccctttgtccctcctgctagtcacatcaaaacctcccagctggggctctgaccatccgagctttatcaaggatatagagcagctcaggaatccaaacaattctgacccatcatctccccaaaccatggttcactacaagcagaatcacagtgatatttttaactatcagagtgaattcttgtggatctttaacctcctatactaagctgtcatctgatagctgttgtgagcaaggactcaggcttaaatgctgtaaccgaaacattagatggtaggaatgcagcatttcagcttcttcagggattgctgggatatagacataccagcttatctcctgtaaaggaaccctatgatgcttcttctaaggatctggggagagagaagagcagtggccattcaacatccggttcttatcctaggaacatggaaggcggccctgatctacagatgagtcatactaaataaacgtcaacatcctacaggagaagatgccattttttaaactatcttctttttccccaaggttaagaacttagaagttcctaatctatgcaatgattagctccttatctaacaagacatgcactgggcccatcctatgtttctgcggaagagagctagtttgcctttgtgtaaaaagaggtccttatgaatgttcattcacttagagatcaacattgaacaacctgtgtgatagagaaatcaattagaccccacgattcaaggaagggaagatgagggagatgatgaaaggaaaagcagaggaatgtggagggaacggggagagtagaaagcaatttaagatcttgaaggacagaaacaggaggaagcttgtttggaagtctcagagtggcaaatttgggggaattcctgagcattactcccagggatgtcagggaacatacttgagcaccacttagccttttgaatttgcaggaaagaaagaattcagaaagcctttattccctccctgtctggggctccttaccctggggtgatacatctgcctacaccccacttagctggttggctgagctgtgaacgactgagaggaggaaggcagagtgaaaagaacaaagggtcaaggactactgtcccccgcacagctagtgccagcagaacactcccttcttacaaggccatgggactccagaggctaaaactggtagatgctagctcatctcaaacccgagcagataaaggaagtcaacgatttcacagttctcctgaaggtgatgaaagattatagccactcatctccaatgcagacagcctctgccatcagtaatgcatgacacagctcttctaaggtaaaggcccagaggagatgaagaaggggtgcatactctgggaaaatttggcaagatgaggcttgactctctctgcgtgctcccaagacagttaccaagttaccactgctttgtcacagagggtccaagacccagagagatgcgagagttgtcagaggcttagagacttatgtggttgggatttgggggcttgaagtgttttttgttttgttgttgttttagtaaataagactgtctcagcaagcttctgaagggtgaaccctgtacctctgttttatccaagatggctaggaagagagacagctcaacgacatctgacttcaccttatgctctgagggttgggagagaatgggatagactttccaaataaaataacaatttgccagccacaaacttccttcctctactatccaggtaatccatttcctccttaaatccctattgcaccagactggaggtggggagggggaacgggggtggactgtggcaatgttgtgtggaggagacagggacaaaaatgtgagacatggacccaactgctggctatggaacttgggatggaccccaaggccaaggccattcagactaaactaagagcaccatgaagtttactaccttgagaacctcttgagttctcaaggaagagagctgttcctgcctacagtggctggggcagagatctaaagcaagtaaaggaccagacagacgctgagaacctagaaggagcacacaaagcctaattcagcctcatgaccttgacttcctcttccagaagtgcctggacacagagcagtgcaccttcaacagcacaactcggccgttaaggctgcaccaaaattcattcaggagcccagccctgggcaaagcaaagcctcctgccccccaggatgcagcacttctctggtttgtcttcaggggctccaatgcagctgtatctgcggggaagctgggggtcaggacgcagaccacaagaacccactctgtgaggggtcactgctttcaaggacaccaaaggggaccctcatctctgcgttcctttcttccaccatgatccctctctgcttcctctcctgccatgtggggtggtgagaatggggacaagcagggcggaccgagcactcttttaataggaaacaaggactcggaggtgaccagctgcagaggtgagcaaagctccagaaggactccagcttctgacccggatggctgagtgccaccaccatttcagggaacactgaccaaacagaagattccacgctgctttgctgcggtcatgtctgagtttacccaagaggggaagctgctccaacagaggaagttaattagaccagacaagagcggggagcagaggtggaagacagggatgagacaagaaactgtggaggacaaaaagtaagatgaaaggaaggagggaggcagggaagggaggagaaagtgtgtgtgtgtggggtgtgtgtgtgggtgtgtgtgtggtgtgcatgtgtgtggtgtgtgtgtagtatgtgtggagtgtgttgtgcgtgtgtgtgtatggtgtgtttgtgtgtggtgtgtgtggtgtggtgtgtatggtgtgtttgtgtgtgtggtgtgggtatgtggtgtgcttttgtgcatgtggtgtgtgtgcatatgtgtggtgtgtgtgtggtgtgtagtatgtgtggtgtgtgtggtgtttgtgtgtgtggtatgtgtgtgcatgtgcatgtgcagcatatgttgtaagaggaggtgggagaggagtgggtgacacatcagagccgtcactgcaatgctgagcccctggctgtggtgatgactggccacagcgcaattcagcagtggtgtctttgcagtcagcttccgtggtcagcacaaggcaaaaatcatgtggagtcaagttatcttgaaaattcccttagaaaggcaccacactggagacccgccagtctccggggagccccattcagtactattcatatacattatttttgtgcactcctatgaatctgagaactagaaggacccaaggagtccatcttccttctctgtggttctcaaaaacaattctgaggagctgaaccattgatatggtctgaatgcttctgagtaagtttctctcagctctcagagattggtttatcacctaatgttatccagccagacggacttcctgcgaagcccacactctcttccatgctgctgttgtcttaaaattgtcttaggagggagaggcctatatcacgggtcccgccccaccactaaatagctgtgtgtgctgggaacagtcgcttcccctttcgtccccaatctccccttctataaaacagagccagactagatgaactctaagagcccagacaatgctctgctgaatgaaaaagtgctttgaaaagtccaagtacttcacaaacagaacgtgtcagtattggttagctctcacaggtcagaaacgttggtgtcttccgtcttgcccctcaagttcatccttcatgtcagtcctgcctcatctactctggaatattctctaggactcgcccccttcctctctcctgttgctgacctgccaggtcctttagcaggcctcctcactgcctttctctggcctctccaaaattatcctattttcatcgatctacaggagagatttccacaaaactccaccttcactgcatcacttcacatcacctatgtaatggcaggacttccagagctcaggtccctggctctgctctgccacacctacccctccaaggtagatcatcgccgtgacactggagtgaacatctctcctttccttataaagttgacccaactttaaagaccagaaaaatcctgcctcctccaaggaaagttttctgtggttttaagatacaactttcttgttctgaactataaatgtatccatggttcgtaaaccaacacagttaagatcttggatattctctacttgtttaacaaacactgtctctcccaatagcttataaattccctcaggtcagaaaataagctttatttaatatttgcatcacaatgtcagtggagctgaaaattcagcgagggctgcattgccttactgcctgatggtggaaagaaagatctttgttatctctccagcccttgacaactcacagggaatgttggggtacagaggaaggagagaagaggtggaattaataccctcccaactcctaaagtatcttcccgcctgttcctccctgctttcacccactctggtgggggaaagagcccccatcacaggctccaatccacctattctctgaggctgagcctgagcccatcagaacagcatgcagacagctctatttagctccattcttcatgttctgatccgcccgtgtgatagcaacagctgctcacagtgcctgacagtagtgggaagataaaaggaagaaagagacacataagaaagaaaagccaagaccagtagtcatcttctaatatatatttcatacctgggccctggagggaaatctgcttcaaattaagccccatctgttctcaagcccccaaagaggcagagcacccatgagaagggctctataccctgccagggcacagacaccagtgaagattggcagctgcaaagaaggatggcatccttgaggaagccaacaaactgggaggtggagcccctggctgaccagcccattcttagactcagagcctctgccccacaacacatgaccccaagacctccctgataggtaagaatcacataagtatgtaatgggtgtaaaatggggaggattgtcaggagatcggcccaattcccagaggaaagcattcctggccatcacacccaaggtactcagcaatgcaagcataacctagcatgcctaaacccaccttccccactactcctggcttctggccactcgggagcaaatacacctctgcaaaagtcccagcttttgtgctccccacagccagcccccaccatcgtctctccagatcttctcctgtttataagatgcattcactcctaatctccacttccagacacacacacacacccttgggtagacacagggcaataagcctacctctcaggctcaacttctgggctgcacacagtggggtggcttgctcccgtaatcccagcacgttgggaggctgaggcaagaggactgtttgagcccaggagttcaagagcagcccgagcaacacagcaagaccctgtctccataaaaaaaagatggaaaaattaaattctgtaggattcactccctaaataattaaaaatttaaacttaaattttaaaaaaccaggcttaacttctacccagtgtgtgttcatgctcccttgggccctttctgcttgcaggagctgatgatgctgggtgcactctgaaagattttaaacctggtaaggatggtaatgccttcaggggccagaggatgccttcacaaaccattcagagtgtcaacagagccagactggggagacgtccagttataccaagaccaagaggcagattctctcatctgcctctaagctccttcctcacaaaaggtatctgccacacccatctccagtgccaaagatggatcacagccgactgagccgactgtctctcctcctacccctcacccccgccttccagagtgacagcgagacaggaaagcaagttggaaaatttttaaaagaaccaacacctcggccaggcacagtggctcacgcctgtaatcccagcactattggaagccgaggtgggcggatcacaaggtcaagagatcaagaccatcctggccaacacggtgaaaccccgtctctagtacaaaatacaaaaattagctgggcatggtggtgcacacttgtagtcccagctactcgggaggttgaggcaggagaattgcttggaccggggaggcggaggttgctgtgggccgagattgtgccattgcactccagcctggcaacagagcgagactctgtctccaaaaaaaaaaaaaaaaaaaagaaccaacacctcatcacaatccatgaaaagctagctcctggctctaggactgcaagaaaagggaattccaccttcaaactcctggttaccttccatggctggtctcagtggaactagcattcctcctcacagaggcatgaggcagccacaccccacacagccccagagcccagaggcagagttgggcagaaaggaatgcagatagtttcccagaagtgtctggccgagaaggaaaccaagagcttacccacagcttcctgggccctgactgggaggcactgggttctcacaacaaggattctggcaattcagggatggtgaggcccttgtatgtgaaagcccacaggaggcgaggacacagtggtgggaagaggccctgacagaacaagcctgggctggccccagacggcttccagtaagcagcggctgcacttgaatgtcagcaagggtcttagggagacccgaagcaatccagtcacaggggagcccaaggcaggcacgcagatgtgaggtcggatcctcttagcataggctttggcgtcacctgctttccaggaagcaggcttcattttctaacacatcttgagggaggagggcaaaccggaggggaagcccaacatctgacaggccagcaaagctggtgagcagatgggctctaatgcctcccagcttgattctctcagtcatgcttcagaggtcataaggctttttttagtcctactgttagtaccacagctcccagaagcctgtgcttcctccaaattatgaccctgtaaggctctgttctaggataagcacaggagaaggagcagaacacagaaagagttattaaagatgccttcctgttatatactaagtgtccacgtgaaggatatcaaaataaaataataaaataattttaatttaaaagtggattacatcattaactgtttcctttgcaaggaaagggcaattcctaatacagattccataaaatccagatgacacttccccttctcatatacgacctggactctgaaaaccttaatcagttgctagcattaatacaaaatacacacagagacacatatagacacacgtctgttcttcaaagctttgttcgggaagccaaagatacaagaacccttccaacttcatgtccctatggggataacaggaggcacagagttaaatatggtttttcccaagcaaagaccttggctgcgaataggattaagggtggctctggacacccccacatgcaggaagaaggctaagcacctggaatctccccttcctccacagcaccagtaaatgaactgatgtcatctctctggtagccaaacatgtctgtctcccagcccctaggatttcacccatccttacctcaaaattgcataataagggtctgcagctggttagttcagttactcacagcctggtgccagtgaagcaaaggtaaaaagttggctacttagagccattagtttcaccttaccctgtggccacagattttaactgtttaaacctagatcaaaatgcatgctgcttttttcagagagacaagaccaaagatgaactcaaaaagagcatccctgggcaccacagaaagaaggacaaagataaaatcagctgtgactgtacttctttggaacgggatgacacatgctgatccccaagcaagaacatctggataagctttcccaccctcacaggaaattttcagtcacctggaacctagtacagtttggaaagtcattctattttcctgaactgttcattccacaaggagatgctgcagtttacacacagtgcactgggacatcttcagttttcatagattagcagcatatgcgtcctacaggaaaggtctgtagctttaaattagacgctttccatcctaagacctgatacagcattgcaacaagaatgtattatttccttgtcaaaaatcagaggagataactccactaaccccactaaacagtaagtttaaagaatgcgatcctgtcataattacatcatgattttcaaagtgggagaatttcattgggttttaagctcaagtttttcccagtgtgacacacagtgcgaaaaagaaaagagcttaggcaaagttaggcatggcacattccagctcctctagccgagactgaagaaaacagacctagctttcctgacctgctcccggaagcccttggaagcacttttcttcctcttcatgcaatgggaacagagtcagtctcttctagagcaacttcaccagcaggggccagagggtgaacagactgtgttttcactaaaagctcctttttcaggcagtcgccctttataggttgaagacagttttccacagaaacaacaccagacatggtagccagatgcgcagacaagctcattaatgaacaacatggctgaaatactgtttatacataataaagacacaaaacaatacctctgtaaatactagcaataaaacaaaatgtaagaggaataaaattatatcatttttggccaggcacggtggctcacacctgtaatctcatcactttgggaggccaaggtgggcggatcaattgagcccaggaattcaagaccagcctgggcaacatggcaaaacctatctctacaaaaatacaaaaattagccgggcatggcggtgtgtgcctgtggtcccagctactcgggaggctgaagtgggagaattgcttgagcccagagggtggaggctgcagtgagctgagatcgcgccaccacactctagcctgggcaacacagcaagactctgtctccaaacaaacaaataaataataatttttacgtgtttcaaattgtggtcctggaagaagggcaggttaattaaaagatggatatctggggggaatctttaaaagcattctcaagaacaatagtgatggcactgatacttcaaaccgtctactttcattcccaaatgtctgactgtcctttcagaagtattcttggtttcacactttaccagctatgatcaaagctagcttttatcccacaggcaaaaaggaaaggggataaggagggttttttgggaggcaattaagcaaaatcataaggacagaaagagaaggaaagatggggattaaagaggatgtgagtaggatctgaagaacacttacctgagggagacctaaattacctgtgattggtgagagatatagaagccagctggttcatgactactgagaatcggagtgccagggaggacgcactggatattatgtgacagataccagttggatcacctgcctaggacaacttaagatcaaagaatgggggaaaataccaaatgccagacacaggctcacaactcttatccagccccagatcaaactattacttcaaccagacatcgttggcattcgcaaggaacacgtctacagagcctacggggaatgctcactgcctgttctcctgagctggctggctgagtaccgatctatctaaagaaaataaactaccccagagttctatgtcacctagctctaacagtctcaggaaagtaggaggcatcctcatcggggatgtaggtcacagtggagttagggcttatggaatacataaaaacatggtgaatatagggccggggatggtgactcatgcctgtaatcccagcactttgggaggccgaggttggtggatcaggaggtcagaatttggagaccagcctggctaacacagtgaaaccccgtctctactaaaaatacaaaaaaaaaaaaaaaattgcaaaataacagagaagtcctacttgaaagtatacagaatcaattatggagctcttctgcccagaaatattctacttagctccacaactttctctagcaagtttcagcagcctgagagcctcccagggttgggcacagcaacagtgagcatgggtcctcatcctcatcactaaccctgcaaagacaagcatccttctgtacttcttttttttttttttttttttttttctgagacggagtcttgctctgtcgcccaggctggagtgcagtggtgcaatctcagctcactgcaacctccgcctgccaggttcaaacgattctcctgtctcagcctcccaagtagctgtgattacaggcattcgccaccatacccggctaatttttgtatttttagttgagatgaagtttcaccatgttggccagcctggtctcaaactcctgacctcatgatccacccgcctcagcctcccaaagtgctggattataggtgtgacccaccgcgcccggctactttgttgtttttgagacagggtctcactctgtcacccaggctggagtgcagtggcacgatctcagctcactgcagtctcgacctccctgggctcaggtggtcctcccacttcagcctcccgagtggatgggactacaggcacacaccaccacacctggctaattttcgtatttcttatagagctggggtttcaccatgttgcccagactggtctggaactcctgggatcaagtgatctgtctgtcttagcctcccgaagtgctgggattacaggcgtgggccaccatgcccggccctcagtacttctttaggagaatttctgcccgacaaaggaccacagaacagcaaaatactttggagattgtctttgtccaactcattctgtactggaagaagccaatgcaaatctttaactggaacaaaaaaaaaagtctaaactatgcaagatctgattaaatctcagtcatttcagaagggtacagggataaggaagaaatgtagctctgtctgagtaagtgtatttggggaggagggatggggattacataggcagaagttaaaccattttgtttcttcttcaaaggcctgcctctcaggaacaccaagaggacacctactcagttgtttccctttatttttctttttgagatggagtctcgctctgttgtccaggctggagtgcagtggcacgacctgggctcaccacaacctccacctcccaggttcaagtgattctcctgcctcagcctcctgagtagctgggaatacaggcgcccgccaccatgcccggctaatttttgtatttttagtagagatggggtgtcattctgttggccaggctggtctcgaactcctgaccttgtgatctgcccacctcagcctccgaaagtgctgggattacaggcgtgagtcaccacatccagccgtttccctttatttcttagttcttgatgatagggtcccccaaataccctccccttccttgctggaaccaaatcataccaccctcagggtacaagaatttgaacatagccatgaacagaaccaacaatcaataaatgtagagcttggacatgttagcaaacatcgaaggtctctggaagctacaacttccaaggaccaatctccgcatgatggagaaatcaaagccaggtgaagatctgggctgagtttcaaatattcctgagtttatgaaggaggtggaaggtgggaagaagaattctggaactgaacccgcagaaggctaagcctcccacatcccaagggtgacagcaaacacgtgtggacccacagcaagccgaggcatggacaggcagttatctccttaagttatcctcgtcagagaatttccatcagtttttcttaccacgttttatactttttcaaagtgactacatatattacttttatctgtttggagtcatctgagttcccttccagttccactaaggatgctcacactaatggttctctgcctcttgcctgtctagtctttcctggatctcccaggcttactctttagattcctatctcatacccacagagtcctgtcttcttcaccatgaaataagttcccctctaacaaaaggaaattcagacatacaaatgtgccttgcgcaagatcccaccacaaactagtaacactgcagggattagaatccaattctccgaactcacgtccaccgctccttccaactgaccacaacacctccgttataggagaaacatctgccctacagcaccacgaccaagaatcaaaacagtttactgcatgtctttttaagcaaaacaacacagccagaatgtttggcagggactaactaaatatttcctctgtgacctatgccagagaggaaaactgtgggagttgggtaggcacagcacagagggaaatcgaagagaccactgcaaaggccagcagatgggtgacaaaagaggaaaaatgcaatcctaaactgaggacaagctgggaacaaaggaatccgagttttaaaagtggttgagatctaaagataggattgtaggtctaaatgggaatgttatctaagagggaaagcatttacggaaaacttaggaggactatcttcatgaccttggggcgggaaaggaattcttaaaggacacaaaaagtgctcaccaacacaaagcttgatcaaaaggatatggagctaaaatctcagagcaacatagaagcaatgaccattcttaggcctacaacacagatgtatgctgaagcaacataacacaggaatccaagcctactcccagcaccaaggtctgaactgaaacctggcttagaaaaaaagcccaaaggcaaaacattaactttccagtgaagaaaaaaggaggaagagagaaagagaatggatactaatttggcctaacagaagctagaataaagcttgcaacatgataaggtacacaggaatctatgagaatgagatggaagccctgggaaaccaggagcatcatcagtggaatcagaaggaaattcaagggacccgaacaaggatctttgccgggggaactgaagaagtcactgtatggaactagatccactgatttaaaaaacaaaaggtaaaaacctacctgaattatccaagaaagaaactctccaaagggtgtgaaatctgtgaaaagagtggaaaggttgttaccaccaagtaaaattcacttacactttccaataacctttaagaaagggcttcaaataggatcccttaattgtattagaggctctgatattgacactgttcaactgaacaagaaaggtgggcggggagttccacagaagagcaaaggggtctgaggccagctttctacccatgctcagggcaacaggctttccctcacttctgaggtgaccacaccagcaaactgggccaccagtggtccccctccccagtgacccctcctgtcctctcacaagcattacatacagagtggggaagagggaaggaaaaaacctggagctcttaacctcaaagggtttccattctactcaaagtgccaggacacacattcctaaggtccagaacccttgcatcaacacctcagctcaagaagcacccaggagcagaccagactctgggttgggaacactgttttgttaggaaggagtgctgataactacagcagagacaggagaatgagaaaaggactaagagaacccaggggaagggaatttcaggagacagatgaattgcttcctgattatgaactgatccacttactggacagtctatgagacaaggagttaagctaaggggagttttggggttttttttcaaggcagctcttccccaggtggaaaaattgagagcacagacaaaaggaaggagtgacctccctggaagcagggaaatcccccgcccaatgcctcatttgtaatcaagggcagcgagaatgagactaatgtaaacaggccagggaagccagcatgcccttctccagagaggccaacacacacacttcccccagcacagcccctggaaaggcagaagtaggtattctcttggacaaaagagaggggacttggggagttcccaaggtgctttcaggcttttctgttcccaggcactcagcattcaccaaaattccagggcaccaagaccacaaaaaaggtgaagctaagattctgctgcttggaggaaaatgcagtttgcaaaaagaccccacaagaaaggctcagaagaaaataatagggctgaacggcaggaccactcccacatctgagcacctaggcctgagtcgggcaagcttcccacacccctcccagcaccaacgcaatgaacagctgccctggagaaaacaatggggcctttgtctgtgccttctcctgtagatctctttttggagaaccaaacaggataattcctttacaagaggggctctcctaaatatcagtcccggccaagatgaaagtttttaccatccacagcatccctctcaagtaagactcctacccgttccatattgggcaggaagggtgctgtgcagtatccagccccaccccacataggaagcactggcagacaggtccttgcagccccttcctgcagccctcaccagtcacacacaggagctgctactcctgctttcttcctggcctggccacggaactgaaagcctaagaactgttctcactccccttttgccatccaccagaatattccatattgagtgaaattacaatgcttgttgatactgttttcatcaaaatctgtcaaaatggactcccaacagtaactgtgattttaaaagaaaaaggcatgaaacaagctggacagtcaaacttctcttaatgttgcactactaaataaaaattcccaaactgacaaatatcaagaaacttacgctgtcattttccatgattcaaacatcttaaatctaacctaactatataatagacaagtggaaggttctttctttgctgtcttattagcccattttcttgacttgtttttaatttatttattattttgatttgcaaatgtctcttcttatatgttgtgaagatgataatagatttgaggtttttgtttttagtccctttgcctaaaaaaaaaatttaaaatttttcctatattggtccaaattaagaaacaaacaaacaaacaaacaaaacgtgtgtttttgtgaagccaggtgcctcacgcctgtaatcccagcactctgggagaccaagcttggaggatcgcttgagctcaggagttcgagaccagcctgagcagcatagtgggacctcatctctacaaaaaaaatctaaatatttaaaaaactatccaggcatggtggcacacacctgtattcccagctactcaggaggctgaggcaggaggattgcttgagcctgggcggtcgaggctgcagtgagttatgactgtaccactgcactccagcctaggtgacagagtaaggccatgtctcaaaataaaagaaaaacgtgttttgtaaaatcccatatgccacatttctcccattttccttcattgggtaactggtagcagatgaattcaggacccacttcttccgaaccaccaccatggactacatgacatggcacaaaattccctttccatgaaacggaaacagtctgagcaactcctgatgtctctctcctcgattcctctattctaaccatcattcttcctctccccaaacacctccagatcaagggtacttgggttttcaggccagttagctggataccatgagttccccagttcaatccagagtatcccccattctccacgatttcagcacaaggcggcatcacaaagtagtagaaagaaatctgcaatcaaatgaaccaaagttcaaatcctggatcttcagtgatttacataatttctctgagtcatgatttcctcctctctgagacaatccgttcacgaaagtatcaagttgtgaacggcacatagtaggtccccggtgctgactcattacttccttgacaggtttctctcctgtcctcccaaaaaagataggctttttagagacttttttaaaaacagggagctggaaatactgatattaagaagacattgttccacaaggaatcaaagtcgtgcagtgtcccttaccttgctgtgctggtcacattccgatgactgccctcaatttctttccagcctctcttaggaaaggcccagaacatctatttaatggtataaacctccatttctccctctcaagagtctggagttatgaattattaggtggctcagggttctctaagggtaaggctttcagtgtcatcctggaaaatattaaaatgtggaaaaaccactcatcccaccacctcgtgtttctgtgtggtatcgactcgaccctttatggtttccttttggagtgcattcaatctgccctgcgcaaacaccacatcaggtctctatcactgtgctaaacaaatgttccaaatgggaaaaaaattgtcataaatattttttgggactgctcacagtcttatttcactgcacttatttcaagtctttcacttatttaaagtcttatttcacttatttcatgatggagacatcatgaaagacaaagaattccctgtaattccctgtaccagaaaagtgtcacacgtgctacctttcctgagaccaaagagtttatacagttaaattctttacagtaagggtgatttcgtaaatgcatacattcagtttgatttaatgtttaggactctgtaaaggcttctcatgtaagcaaattcaaaaatcaggacaaaaatcctgtactggcctaaggatctcaaattttggctccaaaattagagttgctcttcttttctctcttttttttttgaaatgcagtctcactctgtcacccaggctggagtgcagtggcgcgatctcggctcactgcaacatccgcctcccgggttcaagcaattctcctgcctcagcctcctgaggggctgggattacaggcaagtgccaccacgcctggctaatttttgtattttttgtagagacggggtttcaccatgttggtctcgaactcctgacctcaggtgattcgcccacctcggcctcccaaagtgcagggattacaggcgcgagccaccgtgcccggccggagtcactcgtcttaataacaagctaaaggccctaattgagcatgtggccaatgtggaaccttaggctgcagcactaagcccaatcagcccattgctactaagtacaaaacctgcaagaggaacagactctcagtgggcctcaatttcttcctctagcagaatgtaaataagaatctctgcatttgtaaaaatgtccagaagattactaagatggaaaacagtcactgggaaggaagcaccccttcaggggtcattcttggcctcacttgctcatgcctggcccttggcaacagctacctccacagatctccagccccaccaccgcctctcctttccaagccctcctctcatacggaatacacaaatcctgtcacaaataatacgctgtctggctgccgtaaatcaccatcctgctcatgccacccctgtgctttcccccaaggttgatcctgatattctctacctccagaccctttgcacacaccactccctcttcccagaatggcttccctcctctgtttgctaagccaactccaacagtccctcaagatgccgctcccacggcacctcctttggttgctttctctggccatgggcttcccttgcatcttctcctcaacattctttgctttcctctggtcaaacatctgtatcatactccattgtaaatgtctgtttatcttatgtgccctaaaagaatgttatattaccctccttacatttaatatttaaatttttgcatcacaaccagtagtaaagacgtactttctgccatattctaaatattggcattttataaatatttacaggcctggcacagtggtgcatgcctgtaatcccagcacttgaggaggctgaggtgggagaatggcttgagctcaggagttcaagaccagcctaggcaacatagtgaaacctcagctccacaaaaaaatcgaaaagttagccaagtgtggtggtgcatgcctacagtcccagctacttgggaggctaggtgggaggatggcttgagcccgggagatcgaggctgcagtgagccatgattgcaccactgtattccagcctgggtgacagagcagaactctgtctcgacaaaaatgttttattaaaaataaataaatatttacatttttaaattaaatacaacattactctcttaaatgaatctaaatgatccaatggactctaaatgccatagtggatcatctatttaaaagaacatacattttatactatgcctttttgttaactcttacttccttttatttcgttttcagaattttatcctaatatttatgcttcaaaatcttttactgatcaacctatacttctctgcaatatatatattagtattatacatatatacatataaatgcataaatttttaaattctgctatgattataacctcaattttttattctatttattttatttttttttagagacagggtcttgctgtatcacccaagctggagtgcagtggcataatcatagctcactgcagcctcaaactcctgagctcaagcaatcctcctgcttcagcctcccaagcagctagaactacagatgcccaccacattgctcagctaattctttctattttttatttttgtaggaacagagtcttgctttgttgcccaggctggtttcgaattactggcctcaagtgatcctcctgcctcggctttccaaagtgttcagattacaggtgtgagccaccacatccaggctataacttgtaaatgttaaaaaaaaaattcttcttctggattgggttttcattatctttattgtttgaatatgcaaatgatcaaaacataattggtttagaaattggtactattattaaacataaaaagtaaaattttattcaaaatgcattaatttttcatttttatagtggtaagcaccaagaaaccttgttcacataaataactaaacagaagtgacagtctacagccatactaccctgaatgtgccatctcgtctgatctcaaaagctaagcagggtcaggccccgttagtacttgaatgggagaagtaaaataaattttgctatagcaatatcagtatctttagaatcacaagtcaaaatcatgtcatgacctataatcaaaaattatttttaattatctaccaactgacaatgccttcaattttgttgaaagcaagaattggaaaccatctgacttagaaaaggatttgctactcacagtcattcactttcctaataatagtcctaattgttcctttgcttgttaatctggaggctttcacacatcaggcacacaaacagcaagactccagattaataatgactatgtcttccttttgtaaagtgggagaagagtgattgagaaaggaaacaccttgagtgcaactgaattctcagacagatcagcctttggaaaggggacatagaaagtcaaggatctagaaaatataccctgtctgaagactactagcttatctgcctctcccaccaaaacagtggcattatcaaaattaacattaaattatgtttattcgtggataattactgttatattttaacagaaagagactgaagacagcctaaatgtgctcaataaaggtctgattaaataaattacagagtgtctagaaaccaaaaatacacggtttctcttcaggactgaatcaagtcccttcagaatcagggcccacactttattcccacagcctcagctcctacaagcccttcgaaggtcctcatgtgcatcattccccactgcaagtaatggtttctagatgggaaaccatggtccacagagcaacacagacagggacgtgccagaggacataaggacagtaagacctaaagtgtactgctgaggcttgttatgaacactcatggaattgcaacctggaagcctatgtctggggaaagggagaggggacagtgtctatgctaagagaacaagtagcaaggagccagaagaaggctgagtgtggtatgaaggaataaatactcaagaagctggtaaggctggtgacattggaaggaagatcccccaacaggctgctggccctagaggtcagggcgctatctatccttggaagaagacaagtggaggacagtatcatccgaaccaaagcagcgcccaggctgaagggcccactgggcagacactccaagagaaggctcatggtcatcacaatggggaggaggggagaagaggagtgagccaagacgcggctgcttgcggacagggcagaacctacagatgggaacaaatgaacctggtttcataaaacagcttccctcctctgtgccccagagtagtcctcccagttaaagtcccctttctcgttctcttcaccaagtcaaatcctgccaacctgccaagggccaagatgatgccccttgttctccatgcagcctcctcaaacacttctgcttatagtcagttcttctacctctaaaccctcatcattctctgtttataccagaggcggcctgcaatatttctaaaccgctccatgatccatttgtattttgatattaatccttagctctttgctgtaggtgtttgatgcctctctgaagataaggcttgtgacttagacatgttcctgtcccacagggtgacccctcaatgctttactgtgcgggacacctacttgcttacagttccaatggacacacactgtctcctgccactcatccaaatgtctatctctttcacaaaattaaaggttcattatatacatgtggattctgaattcttgggtctttcatagtctttggcttagggcttcacacttgctaaccactcagtgaaacttctccagagtcagtcattcagctgctgctctacctgaggctgtagcaccaatgagccagctctccagagacacgcccacatggtacaaaccacgttctagtggagagcattctcccatcatgggaggctctcccttcaagctaatcttaacaagaatgaaatgggaatttggaatttcgtttcccttatacaaagtcacttcctaaaatggggggattataattaggtgatcattaattacactcgccattacaaaattcaaaatacctcaattcctttaccttttataacgaacataaagtgggatctcaatagtatatttaaaagaatttctcacaaatctcagtaaatacaatacaaataaaatagtttgaaactatgaaagaaagatcagtaaacagagaagaatgaatatataggaaaagggtataagcagtcaaagaaaacaaagcttaacgatagaaaagaaaagaaaagctaatccctgtaatggaatgccttcctcacagcaagctctcaatatttgtcatcaaatttacagaatggctgatattgattctcaaggcaatgaaacagactacgcaagtgctggctgcaaaagaaacagaaacgtaaggtccatactaaatgaactgatgaatgcaataaaaacagaagtgatgctacagaaaaaactaatcagaaaaagatataaaatacaaaaatatatttttcaataaaagattcaaagcatgcacaagatgacaagcacaagaaggaatgcagctcagagaactatcccgcaaatgatcaaagtctttgaacaaatggcctcaaatctataaagtttaatagaaaaaaatgctatctaaaaacaacagaaggatttgctctgagtacaaaagatgtacaaaatcatcaaccagagactaccactatgacattctcatatttttaagcataagaaaaagaaaaaactcagcaggctgagaagacccaaatccaaatttcttccaattttgcaaaggatacaattaaagtccagagatgcatataaaactctcagagaaagtatttttacctccagtgtaacaaggtgagtagactctttgagcaagtgaaaaagaaatatctcttagagctttgatcatacctgaagaaatttacccatcacacacttcactttaaattatgtccaagaacaactgtaaatgagacttaaatgttttaagttttacaaataagaccaaagaacccaaatcaataatttcccattaaaaataataataaaatgttaaatagggaaagagcaattgtcaaaaacacattattaataaaataggactgcaggcacgtgccaccatgcccagcatttaaataccagacaacattgagacaactgaggacatttaaatatgacctgaataacagatgatattaaggaattattgttagtttggttaaatgtgagagagtggttatagatttttaaagttcttatcaaatatgcttcccgaaatattattgggtaaataacataatgtccaggaatggaggagaaagataaaattggcaaaatgttaataatatttgaagcagattaagaatatatggagttcattatacagatgggaacaatggctatcattattcataatagccaagatactgaatcagttctcctgacttttgtgcatattttgaaataagaagttttttaaattaatatttattgggtatctactgagtaccaggtattgcttaggtatttgacacaaaaataaaatggcctcaagaaaaaaaaaacagtaaagcagattcttaacccagggtttatccagggaaatatccatgatttctatgggtggctaaatcacaggtactgccattactgctgttttattgcctatattcataataaaaaagaaatactaaatttcaatcggggtggatgaaaatgatgtaattttttttttcctatccaagttgcagacccttcaaattctacccatggacccccaagggttgcaccattctgcaaatattcactgaacacttaaaataagacagtcactgctaagcactagggatacaaaggtgaagagaatactacaggccgggcgcggtggctcacacctgtaatcccagcactttgggaggccaaggtgggtggatagcctgaggtaaggagttcaacaccagcctgaccaacgtggtgaaaccccgtctctactaaaaacacaaaaatttgccaggtgtggtggcagatggctgtaatcccagctactcaggaggctgaggcatgagaatcacctgaacctgggaggtggaggttgccatgagccgagatcacaccattgcattccagcctgggcgacagagctagactgtctcaaaaaaaaaaaaaaaaaaaaaaacagacagaaagactgaagagactgataaggccaggcatggtggctcatatctgtaatcccagcactttgggaggccaaggtgggcagatcacttgaggtcaggagtttgaaaccagtctggccacatggtgaaactccatcactactaaagatacaaaaattagccaggtgtggtggcaggcacctgtaatcccagctactcaggcggctgaggcaggagaattgcttgaatccaagaggcagaggttgcagtgagctgagatcgccccactgtactccagcctgggtgacagagggagtctccatctcaaaaaaaaaaagaaaagaaaagaccaataaggctgggtgctgtggttcatgcctgtaattccaacactttgggaggccaaggcaggtggatcacttgagcccaggagttcaagaccagcctgggcaacaaggtgaaaccccgtctctagaaaaaatacaaaaattagccaggtgtggtggtacatgcccataatcccagctactcaggaggctgaggtgggaggatcacttgagccaaggaggtcaaggctgcagtgagctgtgatcgtgccacctcactctggcttggaggacagagggatacccagtcacacacacacacacaaaaactgataaatttcacattaaattactaaaaatttttgtatgtggaaaacaaagttaaaagacaaactgtgaaaaacatatgtagtatatatgagttgttcttaatattttaaaagttggtaaaatgcattaaataaaatataaaactgcttgatctgataaggggttaatacccaaaatatataaggaatcaacacaatagtaagaaaacaacttatttaaaaatgggcaaaggacctgaacagacgtttttcagaagaagatatacaaatggccaacaggtatatgaaaaaatgttcaacatcactaatcatcagggaaatgcaaattaaaactacaccgagataacacctcacacctattagaatggctaccaccaaaacgacaaaagataataagtgttggagaggatgtggaggttgacgggaatataaagtggtacagccattctggaaaacagcatggagatttctcaacaaattaaaaatagaactatcatatgatccagcaatctcactactgagcatatatccaaaggatatgaaatcagtatgtcaaagagctatctgcacttccatgttcattgcagcattattcataatagccaagatatggagtcaacctgagtgtctatcaacagataaataaaaaaagaaaatgtggtttatatacacacaatggaatactattcagctataaaaaaagaaggaaatcttgtcacttcctacaacatggatgaacctgaggacactatgttaaatgaaacaagccaggcacagaaagagaaacaccacatgatctcacttatatgccgaatctagaaaagttgaactcatagaaacagagggtaaaataaccattttaccagaggctaggggatgaagggattggggtgatgttggtcaaagaacacaaaatttcagagagataggaggaataaataagttcaagagatctactgcacatcatggcaactatagttaataacaatacatcacatacttgaaaattactaatagtgtagattttaactgttctcaccctcaaaaaaacataggtatgtaaggtaatgtatgttaatgagcatgacttagtcattctaaatatatatatatataaatcaaaacagcacattgtacatcataaatatatacaattatttgtcaatttaaaaataaaataacaaaaacatgtaaatcataaaagaaatagaaattaaacggccattaaatatatgagaaaatattcaagctccatagcaatccaagaaatggaaattaaaacagaaatgcaataccatttttatcttatcagatttgcaaataccgattatcttcattctttttagtttggcaagaatggctggaaacaggcactctcgctcacgctagtagaagtgtacagtgtacacaggttaaagactttctggagggcaatttggctaagcacatcaaaagtccttaaaaatgttcatcccttttacttctaggaatccccaaaataatcaaggaactgcactaaaatatgggtataaggatattcaccatagcatttctgtaatagtttaaatacatagggggggacaaactaaacaataacaggagattaaagtagatcaaatatttagtattttgtgaatattttttaattcgttttaaagtattcatatatattttggtatatatataaacactaattatctctgtgtagtaggattgtgggtgatctttttcctattttccaatttttctagaaagaccatgaattacttgtatgaaattcaactaactaattaggggggaaatgccccattatccctgggctcctgaaagcccaaagccaccagtagaggagaaaaacgttataggtataaaagcaactccctataacagttgttgcttctggagagcagagaaggccttgattctgcctggagctgagttttgaaggatgaatttgccaaagaataaagtgaggagggcaagagactatcaagtgcaaaaaatgaaagcgcctactatgttgacaagctacatgcaatttcggcgtggcagaagggcagggtgcaagtggaggactgaagtaaaagccagatcacaaagacttctgaatgtcacattaaagggtggaattatcctgtcaaagaagaatcaataaagagctttcgtggttcattaatatggggatcaaaaaaaggtaaaacaggccaggttcagtggcctataatcccaacactttgggaggccaaggcacaggaagatggcttgagaccaagagattgagaccagcctgggaaacatagcaagactttgtctttacaaaaatagtaaataaacaagtaaataagagaaaagaaaaaacaaatgataacagaagagtaattgggataggaatgtggatactgtctgggaagaggcatcaggtgaccttctgagatgccagaaatgctccacatcttgatcggagtggtagttataacaatgtatgcaaacgttgaaatccattaagctatacatttaaaatttgcgtactttactgtgttactcctcaataagaaagcaaagagcttttagcaaagaagtatcacaattaaactattctagaaagctcatttgttcagcagcctagaagactgaacaccctgaggcagcactctgagaaatgaaagctgcattctggcaaaagagggtcaagactttggctggattggaggcagcaagacagtaaggagaaggacgattcatgacacatttgggaggtgggcctgataagcttttatgagtgtgactgctaattaaacttcgtgattaaaattcatgtgaaaatctaaccccaaggtgatggtattaagaggtggggcctttgggaggtgattagatcaccagggctctgtcctcataagcaagattgctgtctttatgaaagaagcttcggccaggcgcggtggctcacgcctgtaatcccagcacttagggaggatgaggcgggtggatcacctgaggtcagaagttcgagaccggcctggccaacatggtaaaccccgtccctactaaaaatacaaaaattagccgggcgtggtggcacacacctgtaatcccagctactcgggaggctgaggcaggagaatctcttgaactcgggaggtggaggttgcagtgagctgagatcgcaccattgcactacagcctgggcgacaagagcacaaaactccatctcaaaaaacaaaaagaaaagaaaagaaagacgcttgagggagcctgttagcctccgctgccaagtgaggacacagccagaaggtcctacctatgaagagcaggccctctccaaacaccaaatcttgggctttccaggttccagaactgtgagcaatacatttttgttgttcacaaattacctggcctaaagtattttgttatagcatcctgaatggactaagactatggggaaatctgaatatggtctgagtattagttaaaataaaaagttactgaattagaaaagtgaacgtaattgaaaaataagatagaataaaaaacagtatatatagtataatcttactttggtagaaaaagaatataaatatgtacatctgtatgcgtagagaaagacctagaaaggagaggactaagatttttctctgggtgttgggaaagtgaggtttttatttttttagaatgtactgcaaagcaaacactatatttttaatttttttttttagagacaaggtctcactctgtcgctcaggctcaagtgcaatggcacaatcacagctcactgcagccttgaactcctgggctcaagcaatcctcccccctcagcctcctaaagtgctgggattacaggtgaatgccaccatgccccagttaatttttttttttttttttttttttttttttttgtagagacaggatctcactttgttgcctaggctggtattgaagtcctggcctcaagcaatcctcctgccttggcctcccaaagtgctgggattacaggtgtgaaccaccatgtctggccatatattacatttttaaaagaacctatttatttatgtatttatttatttatttgagacagggtcttgctctgttacccaggctagagtgcaacagcacaatctcagctcactgcaacctccacctcctgggttcaagcaattctcctgcctcagcctcccaagtagctgagattacaggcgtgcaccaccacgaccagctaatttttgtattttcactagagacagggtttcaccatgttggccaggctgatctcaaactcctgacctcaagtgatccacctgcgtcggcctcccaaagtgttgagattacagacatgagccacagtgcctggcctaaaagaaccaatttaaagttgaaagttggaaataatttctattctgtagttttctattaaaggagctcacagacacaaaaaaagcagcagccactgggtatgatggctcatgcctgtaattccaacactttgagagggcaaggtgggaggatcacttgagcccaggagttcaagaccagcctgggtaacatgacaagactctatctctataaattatttttctttttccagacagagtctcactctgccacccaggctggagtgcaaaggcatgatctcgactcactgcaacctcttccacccaggttcaaccgattctcatgccttagcctcctgggtagctgggattacaggcctgtgccaccacgcccagctaatttttgtatttttagtagagatgggttttgccatgttggtcagactagtctcaaactcctggcctcaagtgatccgcctgcctcggcttctctacaaaaaaatttttttgaaaaaattagccaggcatagtggcccacatagtggtcctagctactcaagaggctgaggtggaaaagatcacttgagcccagaaggtcaaggctacagtgagctgtgttcacaccactgcattccagcctgggcaacagagggagactctgtctcaaaagaagaaaaagaaagaaaagaaaaaagaaaagaaaagggaagggagggggagggaagagtagagaagagagaaaagaaaagaagagaacagcaaacctcaaacgtgtagtgtacaagctggctccagatgccaagcaaggaggggaagactatctcgctcaggctggcaatctaaaggctcaataaagcactcctcttgggcgcccatcttatgttcctctcttttattctgagcagcagcctctctagatgacgggaaaatttagcctgatggatcatgatggatcatgctaaattttcccatcatctagagaggctgctcatctgcatcattcattctaagaaaacaagacaccaagcccctgccagcatccccacagtgagccaacggagcaggcagatgcaaagagcccgagaaataccaagtgctgtgcaccctgtatccacacagtaggcaaaagcaactttcataggaaggaggaaacagcacgccgagaaggctcttctttgggattacatggcaacagagattctcctggaagggtttctaactttagggcatcatcagggaagtgctgtcctgatggagctgcccaaacttaatacaaaggagctaattttcgtttgtctcaaatttaaagacagggattagggagaaggtgtaaagggcaaagggaagggcccaatccaaacagaataaggaaaggggatacattgctgctgactatactctcctctgggaggaatcccagcaaactagacagctgccagatctacctggtaaattccagtcaaccagctagagaattggagaactctctccaattcttgttcatcttcaaaactgtctgagcacccaacatatgttgcctgttacacataaacattcaacaactgaacacaaacataagtgaacaggctgaaccaactgaaggtttatggaccaagctgtataacgtttggggctaaaagagcttaacatgaaatagaatcaaatgttaatgttccattaataacatttgatgcaatatgatcaaaagactgaagctctagtacccagcacagtatctggtgtttaagaagtgctcctcaataaatatccattgaatgttaaatgatccaggatttttttcttgcatccaaaactttcagatccagtagaagatattatttaaaagtctgtgttctcacttttatgctgactttcaaagtgttttgttagagatggaaaaagatttctgggtatggaaaaatttttaaagtatcatacactgccaattcactggcctggtacaggctgtatcaatctgttctcatcagctctggttgaaaacatatgtggactacctgaatgggcctaggcttgagcacaacttatccgtccaaagcatttgtgggcccaggagacaggttttacttccactggtcacacgtgtccaaaaaaaaatgtgcaaggttggttggaagtccctggatgcctgactccccaaccactatattgggcagctcccctgatggaaaggcaggcccaggccctctctgggcagctgctcccattcatttccgtctgttccttcagtctctcctcactctatcactattttcttttttttttttttctttcttcagacaggtcttgactgtcacccaggctagagtgcagtggtgcaataatggctccctgcagccttgaactcctggtctcaagcaatcctcccacctcagcctcccgagtagctaggactacagatgtgtgccaccatgcccagctaattttttactttttgcagagacagggtctcaccatgtcacccaggctggtctagaactcctgggctcaagcaattctcctgcctcagtctgccaaagcactgggattacaggtatgagccactgcacttagccccatcactattttcacatcagtataatgttatcttgtatccctcctgtcctaacctggcccaggtttcttagaagaattatcatctggatactaaaatgtcatttatagccgcatacagaattaaggcaaaataccaggtctcctccttcttatccccaaactctattagaaagctgagtatacacatattgcctgataatttcatgtcatcttctccaaaaaccaccacaaatctctaaaaacagaaacagaaataactaaaatgatactaggcccttagcaataatacctggattgttacaagggcctcctaactcctcttagcttctagtttcctcctcaattccaatccattttctatactatccattctgtcaccatccctgtagagaaagacagaacaatagtcaaagcattttcacatgcctcccactcattccaaactcaaagtcttcaagatgacattcaagatcccagaggatctgattcagcctggtctgtctccgatgggctcctttataaacctgctgattccaatagaccacctatttccagcccatacaagccaacatcttttctgcctctgggcctttgctcatgctgcccctggttactccccaacccccagagtcctcctggattctgaaggcagcactgtgtagaagaaagggaactaaattaggagtcaaaacacctggatgccagacgtggttctgacatcaactggttgtgtgcctttgggcaggtcctacacctctctgggctcagtttcctgtctataaacagaaagattggactagttcaccctatagcccttccacctttaaaaaaaagtattcttcgattcctatatgctcgaccaaatccaatctctccttcaaagtctgcaggtcctccaagaaatttctctgagcacttcagcccacactattctgtcccctctgtgtggaatccagaacaaattacacagtgcattcattcaaccaagatttctgagcattttcttggccatgttatgatagcaaagccttggtaataaacataaaaccagttaggacccaggctgtagttatcacctgtacctccctttcctctccactatttttacccaagtgaagtcatgaacagcaaatgaatgcaaaagataccatttagtcatttatttaacaaatatttaaagaaaaccttccatgtcctattctaaaaagtaaagatatcagtaaacaaatggatcaagtccctaacttcatggagtttatttatttgggaaagcagacaggaaaaacacagaaatatgtaatataattttaggaagaaaaagaaaggaggggattaaagagtgactcggagcagttttacataggatgggcagagaaggcctccctgaggtggcacactcgagcccacactcaaatgaactgggtgacaaaccagcaatattcaaggagaagagcatcctaggagcaggcaaaggccatgagacagaagagatgggaggaaggcaggagcagatgggagagctggggcttagaccacacaagaacttggtagtaaatgtgcattgtacttctaagtgtgatagcattccatatgagggtaaaaaatatatatattctcattgctatgtggagaagagactgcaaagacaggagcagaggagccaggaccagctgaggatggctattctgaaccagtcgagggcttggctggtcacccaaactaggtcatttcctggctctccagcttataagctgtgtgagctcaagaaagtccatctcttgtctcagtttctacacctttaagcaaggataataaaaatacctatattataaggttgtctggaaggctagattagtgcacataaaacccttacaacagcctctggcagccagtaaacattccataaatgctagtacttcaaagccagggaatcacctaagaaaagtgaagacagagacaagaaacaggctgaagactgagcccttgggcgctccaaaagctccaaaggcctccatttggcccaagatttgccataagcctgcacgtcctaaaccttgtctggggctccaaaccccctgtatgtatcaataactcaaaatttagagcttgatgatgtactgctttatatcattctttaggtaacaattatatgttctaagttcaggttatcactttccctcagttgtattgtatatctactaccaggcttggcatagggttagataaacactaacgtgtttttttgtttgtttgtttgtttgtttgtttttttgagacagagtctccctctctcgcccaggctggagtgcagtggcgcgatctcggctcactgcaagctccgcctcccgggttcacgccattctcctgcctcagcctcccgagtagctgggactacaggcgcccgccatcgcgcccggctaattttttgtattttttagtagagacggggtttcaccatgttagccaggatggtctcaatctcctgacctcgtgatccacccgcctcggcctcccaaagtgctgggattacaggcgtgagccaccgcgcccggccacgtgttttgcaaatactcattcatggattatatcatgtatatttcaaagaaatcaatgtaaggcactatacttccttttaaaacaaagaaccatcttctcttcaaggaataatgtgaattataagttatatcctcagcactgccccactacccccactaccctatcagtcccatcttggcagagacaggcatgctgaccaaagaagttacaccatctgccatgccattttcccacctgacttcctgtccacatgctttgtgaacaaagttttctgtctcttctttcctggaaatttctcaagctgtaaaaacctcccatacctagcaacatgtcacacctgcccctgtccccagaattccccatggcccttaaaaaagcctaaacaatgaagccaaaatattcccagaaaaacaggagcatcaaaacttaggaagaaaagagggaaagaaaatgggcataacccaaataaacacctagagaatcatccagcagggttcttcccgccaaggtacaggaatctcagtgccttcaactagttactatgaatatttataaaatgaccttaggaagtcctagccagaacaatcaagcaagagaaagaaataaagggcatccaaattggaaaacaggaagtcaaactatctctgtttgctaatgatatgattgtacacttagaaaaccctaaaagatgcctagatcctccaaaagactcctagatttgataaattcagtaaagtctcaggttacaaaatcaacgtacacaaatcagtagcactgctatataccaacaaccaccaagatgagaatcaaatcaataactcaatcctttttaataccttcaaaaacaaataaaatacctagtaatatacttaactaagaaggtgaaagagcactacaaggagaactacaaaacgctgctgaaagaaaccacaggtgacacaaacaaatagaaatacaccccatgctcatgaaatcaaagaatcaatatcatgaaaatgagcatactacccaaagcaatctacagattcaatgcaattcctatccaaatactaacatcattttcgaaaatattagaaaaaacaattctaaaattcatatggaaccaaaaaggagcccaaatagccaaagcaatcctgagcaaaaagaagaaatctgtagacatcacgttacctgacttatactgcaaggctatagtaacaaaacagcaatggtactggtataaatgtagatacacagaccagtgaaacagaatagagaacccagaaataagccaaatacttacaaccaactaaccttcaacaaagcaaacaaaaacataaactgggaaaagataccctattcaataaatggtgctgggaaaactggctagccacacgcagaagaatgaaactggatccctatcactcaccatatacaaaaattaactcgagatggatcaaagatttagatctaagacatgaaaccataaaaattctaaaagaaaacttaggaaaaactcttctggacattgggtgagacaaagaatttatgactaagaccccaaaagcgaatgtaacaacaaaaataaataaataaatgggaactaattaaactaaaaggcttctgcacagcaaaagaaataaccattaaacagacaacccgcagaatgggagaaaatatttgcaaattatgcatctgacaaacaacaaatacctagaatctgcaaggaactcaaataattcagcaagaaaaaaacactcccatcaaaaaccgagcaaatgatatgaataaacatttctgaaaagaagatatacaaatagccacgaaatatatgaaaaaaatgctcaacataacaaatcatcagggagatgcaaattaaaaccacaatgaaatactctaccttactccagccagactagccattactaaaaagtcaaaaaacaatagatcttgacatggatgtggtgaaaagcaaatgcttatacactgctggtgggaatataaattagtacaacctctatggaaaacagtatggagatttctcaaataactaaaaatagatctaccattcaatccagcaattgcactactgggtatctactcaaaggatgagtcattatatcaaaaagatacttgcacaaatatgtttatcgcagcacaattcacaacagtaaagatacggaaccaacctaagtgcccatcaaccaatgagtgattaaaaaatgtggtatgtatacaccatggaatactactcagccataaaaaaagaatgaaataatgtcttttgcagcaacttggatggagctggaggccattattctaagtgaagtaacacaggaatgcaaaaccaaatactgtatgttctcacttataggtgggagctaagctatgggtatgcaaaggcatatcgagtggtataatggattatggagacacagaagggggaggaagggagggagggaggggagatgaagggttacaaagactacatattgggtaccatgtacactactcaggtgactggcacactaaaatttcagacacaattcatccatataatcaaaaaccacttgtaccacaaaagctattgaaataaaaaatacatatttttaaaatataataataatgaaacatttaaaaataaatacataaataaaatgacctcaagtgataagggtttccaacagaacaaaggtccaagtcagtgaggggaaaaagattaactttttcactctttttttttttttttttttttttttgagacagggtctcactctgtcatccaggctggaggtcagtgccacagtctcgactcactgcaatctcaacctcgggtgatcacctcaggtgatcctcccatctcagcctcctgagtagctaggaccacaggtgtgtgccactgtgcctggctaatttttctaatttttgtagagataggggtttaccatgttgcccaggctggtctcaaactcctgagctcaagagatccacctgccatgggctcccagagtgctgggattacaggtgagtgccacagtgcctggccaactttttcacttatttattcagtttccacagaactatctggtcttctgtttttcttccctgtcctacccacccatgctcccacacgcctagcctgggtgataagccgcagaaaataacgctgacccaccaggaccacagctcttgatgtggcttcaaccaagtctgagcctcatatcctgagatctaccccagccctccagggaccagaaatagtgacaaatacatgggaactatgtaggcgactcaaatgtagacagagctgggcacatcatactgctcccaaattggttttcttgaacaaacctaacctgaaatagacaaaggctgctagatgttattttgccaataccttttggcagagctatttctagctaattctgatcactgagctactcatggaggttttaaaaatggtccatctttaaacctaccattttgggaggcaaaagtgggaggattgcttgagcctgggagttcgagacctgtctgggcaacatagggggaccccgtctctaaaaataagtaagtaaattaattaattaaaaaaaattttaaatggccctctgaaacaagatataaagtggcctctacccacgccccatgactcttaacgccactttctttttttttttttttttgagaccgagtcttgctctgtcacccaggctggagtgcagtggcacgatctcggctcactgcaagctccacctctcagcctccccagcagctgggactacaggcacacgctgccacgcctggctaatttttttgtatttttagtagagaaggggtttcaccatattagccaggatggtctctatctcctgaccttgagatccgctcgcctcggcctcctaaagtgctgggattacaggcgtcagccactgcgcccggcctgcctcttacgccacttcctatgcaaacactgtggtcctgagtgctattctaattcaaaagagtgacctgtcaatgtacaaatgggggaaaaatagcaaaacggaatcctcacaactgatattgctgattaactggacaagaaggattcaattaatatactttgaccttaagtgccatttttccatgttaacccacagcaccaaatactcatttgcaagttgggttttctttatctccaggtatctatgtacagattcgagtgactactgaaaagtacaaagctttgattcccctcccatacaattatactattttcaagagaatttccattcccctgggacttggacccagtagaagaagccttttgggtctaagtacttagaatgcactcatccctggctcaagaggcaagaccagactttcaagaaaagcttctccaggcagtcctggagaaagacagctattgagtggcacttcctaattcaaggggatattatgctaactagagttcccggcaacagtaaatgtaatccaacatgactaatagaaaaaataactgactaggccctgtttactcactagaaaatatatccccacatgatgagccttaacagaggtcatctcagcttccagagaccagagtgttgtaaaaacagttgcttcccaacagcaatatttggatcaggaggtacccaacactcatatccaaaactaatttcccatccaatttcttttgttgttgttgttattttcactcaggggctcactctgttgctcaggctggagtgtagtgacacaatctcggctccctacagccttgacctcccaggatcaagcaatcctcccatctcagcccaccgtttagctgggaccacagacacgcaccgccacgctcggctaatttttgtatttttttcataaggacagagtctcactgtgttgcccaggcaggtctcaaactcctggcttcaagcaatcctcccaatttggcctcccaaagtgctgggattacaggtgttagccaccaggcctggcctccatctaatttcttaacttcatccactcattgattcatcaaacccctaacattaagcatattcactgaagaaaggtaataagagaataaacagatgcccgtacacaccccagtgctttttccgcaggagatattcaaaaactataggacacaagaaaggaaaagtatataaatgatagtgatacagagcacttcccagagaccagtgtctgacagtctcaggacactgactctgattaaaggcactttttaccccactctagttagccgcctccaaaaggaagaatggaacaagacggaaaaaatttaaaaaatctaaattcaaacttgtccttggctaaatttacatccaagatcccaacttcacatcaaagaaagaaaaaagccacccaaagtgacccctgcctactcaaaggagtttccaaaacattaacaaacagggacaaattcccagcatattctaattactatgaccttttatcattaagagtcccataaaaaggggcttatttctaatgctactaacaaagggttaagcagattatttctatcatatttgcatggagatcctaaattccagtttaaacaaatgattcccagacttctagataggccttaattgggctaatctgttacttttagtgcaatctcgcaaaggctggattcttcttaagcccttaaaggacttgagtaaaattcttttgatggtaatttttttaaaagatcatctccagagtttacatatattccacaattacttatgctgatagaaaaaaatatatatattttactccaaaaggctccttccagtttgaaagctctaattgccaacatatctgatatgaacttcctgcataaaacaaaacacaaagcaacaagtataatcataggtctaaaaagagagacttgttaaggaaaacagagaaagctcagcttgtttagccagaggaagggaaggaaaggatgggtacagatgggacagtctgtacatttggtagctgcctttggagtccaggaaagacaatttgttcactctgtgaacatgtgtgcattgaagagggacaggaaaacagtaaaagtaggaaacattaaaagaaaagctaactacaaggagataatctgtgatcatcaatctggaaaccttccttagaaagtgtttcccagggaaattgtgagatctctttaagagagattaaatctcttcagaaagatttaaggatatttggaggtggaggaggtcaaaatagtcaaagttctaccatactaggagattacatctgagtatcaaagggatattccagtcctggggaattgtccaaatgccatccccactaaaaaataatttagactatttttaaagaggatattgcagccctatttttctttttctttttttttcttttattttgagacggagtctcgctctgtcgcccaggctggagtgcagtggcgcgatctcggctcactgcaacctccgcctcccgggttcacgccattctcctgcctcagcctccccagcagctgggactacaggtgcccgccaccacgcccagctaattttttgtatttttagtagagacggggtttcaccgtgttagccaggatggtctcgacctcctgaccttgtgatccgcctgcctcggcctcccaaagtgctgggattacaggcgtgagccaccgcacccgacctgcagtcctatttttctaagctcttagctatcttagaaaacctaaatcacctgtttaataaattattaaaatgacaagtaccaaatacaaaaacattaactatgtaagcaatgcatcaaaaatgcaaccaaacatttctaacatttaaataagggcattgccaaagtctcttcttgaggccccaactctcaaaactaggttcaagagcattctcccgggaagacataccaaatgatccccaaccaacaatgagctttgccattctctggaggaatgaccacataacctataaccagaggctacagagaaaataaaatgactttcaggtgacacaaaatacaaactgggagaaggaaccaaggtgctaatcagggtgtgaccacctctatctggccctaagggattaccctgatctagaagaactaggaaaactgagctcagagatctctcaaacatcaaattccaggaacttctgaataaatggcaaagctggaactttaacccaggtttttgtactccaaatcccctacactaagaggggtcacattcctcagaggtccaaaacccaaactgagtcatatcctgacccatgtagaggtcctggtgataatttcacctatcaaaaccccattcagtaaggcaagctctccaaggtgtgagaggctcttaaaggtaaaaatgggtgtggagaaccgagatcatattttgatttcgcattttttatttgacaaaaaaccatgggtgactctaacattaattaaaagaaaacttctttagttgacaaacatcacttttctgcctgtcaagctgcccctccttagtgagccctcctgctaggggatattccttggccaaacaaccaagtctccagagcactagcaagttcagaggaaacggcgtacaggttgcacaagaaatagcaagaaatccagattgtattcaaagcggcagactaattctagtaaaatgtctccacccactgctgcccttcctgagcccattatctgccgagaatcaaagggcctggctataaatgtgggtgtccaatgtccttataagctccataagctgtatacatgaacaatacgattaactggtaagaaatgtggaggggtaggaagacctttgcacatctctaaatcctggctttcctatcccttctaaatccccacgcaggaactctacaaaggcctcctgtttttcctccataacacaaagtgaaataaatgtatattttatgttaatctttctcataattaagaaaggtaatctaaattcacttttaccttactagtaccaagttttaaaattcagctttttttttttttttttttttttgagacagggtctcactctgtcactcaggctgcagtgcagtggcatgatcatggcttactgcagcctcaacctcctgggctcaagtgatcgatcctcccaccttagcctcctgaatagttgggaccacaggcacatgccaacatgcatgattaatttttgtattttttgtagagacagggtttcaccatgttgcccaggctggtctccaactcctgagctcaagcaatctgcctgcctctgcctcccaaaatgctgggattacaggtgtgagccacagcacctggccaaaattcagcatttttaagaaataagagaatatgagaggaaaaggcacatcaacttacctaagatgtttagggcgaggaaaagcttttaaacaaattacaacattgatctacctctcagggtagtcatgaaagaaaaaaccaaagcattgcgaaacatgggggaacataaaggacaaaccagcagtggcattgatccacatacacattccatttcagcgtatgcctggtaagattcagctcttttctgatccagagcagccccgtggtcactccaactagctctttacccagtgaaccaagctactcgctgcagggtacagtaagtgagacaggaattgaaacacccagatatcctggctacatttcctttttgaacctcctcattaggaattatgacttgcacatgacttgtgatgagcatgtcacattcctgtacatagatgtcaccttaatcttctaaaatcactgctttacccatagctccttttctcaaaaatctttaaaacctaaacaatgtctacaggataaagttccagcccttgagccagaattcaacctgaccacagttcggcttccactggacctcccactgctctttggagaaggcagctgtgaaagcacccatgttagtctgagagccaggcattggaattccagctctgccactttaccacttgtgtcatcccaagccagttacgtatctttttgatcttgtctttttaaaaacaagaattccctcatctttaaaacaagagcaacaatacctatgtcacaacactgaaggatgaaagagagagctggcaggtggcatagagcagatgctattacttttctctctaggtccagtccaaatggtctgctctccattctcttgaaagctttccccagcaactctccaccagtttcagaagcatactttgcttcaaggctctcccctcttctatgaaaccgccctgcctcagaatcattttctccttgagctttataattcttagattctaagccaagtttgtccaacctgcggcccatgggccgcccaggacggctctgagtgtggcccaacacaaattcgtaaacttttaaaaatattatgattttttatgcgatttattttaagctcatcagctatccttagagtcagtgtattttacatgcggccccaggcgattcttcttccagtgtgaccccgggaagccaaaagattggacattcctgttctaagccaattgatctgaaattatccttcactcaaatgtcacttctctttccccaaggagtccacaaactcaagaccaaggatttccctaattaccaagccaatccaatctaagcgttcagtaaaaaaatacttttaaggtaagagttgccttggagttgtctaccaaaatgggtgcccttctggcccaattaggggataacatttcccatacatacacttgaacaatttttcttccccctatcttggggagtttttccaaaggtaatatttgccagatagcctgggcccagtggctcacgcctgtaattccagcactttgggaggcccaggcgggtggatcacctcaaatcaggactttgagaccagcctggccaacatggggaaccccatctctactaaaaatacaaaaattagccagacgtagtggcaggcgcctataatcccagctactcgggaggctgaggcaggagaattgcttgaacccaggaggcgggggttgcagtgagccgagattgcgccactgcactccagggacagagagagactccgtctcgaaaaaaaaaaagaaaaaaattttttaaataaaaaatatatgccagataaataaaaaggagggttacatctatgttagtcacctaggaactctctgccagaccagcagaatttaagaagccttcacttcatgcattcaacaggctcttcttgagttctggccttgtgcggtccttaattcagcaagggagataggctgtgaacaattcagtctctatcttggattagctttctggaccccagattacgtctaaccttttagaaacccctaattctggcaaaaaaaaatcaattaagggattcaccttctgaaaaatattaaaacaaaacaatgcagccctttgggttttaaccctgtggccccatcccaaaatggccagttgcagtgtgtgcagctaagaggtagctgaaaacagtcttgcagatgggataatgacctctttgccattcccaagaccctgctatccaaacagcagaaacacctggttggtaataaaagcaagagctggactaaggctgtactaaggcaaattttctcacttaatgaagaagttattttattcatattaatcatcaactactttcatataaagatcccaggaaaatgcaataagccctctttagaaacacttgaaaacattgtctcttgaactctactcagttactaaattattggataacgtgccataaacgttgactagagtgtggaccctttaatacttagtgcgtgtctgcacaagggcaaaaagtgaaccatccacaaataaacatagtttaacttgttgcagtaatagcatgcaaagttaattttcctttgtttgagttccgtgtgtctgtgtgtgttgtgcgtgtgtatgtgtgtgtgtgtgtgcgcgcgcgcgcgcgcgttcttcaaggagcctgcatacaagctgcaacagctccaggtaggagctcgaatgccgccaccgagaggcaaggcggtgcgcagagccagctcccaggacgtcccgagatcgggtctccgctcggcaccaggcagctcttcaccgccggactctggccgcgaggttccccacccccaaccgcgcggcccccgccgggccggaaagcagagccggcggctactgaccgcccgggagggcggaccccaccagccccgctcctctgcgcctgcggcggcccccacgcgcgtactcacggagctggacaccgctgccggggccgggagtcgggagcagagggaaaagggctgggagggcaggggcgggaccgggcgcgcacgcgggaaccggggccacccggcccggaggcgcttacctctgcgttccccagccgggccgggcgcggcgcctggatggggtctcgccgggagccgcgcggcccggaggaggagccgctcctgcagagagggcgggcggcgggcaggcatccgcgccccgggctgcggccgggctgcagggagagagaggggagggagcgcagatttgagtggagggggcgtggaggatgtgcgcctccacccaagacagagagggtgggctgctggagcccggcggaggggagcgctcggaggcgccggaggcagcgagaaagccgcgccgagagtgtgcgagggagggtgggggacaggggtgagggaggcgggggccgggggcagcagggaggagaagttggcccccaaactggacggccctcacctcctcaccatccgaccaagagttgtctgggtctggagcaaagcacaacggggtctgaaactttatgtcattttctcatacacacgtgacccccctggagtccagatggtttcaatcactggaggaaaaaagcggctcttctggtatgcgtgaaaagccggagctgggagagtctgggaaaagctgcctgcaccgcccgccggccttcaaacaaaccgatgagctctttcccttctcccagttctcgggcctcgggggagccctacaaaacccaaatgaaattcaaagaagctacttttggtactgcagcagcagcagaactcccaaagcactagggttccaaggagcctggtctcaaccgaaagctccaaaagggattctgaaattttactttaaatactccactggtttgcaaaaacaaaaactagaaaagggtgccatttaataataaagcaatggaataacagcactgagaatctgtgatttattagtggaatttgaaggaaatcattagcccagtataacaatcaacttggaaaagaaaaatgtaaattacttaagatccaaacccatacttagtgagatgttaggaaatcgtgtaatccattttttactcacgtaaatcactgtaaataaaatttgataatagaaatgcacaacagcagcaatgaaaattgacttttgaagtttcagttttacattgactttacaaatttacatttctaaggaaccagtgtgtatgaacataagcaggctccaaggccaggacatgttccaaaatccaagccagttcaattgtcacatatcctaaagaggtatttactcagctgcagggcaagcatcaaaaataatgagtttaagatacatcctgaggccgggcgcggtggctcaggcctgtaatcccagcactttggaggccaaggtgggcggatcacttcaggtcaagagttcaagaccagcctggccaacatggtgaaaccccatctctactaaaaatacgaaagttagcaggagtggtggcaggcgcctgtaatctcagctactagggagccttgaggcaggagaatcccttgaacccaggaggcagagattgcagtaagccaagatcgcaccactgcattccagcctgggcaacagagtgagactccgtctaaaaaaaaaaaaaaaaagaaaaaaaaagatacatcctggaaataatttaacttggtcaagatcgaacacaagtaatggcaagaaccaaactgataaagtctactgttcctttgccaaaaaaggatattacacaggaattactagtattaactctttgtctccaaaatactgaggccaaaggacagtttggcctttctagcagaaggccttatatgcggtgtgatgcagtctgcgcatgaaaaataaatcaattcctcgttgagttgcttctacattaggaaagcccaagatttcagctgttgttgaggcacattgaaaacacaaaggccaaaaatcagcacaggttttactccaaaaatcagaacagttttactttaatcagaacaagtttttctccaaactcacaatctaagtgagtttctactctagttcactgaagtgcttgaacacctcaggagacctgggccatatttggatgaacttagccctctccagtcttttccaatctctccaatctcaaattaggatggttctgccccaaacgtggaacaagagaactcatgaatgtaaaggcaagccacagaatttagccagcctccaggtaaattctacctgcagctctctgagctctgtaaggaggttcttaagtctcccactttcaaaactattagaacctctactactaaagtcccgtttttcttgtaacatctctaaggaaagacaactcaacagacagcatcaagattttctctaatcagacccaggacaataattattttcatcattggcagctgctgctgctgcctcttatatgtgctgaagcaatgtaagagggcaataattagatataaatacttgttctttttgttggccaattccattgtaagttatgcatggaactgttttaattcttaggaaaaaaacttcattagatctgctctctcagaaagaaaagttaacatcccttaaattgtctaaatatagtctaaatatagccttgagtctaaacttcatatatgtgactattagttcatcttaatactggccaaatatttattagagacactgacatcagaaatggtgttaatgctatattttaaatagtagtaatttagtaatttgcgttaacgtaatgttcacatcacttgacaaacaaggtcgactatgtataagagatggcaagctctttgaggacagcaacctagcctgtcttgctaataattacatcctatctgcctagcacagtgcccagcatgaaataagcgcacagtaaatatatgctgtctgaataaatgaaagataaataaaaacactcctcataaggttacaatcctgttgtagagacatgtgacttataaacaacagaatgaaatcgccatggaaggatactagcaacaaaaaagaggaagggatcattagcattagccagctttggactttaatcacagcatatattgagaaatgtgcagagactgctgaaaataggaagcgcttgtaggaggaatttggtaaatttactgcctaatttaggggtctgagatatactttcccatgttccattattcagtcccatcaacacagagccaagacaagatttgagcataaacatcctggctctaatttggatagttatgaatactgttcctttcatcctctctcatacgtctcctccacccgcaagccatttcctctgtacggtcttctgtcagtctaatgaaagtttcctaatctttagaagcagtagctttggttctctttgtgcagagaagtacaatatgccctgattacatggttatattccatacagatgcctggcaacacatcttgtagctaagggtctgtttaatattttaaccttgagagccttataattcaactactttgttatataccaaaatagaacttgacatcacaaagatgagctttacttccttttgctattttaaatcctgcacttaagcatggtgagttgtctgggttttctggttcatggattttgctttggcatgttttgttttttcctttgaaggacagaagggttaagattttctaggaagattttcaggtttgcaggtctagcactcacgaaacaatgatttcttcctaggtactctgcctgtaatattatatgtattcattaaaggggcagtgagggttgggttcagtggctcattcctataatgccattattttgggaagtcaaggcaggaggacctcttgagctcacgagtttgagaccagcctgagcaacatagtgagaccccagtctttaaaaaaaaaaaaaaattagctgagcatggtggtttatgtacacctctagtcccagctactcaagacattgaggtgggaggattgcttgagcccaggaggtcctggctccagtgaattatgattgcaccactgcacttcagcctgggcggcaaagtgagaccctgtctcaaagaaaaggtattggggctgtggggccttatttatgcttcatgatccaaacaaccagttttctctaaagcagacaactgggaaaggtggttagcctagatgactttaagtgttctaggccgggcgccgtggctcatgccagtaatcccagcactttgggaggccgaggagggcagatcacaaggtcaggagatggagaccatcctggctaagacggtgaaacctcgtctctactaaagatacaaaaaattagccgggcgtggtggtgggcacctgtagtcccagctacttgggaggctgaggcaggagaatggcgtgaatccaggaggcagagcttgcagtgagcccagatcgcgccactgcactccagcctgggctacagagtgagactcagtctcaaagaaaaaaaaaaaaaactactaaattttctaaattgcactgagtaggaagcccagaaaccaaaatttgcatgcaaaaatttttgacactgtgatttttttttttaattttactattcttattttttttgagaaagagtctctgttgcccaggctggagtgcagtggcacaatcagagctcactgcagcctcccaccttagcctccccagtggctgggactacaagcacataccacaacacatggctaatcttttaaaatagagatttttaaaaatctctattctatagagataggagtctcactgtgttgcccaggctggtctcaaactcctggcttcaagtgatcctcccacttcagcctcccaaagtgctgggattatagacataagccaccacacctagctgacattttgacctaaaaaaaattttttatatgtaggtaagatatacaccaggtaaaaacttcagaaacagtttaaaaatatataaatgatccccaatatatggtggttcaacttacaatcttttgactttaccatggtgcaaaaccaatattccttcagtagaaagcatacgttgagtccccatacagcattctgtttttcagtttcggtacagtattcaataaattacatgagatattcaacactttattattttatttagatctacacagaattaaaggagaaaaataaatgtagtactcctggttaatatcattaacataagttacagggttattaatcaagatcttaagagaagaattaagatatactataggccgggcatggtggctcatacctgtaatcctagcactttgataggctgagacaggaggatcgtttgagcccaagagttcaagaccagcctgggcaacatagcaagaccccatctctatattatactaaagtacatatatatactttaatcttgtcaagctggtaaatctcatttggatttcaagtattactgaggttttaatataaaattaaaaataaattattcattttcttaaaatatataaggaataagtaaactgaattgtgttacttatgtcttttttatagtagattatatttcctgccttggataccatgcagtgccttttgttccctccctactaagtgtacagaagacaggatacatccaatcaaagttctctttctatatcagctcacaaaaaggttcactccaatccatttatttgattttatcctgctatgttgtttggggttttgttccagatagcaagctgtctaatactcatttagataaagtacaggggctcatgcctgtaatcccagcactttgggaggccaaggtgggcctatcacctgaggtcaggagttcaagaccagcctggccaacatggtgaaaccccgtctcttctaaaaaatacaaaaattagccaagcatggtagcgagcacctgtaatcccagctacttgggaagctaagacagggagaattgcttgaactccggaggcagaggttgcagtgagccaagattgtgccactgcacatcagcctgggcgacagagcaagattccgtctcaaaaaaaaaaaaaaagaaagaaagaaaagaaaagaaagtaataaggcagcttgactgctgatgctgggcaggctggatctgagagtaaatgagaggagatgtcaggtggcctttagacggacaggagacaagctcagaaaggctcatccaacctggatggtcccctcactcctctgtcttgctaagtcatccttcttccttctctcatgggcttgaagatactttttttttttttttttttttgagacggactctcactctgttgcccaggctggagtgcagtggtgcgatctcggctcactgcaagctccacctcccgggttcatgccattctcctgccttagcctcccgagtagctgggactacaggtgcccaccaccatgcccagctaattttttttgtatttttagtagaaacagggtttcaccatgttagccaggatggtctcaatctcctgaccttgtgatccacccgccttggcctcccaaagtgctgggattacaggcgtgagccatcgtgcccggcctttttttttttttaaacactagtcaaatgaagcagtgggagcagagaaggaacaaagaaatctgtaactggttgtcatcaattagttgtaaacatcactgcacttgaaccagcctgaagataattttttattggaagaaattaaagtctaaaaatttactcatttgaaacactagttaccaatctttgttctaatggtatcagtcttagatttaatgaattatctccagataaaataatgatctatatttgtcactgaattcactgaattttacccaacatgcatccctgaaaccagacttgtgaaatttaatatcattttgtcattctccatcttactggcaaaacagaaatccatagttcccccccaaaaaaatcacgattgtatctgtagctccttattcatttgtttattcattcaataagcatttattaaacatcacaaaactatttttgacactggggggaataaaagtaataagttgtgtaagcaaatttaaaatctagtgataaaggcattaataaacaactactcaaaaataatagcatacaagagataaagaggaggaaatatgggaatttgcagaactagtagagattcttactagaatttagagaaagagggttggaactgaaccttcaatgattgtcagaatttctatttcagtcattagaaaagaaggggagaaaattttaagccaaaggaattgcctaagccatgaaaatgagaaaccagctgtaagaacagtgactggtcctcatttgactgaagtaggaagttaaaaaggtaaattaagtgggaatcagtttggtggttcctcaaaaagttaaacatagaattaccatgtgaccagcaattccactcctgggtatatacccaaaagaactgaaaacaattgttcaactacttgtacacaaaagttcatagcagcactatatacaggaccaaaaggtagaaataatcatgtccatcaacaattgaatgaattttttttttttttttggagacagagtctcgctcagtcgtccaggctggagtgcaatggcgcgatctcagctcactgcaacctccacctcctgggttcaagcagttctcctgtctcagcctcccaaatagctgggattataggcacctgccatcatgaccaactaatttttgtatttttgtagagatggggtttcaccatgttggccaagctggtcttgaaatcctgacctcaggtggcctcagcctcccaaagtgctgggattacaggtgtgagccaccgtgcccagccatgaatggattttttaaatgtggtgtatctatacagtggaatattatttgaccataaaaaggaataacattctgatacatgcaatgtgagtgagacttgaaaacattatgctaagtgaaagaagccagacccagaaagtcacatattgtatgattccatcaatccacagagacagaagataaatggttgccagggctccgggggagaaagaaatgggaggtaactgcttagtgggtatgggagctccttgagagtggtgaaaatgttttggaactagaagtgatgattgcacaatattgtgactataattaatgtcactgaattatacactttaaaatggtttttatgttgtgtaaatttcacctcaaacattttttaaaaaggtagactcactaatgctcactgttatacttcccagtccacagaagtctaccgttccagtcactgtgcagttaggcagggccatgtgactgtccaacccttgtctagccaacaggctgtgagcagaagtgacacatgtcacttccaggccaaagcattgaagaaggggtaagagatgtccatgcctctcttctctgccacataaacccaaagccatgtgagactgtagcggaccggatccctgaataaaccaatacctccctactgatccatgctggccatgctggatatgtatgaaatatcctcattgtcttaagccactgaaatgtgagaagctgttattgcagcataagcttagctcctcctgactgatacaggatcagatctaggaaggatatgaaggcaatatgaaggaatttgaatttgattctgaaggatgtggagagacaatatttttgagaagagtgacatgatgtgcatttgaggaaaataactctagaaacaaaagtagctcttaacctttggtgcatgtcaaaaatcacccaaagagaactgtagtcatcttccaattcctttataaattctttaaagaataaaatatttgtcctctggagaaaaaaaaatcacccgagaagcttttcaaaatgcaatgctctggtccaagacatctccagatatcctgaatcagagtctctatgctaggtacatatgattgaaaaaaaaattatgggaaattctagactagaggttagaggcaaggaggagataccaacttcagtcagagatgaccaaattcacatgcttagtgaattcaaataagcattctaataaaataatggaacgataaatgcttagggagtttcgattgaaatagtaagttatgaaaaggttagtcacattaacatttgtacagtcagagttattactttgaacatttaggtaccaatagaatggtggtggtagttttcatgcatctactctattgctaactaagcagcagcctaccccaacatttccattatgctggggaacatggttgacataccacagacaaaggacagagccatcttcagtctcctagaaggtcaaactcttacatctcctttccttctttgcttcctttttccttttcttttaggataattggcattctatgctcttcttaattccttcctcctaggtactcatcagtcaactttcaactaatcaagacttgaagagccaaaatatttaagagctcaaaaagcctaggttacagatgcactggaagctgtcactttgaactgtgtgtgtgtgtgtgtgtgtgtgtgtgtgtgtgtgtgtagtttttactaccaaatgtgatttattatatgtaattgctaagagcctcagctttccagaatagagatttcaatactgtgaagaaataaatcattttctgacaataattcagtttgtgttgcaaaatgcatcttcagagcatctcaagataaagtgatctccaataaacagcactaaagctgcctgacagaaaaactatcttcatttctaaaattgacaagccttgaagcaggaggatagcttgaagctaggagttcgaggtcacagtggctatggtcacgcatgttatctcctagaggtagcaagacttcgtctctaaaaaataataaataaaactgacaggcttcactacaaacctcctcctaatactgaatactgctcaacaatccttttattcctagtgatttcgatcctcttcttgttccccacagcaactgtcccaagcctgtctcttcccaaaacttccaactactcactctcaggaggtaaccttgccttcaccactgagaaaggagaaatgtaaattccctcaactttcccttaccatgtccaaatgtatcttcattcccccatctcctgtctcagaagcatgcttactctacttattttgaagaacgacccttacccatgttgaatctcctgtttccttcatctcatgtcttcctgtttcctgttcttccccttcatttttgtgagtatctcctccagtggttttctgtgaaaggctgcagaggaggtaaatttttttttaccagctgggaaatataatgtatatatttttatgtctttggaagcttgtaggatattttcctgaaaattcatagtgatgtgccttagtatgggtactttttcaaacatcgttctaaggcacttgtgggcctttttaatctggaggctcatgttctatagttccagtaaatgttcctgtactgttcctttaataatttcatcccatatattttctcaaatttctctttctacaactcctgtgacttctatgttggacctctttggttgatctcctaattgtccatcttactgtctttttgttctactgtatgggaaattttgtaaattttttcttctgattcttctatcaatttttaaaatttcaactatgattttttaatttccaaatgctctgtcttgttctttttgtttgtttgtttttgagacagtctcactctgtcacccaggctggagtgtagtggcatgatctcggcccactgcaacctctgcctcctgggttcaagtgattcttgtgcctcagcctcctgagtagctgggattaacaagcgcctgccatcacagttggctggctactttttgtatttttagtagagacaggatttcaccacgttggccaggctggtcttgcacttctgacctcaagtgaccgatccacccacctcagcctcccaaagcgctgggattacaggcgtgagccagcatgcccggccagtcttgttcttgttgttccttttctctagagcatcttgagcttcttacttaacttctctattctcttaatatctctatcaactcctgtctctatgaccactctttttcactggccttcatttactatctccttctctgtatactctttaattggatttttttttcttggctctcttctacacagcccatcctggacatcttatctacttgcatggtttcaattcaatttagctgatattgccaaactattatctctagctccgacttctctcttttaatttctagacctgaacttccaactaccttgtggatatctgcacctagatgttccagacacctcaaactttacattacattgctggcttctggcatcctatgctccaatctcataaacaacttgttatttcccagaaaatattatgaaaggtaacatctctgataggcccaactcaaatgtcacctttttaataaagccttctccgacttcttcctactccttgggagaatggattactctctcccttggcacccaaggctcacttcatagcccataaccattgttcataagtattgctcaccatgagccaatctgctgactgccagattgtgagcctcttgaaagcatgggttatttatctatcagtataagttccatctttaacctctagcaaatggctgttactcaataaatagctgttgaattacaataatttcaggtgaacatacagtataaatatttgactatgtaataattaattaatcatagaatgtaaccagaaacctaacccactagaaaaatattatgtaagtttcaaaatgcatctatggttatttttaattttaaaagattatcattttttggttgggcactgtggttcatgcctgtgatcccagcactttgggaggccaaggtgagtggactgcttgagcccagcagttggagatcagcctaggcaacacagcagggccctgtctctagaaaaaatacaaaaattagccaggaatagtggtgcatgcctgtgatcccagctacttgggaggctgaggtggaaggatctcttgagcctagaaggttgagactgtagtaagctgtgattgcaccactgcactccagcctggacgacagagtgagagtctgtctcaatcaatcaaataatttttaaatattatttttaaaataaacattcccaagcttatacaaaggcgcattcttcatagtaacttgcacagagttacttgcacagaattcaaaaagctaattcagttttaaatcatctgctcacccagatgggtacctgaacagctcttagaatacagaacacattttgttgttgttttcatttgggataactacaaataaaaccaaagaaaaggcaaaaagagatctctttagaatatatgacccatataaaaatattaatagtggttagccaacaagcattctgataaatttcttttccaaaaatgtcaagtgattaaagagtgaagaaaagaaagacacttctgaactcttaactagagcactgctactaagggcattatgaagctgaatgaagaatgttcattcctatgcagggattaagtgtcattaggggctttttgttttctttagtttggtttgattttctttttcaaactaagccctaatgccaaatcttacattttctttttctttttcttgttgaactgatgctatgttaagatataagcacaaacatctcataagtgttttaaaaccatccaattgtttgagaaggcatacgtgctgggcctatgaagccaaaacattagagctaggaaatttgatgaagataataattgcttacagaccagcttgttttaacttgctgaacaaagaatacaattttataccacattttcatcagaagctttttctctacataatcactactgtaatgagcactttaaaaagggagattatctacaggttaaggagtaaggaagttatcaattagataccatcgtcttcaaaatttcacttactcaaactttagattaatagaaaaacatttttggctgacttaagcgatgttttgaatctttacaaaccatttgtttagtgtgcacagcatgaaatctagaaatgaagacaccccattctttccagtactgccctcaatggttctatagccttggctaggtcagtaatttctttgtatcttagttgacttcttagattttcctctatagagatacagttccatctctctcacatcttcaaaatgcattcaggctctatgcctgtgtcagaagttgctctctcactcctttcattcagttactttgatcacttgaagaccctctaattcacgattcaaccaacatttattaagggctttctccatgacaggcaattcagtgaaggtggggatggggtcagtccctaaaaggatactaatactagtctactaacagaaaaaaaaaaaaaaatcctcttcggacttcctttgtttttttgttgttgttgttgttttttgtttttttgagacaggatctgtcatccaagctggagttcagtggtgcaagcatagctcactgcagcctcaaactcctgggctcaagcaatcttcccacctctgcctcccaagtagctgagagtgtaggcacgagccaccacatctgatttagatttcctattctttatttcctctagtatattcagctagaaattctaagaattaagttgtggtaggtttacaggattgggttaaggcagtcattcagtgatcgatggttacaggaccaggcagcctaggagttaatatggtttcaaaacagagataagtcacagaatggagcaaagtcaccaatttcacaagatgaagataactcttcatgcatggtaccaatgatgacccttggtttgctgaatcctttggctttattactccaccctttaaggcagaactctctagacctactctgcaagctatgttgacttctgattctcttaaacagggagccattcatctcagcccataagtcttcaatatcagtgtgttaaagccagagtcatgtcttccaactaagtctgaaaccttgtaaagagaggaaaggaagatgggaagagatctatgttgtccagaagtactaaggggccattttctaacggcagaacttaactttgagactcccaactctggatatttgctcattcttccccatctaccaatcccattggtacctgtgtgacaacctcctccgctttgtctctgacctgttgcttgccatgatccttgccattcagaggccatttggctctgatccatggccttgttgtaatcttgggtcacagatatgctaccaatctgaaatgcttatctggttcctgaccccaggcctaggcctgatcacaaactaaattattctcttgccacctgtcccatgccatgcatatcagtctcatcacagtttcttatcctgcttccccacccacggctgcctatagttctagtgctggctaaaattatagaatcttttttaattcattctggaaggacaaagtaattaagagatgattagtttatgtgacaacaatatgcagaaaggatataaatttgctcacaattaactgtagtatgtgcattgttattatatctttccacacctcaagctttcaatctctaaattaatacatttgccaccacattctctcaaagatatatttatgcatacttaattaacatgtactctgggagtgcaataaagctataatacattcctgcatttctaactacataatgagtatttaaaacatttagaaacaaattggctcccaataaggaataaaaatgttgagtaacttatttttcaaatataatgtctatgccacttaactgaatatttctgaaatgttatataaaaagaaaaatattataattgaatcaagaaaagcataccattctgaagaaattcagtggtgggttctttttcatagtaaagaaggattttggaaatggtgacaactatcccataattaataagttttgtatgttcagctataattacattgaattttctgaaagagagactaatgtgaacaatattccaggaaaggaatattctttttttttctaacttttttcggggggagaacagagtttcagctctgtcacccaggctggagtgcagtggtacaatcatggttcattgcagcctcgacctcccaggttcaagtgatcctcctgcctcagcctcccatgtagctaagactacaggtccacatcaggctaatttttaaaatttttttgtagagacaaggtctcaccatgttgtccaggctggtgtcaaactcctggggtcaagcaatcctcccacctcagcctcccaaagtgctgggattacaggcgtgagccaccacgcccagcctagaaatattcttctgagtacatcttattaggttaacttgctttaaggctttgccttttctactagtgaagcactaaaacatatcctttttaatttaaagacacaaagattttcattgctcttacatgaagagcattctaaagtgttagaataaagtatacttctaaaatgtaaaaaagttaaaggagattcctcacctcaattcttaggagatgctgtatctggaaagggtaaacagaagcaaacagtttcctgaaattgtgccaaggctacatgtcaactgcctggcaggaaatgctttggagaacctagataaacagactatcatctttctctggctttttataaagcaaatgtactgagttaaactagcatcatagacacaacaagcagaaaagggcaccgagaaattttagatgatagtacctgtaggatttatgacaattaaatcagtggtctgtccgtcacttttaacatacatgaacatcacggctcaacaaacatgtactcaatacatgtctgttggatttttgcagtaaattaaatcttaccgttccattaattttcatcatgattttggtgaagatttatctttttttttggcaggggtgtagacagagtttcactcttgttgcccaggctggagtgcaatggtgcaatcttggctcactgcaacctccacctaccgggttcaagcgattctcctgcctcagcctcccaagtagctgggactacaggcatgtgccaccacacccggctaattttgtatttttagtagagatggggtttctccatgttggtcaggctggttttgaactcccaacctcaggtgatccatctacctcggcctcccaaagtgctgggattacagcacggtgagccaccacgcccggcctgtgaagatttatcttacaataaattttcattttgcagcagctcttaatattttggcattatagaatgataaagctttcttacatttatatagcaaataatttttcaaaatattttgcattatcttcatttttttctaacttctcatttcacaagtgctagcaataatgcttaggcaggttaaacaatttggttgtagtcaaagattaagttagtcagagaaccaggtttagaatcaatttgcctgaaacatttgctagtattttccctctctccccactgtataacagaaaatggatttgaaaatccctctactatctttactaaaataatcctcctacctcaccttattttactttacttaactgcaaaaaggatgataatatatgtgttaactgataatatctactgtcaaccaaataaatctgtcttgcataaagtctactcagcccttccataccttttctctctccaccagccacatgttctattcagctccaatcctaaccacacatcttctctttcttctttctcatactagaaggatcctctgccccacataccttatgcccagtcttgcctggtcacaaaggggagcaaaacttccctaatcaaaggaataaagtaatataaaaggtgacatacctctctacctgctataatatcctttagccaaggcacctcagataacaatttgagccacctcaaccctgaggtccctccccatgatccacaaccaccatctgtgacttccagtatacacccaatctgcccctccctcccaaatggaacatcttagccttcgttactactggggatggggagaaaaaaataaactttgtgtggaggccagttatgttctctgcacaaaatgtggagaaggagacagcattctggtggagtaggaagctgctggaatgtctctccccagctagacaacatttgcacagcagcatctgtctgatgtaattattttggaactctagagtctattgaaggtttgtgacttccaggaaaaggcttggacctaaattgtggttaattttggtcaatttcggctcttagtgtagtggacgctacccatgaccacccccatggcaggcagctgtacacatttcctgaaacagcttgctggagccaggatgggcaaaaaggatcttgtccttcaaatgtcagtgatctgtgctctgtctgctgattgctgcttctgatcatagatgtgcagagaaagaggctggtggccattgttgcaagaatgaacttggacccttacctaacgcctatacaaaaattaactcaaaatgaatcaaagacttaaatgcaagacctaaaacaataaaattcttagaagaaaacataaggccaaagcttcaaaacgttgaattggcaatcatttctgggatatgacacaaaggcacaggcagcaaaagaaaaaattgatatattgcactgcattaaaattaaaaatttgggggcaccaaaggaaactgtcaacagagtaaaaatgcaacccacagaatgagagatatttccaaatcatatatctgataagggattaacatccagaatatgtagagaactcctaaaactcgacaacaaaaaacaacataattcgaaaatgggcagagaacttgaatagacatttctcaaaataagatacaaaaacagccaataacaatatgaaaagatgctcaacatcactaatcattacggaaatgcaaatcaaagctacaatgagatgccacctcatacctattaggatggctaccattaaggaaaacaaaggcaaaataaaagtaacaaatgttggtgaggatatggagaaactggaacacttgtacactcttggtgggaatataaagtggtatagtcattgtggaaaacagtatggtgattctgcaaaaagttataaatagaattaccatatgttccagcaattcaaccatgggtatatacccaaaaaattgaaaccagggtctcaaagagatatttataaacccatgttcatagcagcattatttgcaatagctaaaatgtggaagcaacaaaaatgtccatcaatggatgaatggataagcaaatgtggtatgtgcatacaacagaatattattcagccttaaaaaggatggacaggtggttccaagatggccgaataggaacagctccagtctacagctcccagcatgagggacacagaagacgggtgatttctgcatttccaactgaggtaccgggttcatctcaatggggcttgtcagacagtgggtgcagtacagtgggtgcagcccaatgaacatgagccaaagcagggcgaggcatcgcctcacccgggaaacgcaagggtcagggaattccctttcctagccaagggaagctgtgacagacagcacctggaaaatcaggtcactcccaccctaatactgcacttttccaatggtcttagcaaacggcacaacaggagattatatcccgcacatggctcggagggtcccatgtccatggagcctggctcattgctagcacagcagtctgagatcaaactgcaaggtggcagcgaggctcagggaggggcacctgccattgctgaggcttgagtaggtaaacaaagcggccaggaagctcaaactgggtggagtccaccgcagctcaaggaggcctgcctgcctctgtagactccacctctgggggcaaggcatagccaaacaaaaggcagcagaaacctctgcagacttaaatgtccctgtctggcagctttgaagagagtagtggttctccaagcacggaatttgagatctgacaatggacagactgcctcctcaagtggatccctgacccccgagtagcctaactgggaggcaccccccagtaggggcggactgacacctcacacggctgggtactcctctgagacaaaacttccaggggaacgatcaggcagcaacatttgctgttcagcaatattcactgttctgcagcctccactgctgatacccaggcaaacagggtctggagtggacctccagcaaactccaacagacctgcagctgagggtcctgactgttagaaggaaaactaacaaacagaaaggacatccacaccaaaaccccatatgtacgtcaccatcatcaaagaccaaaggtagataaaaccacaaagatggggaaaaaacagagcagaaaagctgaaaattctaaaaatcagagcacatctccccctccaaaggaacgaagctcctcgccagcaacagaacaagctggatggagaatgactttgacaagttgagagaagaaggcttcagatgatcaaacttctctgagctaaaggaggaagtttgaacccatcgagaagaagctaaaaaccttgaaaaaagattagacgaatggctaactagaataaccagtgtagagaagtccttaaatgacctgatggagctgaaaaccatggcatgagaactacgtgatgaatgcacaagcttcagtagccaattcagtcaactggaagaaagggtatcagtgattgaagatcaaattaatgaaatgaagtgagaagagaagtttagagaaaaaagagtaaaaagaaatgaacaaagccttcaagaaatataagactacatgaaaagaccaaatctacatctgagtggtgtacctgaaagtgacagggagaatggaaccaagttggaaaacactctgcaggatattatccaggagaacttccccaacctagcaaggcaggccaacattcaaattcaggaaatacagagaacaccacaaagatactcctcgagaagagcaactccaagacacataattgtcagattcaccaaagttgaaatgaaggaaaaaatgttaagggcagccagaaagaaaggtcaggttaccctcaaagtgaagcccatcagactaacagtggatctcttggtagaaactatacaagccagaaaagagtgggggccaatattcaacattcttaaagaaaagaattttcaacccagaatttcatatccagccaactaagcttcataagtgaaggagaaataaaattctttacagacaagcaaatgctaagacattttgtcaccaccaggcctgccctacaagagctcctgaaggaagcaataaacatggaaaggaacaaccggtaccagccactgcaaaaacatgccaaattgtaaagaccatcaatgctacgaggaaactgcatcaactaacaggcaaaataaccagctaacatcataatggcaggatcaaattcacacataacaatattaactttaaatgtaaatgggctaaatgtgccaattaaaagacacagactagtaaattggataaagagtcaagacccatcagtgtgctgtattcaggagacccatctcacatgcagagacacacataggctcaacataaagggatggaggaagatctaccaagcaaatggagaacaaaaaaaggcaggggttgcaatcctagtctctgataaaacatactttaaaccaacaaagatcaaaagagacaaagaaggccattacataatggtaaagggatcaattcaacaagaagagctaactatcctaaatatatatgcacccaatacagaagcacccagattcataaaacaagtccttagagacctacaaagaaatttagactcccacacaataataatgggagactttaacaccccactatcaacattagacagatcaacgggacagaaagttaacaaggatatccaggaattgaactcagctctgcaccaagcggacctaatagacatctacagaactctccaccccaaatcaacagaatatactttcttctcagcaccacaccgcacttattcgaaaattgaccacatagttggaagtaaagcactcctcagcaaatgtaaaagaacagaaattgtaacaaactgtctctcagacgacagagcaatcaaactacaactcaggattaagaaactcactcaaaactgttcaactacatggaaactgaacaacctgctcctgaaggactactgggtacataatgaaatgaaggcagaaataaagatgttctttgaaaccaatgagaacaaagacacaacataccagagtctctgggacacatttaaagcagtgtgcagagggaaacttatagcactaaatgcccacaagagaaagcaggaaagatctaaaattgatctaaaaccctaacatcacaattaaaagaactagaaaagcaagagcaaacacattcaaaagctagcagaaggcaagaaataactaagatcagagcagaactgaaggcgacagagacacaaaaaaaccttcaaaaaatcaatgaatccaggagctggttttttgaaaagatcaacaaaattgatagaccactagcaagactaataaagaagacaagagagaagaatcaaatagacacaataaaaaatgataaaggggatatcaccaccgatcccacagaaatacaaactaccatcagagaatactataaacacctctacgcaaataaactagaaaatctagaagaaatggataaatttctggacacatacaccctcccaagactaaactaggaagaagttgaatccctgaatagaccaataacaggctctgaaattgaggcaataattaatagcttaccaaccaaaaaaagtccaggaccaaatggattcacagtcgaattctaccagaggtacaaggaggagctggtaccattccttctgaaactattccaatcaatagaaaaagagggaatcctccctaacccattttatgaggccagcatcattctgataccaaagcctggcagagacacaacaaaaaaagagaattttagaccaatatccctagtgaacatcaatgcaaaaatcctcagtaaaatactggcaaaccgaatccagcagcacatcgaaaagcttatccaccatgatcaagtgggcttcatccctgggatgcaaggctggttcaacatacgcaaatcaataaacataatccagcatataaacagaaccaaagacaaaaaccacatgactatctcaatagatgcagaaaaggcctttgacaaaattcaacagcctttcatgctaaaaactctcaataaattaggtattgatgggacgtatctcaaaataataagagctacttatgacaaacccacagccaatatcatactgaatgggcaaaaactggaagcattccctttgaaaaccggcacaagacagggatgccctctctcaccactcctattcaacatagtgttgaaagttctggccagggcaatcaggcaggagaaagaaataaatggtattcaattaggaaaagaagaagtcaaattgtccctgtttgcagatgacatgattgtatgtttagaaaaccccatcgtctcagcccaaaatctccttaagctgataagcaacttcagcaaagtctcaggatacaaaatcaatgtgcaaaaatcacagcattcttatacaccaataacagacaaacagagagccaaatcatgagtgaactcccattcacaactgcttcaaagagaataaaatacctagtaatccaacttacaagggatgtgaaggacctcttcaaggagaactacaaaccgttgctcaacgaaacaaaagaggacacaaacaaatggaagaacattccatgctcatggataggaagaatcaatattgtgaaaatggccatactacccaaggtaatttatagattcaatgccatccccatgaagctaccaacgactttcttcacagaattggaaaaaactactgtaaagttcatatggaaccaaaaaagagcccacattgccaagtcaatcctaagccaaaagaacaaagctggaggcatcatgctacctgacttcaaactatactacaaggctacagtaaccaaaacagcatggtactggtaccaaaacagagatctagaccaatggaacagaacagagccctcagaaataataccagacatctacaaccatctgatctttgacgaacctgacaaaaacaagaaatggggaaaggattccctatttaataaatggtgctgggaaaacttgctagccatatgtagaaagctgaaactggatcccttccttacaccttatacaaaaattaattcaagatggattaaagacttaaatgttcgacctaaaaccataaaaaccctagaagaaaacttaggcaataccattcaggacataggcataggcaaggacttcatatctaaaacaccaaaagcaatggcaacaaaagcgaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaagaaaaaaacaaacaaccccatcaaaaagtgggcaaaggatatgaacagacacttctcaaaagaagacatttatgcagccaacagacacatcaaaaaatgctcaccatcactggccatcagagaaatgcaaatcaaaaccacaatgagataccatctcacaccaattagaatggcggtcattaaaaagtcaggaaacaacaggtgctggagaggatgtggagaaataggaacacttttacactgttggtgggactgtaaactagttcaaacattgtggaagagagtgtggcaattcctcaaggatccagaactagaaataccatttgacccagtgatcccatttctgggtatatacccaaaggattataaatcatgctgctataaagacacatgcacacgtatgtttattgcggcactattcacaatagcaaagacttggaaccaacccaaatgtccatcaatgatagactggattaagaaaatgtggcacatatataccatggaatactatgcagccataaaaaaggatgagttcatgtcctttgtagggacacggatgaagctggaaaccatcattctcagcaaactatcacaaagacaaaaaaccaaacaccgcatgttctcactcataggtgggaagtgaacaatgagaacacttggacacaggaaggggaacatcacacaccagggcctgttgtggggtaggggggtgggagggatagcattaggagatatacctaatgtaaatgacgagttaatgggtgcagcacaccaacatggcacatgtatacatatgtaacaaacctgcacgttgtgcacatgtaccctagaacttaaagtataaaaaaaattttaaaaaaaatggatggacattccgcaatatactacaacatggatgaaactttacgacattatactaaatgaaataagccagtcacgagaagaaaaatactgtatgagtccacttatatgaggtacttacagtagtcaaaataatagagacagaagacagattggtggcttccaggggctgggagtagggaagaatagacaattattgtttaacgaatacagagtttcagttttacaagatgaaaagaagtatagagatggatggtggtgatagttgcacattttgaatatatttaataccactgaagtatacacttaaaaatgcttagaaaactatattttattttgtgtgtttttttattttttatttttattttttgttaaagaaaggtttattcttttagagatgggggttccgctatgttgaccaggctggtcttgaacttctggcctcaagagatcctcccatctctggctcccaaggtgctcgaattacaggtatgaaccaccatgaccggcctattttatgtgtattttaccacaattttagaaattggaaaaaaaatgtggagggtatggtatatgactggaaaaagaagtcacaaaactgagggatataaatacttgaatgcaaacagtaatataatcacagtataacttacatttattaaatagagtatacccataattataattaggtaaacttagtataagctaggagatataaaattttctctagaactggtataatactaaccctggagatctggctacctactctacttgctagagcttcctggagtggaaatacattccagtatcaatgcacagaagaggtttaataaatgtccatggaacaaataaataaatattgatggaaggaataaatataagctttatcctaaaagaatatataaaagtaagccttaagagagtccagaattatatcacaaaaaaggttaggaggaatataaaattggaagggaacaggaattggaatatattaatttttgaaaactgctggatctgtcgggaaatactgtgaccttttttaggtcactaaaactctacacaaggaacacttccagaatggcatagtgaggaggctggcaaatcgtttaacataaagccgcaataaaactgtacaggtagtctctgacttataaagatttgacttcggttttttcaactttatgatggtgcaaaagcaatatacattcagtggaaaccatatgttgaatacccacacaaccattctgtttttcactttcagtacagcattcaataaattacatgagatattcaacactttattataaaataggctttgtgttagatgattttgcccaactttaggctaatgtgagtgttctgaacatgtttaaggtaggctatgctaagatacgatgttttcagataggtgtattaaatgcatttttgacttacaatattttcaacttaaaatgagtttatcaggatataactccttcctaggtcaaagaacatctgtacaaaactgttaaaacaatcatttcaggattttgaaaactgagactgggctcggtggctcatgccttgtaatcccagcactttgggaggccaaggcgggtggatcacctgaggtcagcagttcaagaccagcctggccaacatggcgaagcccatctctacaaaaaatacaaaaaaaatttttttttttaaaaactagccaggtgtggtggtgcatgcctgtaatcccagctactctggaggctgaggcaggagaatcacttgaacccgggaggcagaggttacagtaagcagagattgcgccactgcactccagcctgggcaacagagcacgacaccatctcaaacaaacaaactaactaactaaccagaggcacatgacaaattaaaaagcatttataaaggaaaaaaatcaaactattgaaccttggtaagaaaaatatgaatctatggtattttgagtttttgcaatccctacactccctacccccagctccaacatagtagttctatcaggacagtaaaatccatgaaaatcagcagctctgcaatgtaatttggtgcataggacattgtcagaaacatgtgatcttggtagtaaatgatcagggaaagtcaatatcattgctggctgaaactgtagttttggttgggaaaagtaacagaccagccagaaatttaataggcagatctagggaaaaagacagccatagtggaacctgatacccttggtggtctggaaggctgtgtacaagggcacggttatgcacatgcccaggagagaccacagtgggctacagatttcaatggctgaatgtgaagccttgcatacatagaaataaaattggggcagacttgactgaactctatttctttgttcttgtttttttagaggtagggtctcacatggttgctcaggctggagcacagtggcacaattacagctcactataaccttgaactcctaggctccagcaatcctcccacagttaggaccacaggcatgcaccaccatgcccagctaattttttaaaaatttcttgcgaagacagggccttgctgtgttacctgggctggcctcaagctgttggtatcatgcagtcttcctgtcatggcctcctaaagcactgggattataggcataagccatagccacatggccttgactgaactttaaaggtgttccccaaactatacacagattaattagcaaacagtagagccttactaggctcaagatgtttaagtacaatctcttcccagttattagctgaccactagctatgttgacccaggggcaattcctaggaaagagatttaaaaataaaaccaaattgggcacagcagcacacatctgtagtcccagctactcaagaggctgaggagggacaactgcttcagcgcagaaattcaagtccagcctgcacaacatagtgagaccccatctcataaaaaataaaataaaatgaagtaaaataaaataaaaacaagaattagaaaggaaaaaattaagaaaagatgtcagtagctacacactacaggaaagaaagactacagaatcaaccccgttaactcactaaacaaataaaccaacaaacagcagcaatatcaaaaatccttaggtagggatggaaatcagaatctggagttgccatcatacattatttaaaacagcgatcagcaaactacaactcatggcccaattatggcctactgcttgttttttaaataaaggtttattggaagacatctactttcattcatttacatattgtctatggctactttcacattacaatagagaccacattgactacaaagcctaaaatattttctatccagtcatttatagaaataaattgttgacctctgatctaaaatgttcagttttcaacaaaaaattgcaagacatacaaacaaaaagtggggcccatatatagaaaaaggtgcagttaatggaaactttttctgtaggggcccaaatgttagacttagcagacagacttcaaggcagctgttgtaaatatgttcaaagaactaaagaaaacaaaattttaaaaattaaagtatggcaacagtgacaatatagaatatcaataaaaataaattataaaacaaaacaaattatggagtgaaaagaaaataattgaaatgaaaattcactagaggggctcaagagcaaatttcagattacagaaaaagaatcagtaaactggaagatagatagatcaatagagattatacaatttgaagaaaagaaaagaaaaagaatgaagaaaaatgaacaagcctcagagatttgagagataccaccaaacatactaacatatgtataaggagagtcccagaaaaagaagagaaagagaaagggacagaaaaaaatggctgaaaactttataaatttgaggaaaaacaaatctacacatccaagaagatcaaaagaactccaagtaccataaacacaaagaggtccatacctagaaacaccaaggttaaactgttgaaaggcaaacacaaagagaaaatcttgtaagcagcagagaaaagtggatcatcatttacaaagaaaccacaatcaaattaacagatgactttttatcagaaacaacagagactaagaaagcagggatcaaagtgtttaaaggaaaaaaaaaatctgccaactaaaaattttatatccagcaaaaatagccttatagcctttaaatgtgaaggtgaaataaagacagttgataaacaaagactgaaaaaatttgttgttgccagcttgccttacaagaaatactgaaggaagtttttcaggctgatggaaagtgattttagagttactcaaatctacagagaggaatgtagaacatcagaaatagtaaatatattggttaatataaaggactctatacatatgtttctcactttttctcataacttctttaaaagccataagagcatataaagcaataattgtaacactgtcttgttggatctgtaacatatatgaatgtaatataacagcatgagaaggggggatatggagttatattggacagaagtgtctatatttcacctaaattaagtttatatcaatcagtagattgtggccaggcatggtggctcacacctgtaatctcagcactttaggaggccgagatgggtggactgtttgagcccaggagttagaggccagcctgggcaacatgatgagacaccatctctataaaaaatgtaaaaattggcccagcacagtggctcacgcctataatcccaacactttgggaggccgaggcgggtagatcacaaggtcaggagttcgagactgtcctggctaacacggtgaaaccccgtctctactaaaaatacaaaaaaaaaaaaaattagctgggtgtggtggtggtgcctgtagtcccagctactcaggaggctgaggcaggagaatgacatgaacccgggaggtggagcttgcagtgcccaaggtcgtgccactgcactccagcctgggcgacagagtgagactccatctcaaaaaaaaaaaaaaaaaaattagccaggtgtgttggcgtgtgcctgtggtcccagctactcaggaggttgagttggggggatcacttgagcctaggaggtggaggcaacagtgagccacacttgcgccattgcagtccagcctgggtggcagagcaagaccctgtctcaaaaaaaaaaaaagaaagaagtagatcgtgacaaataaagatgcatattctaattcctagaacaatcactaaaaaatttttttaaaggccgggtgcggtggctcatgcctgtaatcccagcactttgggaggccgaggtgggtagatcacctgaggtcaggagttcaagaccagcatggccaatatggtgaaaccctctctctactaaaaatacaaaaaaattagccaggcatagtggtgggcacctgtaaccccagctacttgagcagctgaggcaggagaatcacttgaatctgggaggcagaggttgcagtgagccgagatcatgccattgcactccagcctaggcaacaagagtgaaaccttggtcttgaactcctgaccttaactgatctgcccaccttggcctcccaaagtgctggaattacaggcgtgagccaccacacctggcccaaattttaatatcttttcaaagaaccaactgttggtttcattgatttttctctatttttctactttgtattttattgatttctacctaatcatcattatacccttcctcctgcttcctttgggtttagtttgttcttcttttcctagtttttctttttctttcttttcttttcttttcttttttttttttttttttgagatggagtcttgctctattgcccaggctggagtgcagtggtgcaatctcagctcactgcaacctccacctcccaggttcaagtgattctcctgcctcagcctcccgagtagctgggattacaggtgcatgccaccacatctggctaatttttgtatttttagtagagacggggtttcaccatgttggccaggctggtctcgaactcctgacctcaactgatctgcccacctcagcctcccaaagtgctgggattacaagcatgagccagcatgcccggctcctagtttcttaaggtagaaacttaggttattgatttgacctatattcttttctaatatagacatctaaagcttggcacttccctctaatcacagttttagctgcctctcatacattttgatatatcacatctttgtttcctttcagttcaaaacatttcctagtttcccttgtgatttagtctatgacccatggattatttacctatgcgttgtttaatttgcaaatatttgtagattccccaaattgtctattgttgatttctaatttaattctattgtgggtagagaacatacctggtatgatttcagtccttttaaattcattgagacttgttttatgacctaataatggtctgttttggagaatgttctgggagtatttgacaagaatgtgtattgtgctattgttggatggagtttcctataggtgtcaaggtggctgacagtatcgtttagccttctatatctttgctgattttctgtttgttctatcagttattaagactgaggattgggctgggcacggtggctcatgcctgtaatcccagcattttgggaggctgaggtgggcgaatcatgaggtcaggagttcaagaccagcctgaccaacacggtgaaaccctgtctctattaaaaatacaaaaagtagccgggtgtggtggcacgcgcctgtaatcccagctactcaggaggctgaggtaggagaatcacttgaacccaggaggcagaggctgcagtgagctgagatcacaccactgcactccagtgtaggtgacagagtgagactccatctcaaaaaaaaaaaaaaaagagtgaggtgttgaagtccccaactaccactgttgaattgtctatttcttgcttgaattttgtcagtttttgctttggtattttgaggctgtgttgttagggtcatgtacatttgcaagtgctatatcttccagatgtaatgatttgtcatttttgtgattctgatatgccccactttgtctagtgatatttcttgtcttcaagtctattttgtctgatgttaatacatttacttcagcaatctttttttggcaaggggagtcgcttaaagcaacacaagtttattatcttaaggttctggaagtcagatgtctgaaatggttttcactggactacaatcaaggtatctgcaggattctgtttctttactccagcaatattatgcttatagtttacatggtatatctttttctttaactttcaacttatttgtgtgtttgactataagttgtgtttcttgtagacagacagttggatctaagccagtctgacaatctctgcttatagaatgggctgttgagaccattcacatttaacattattatcgagatggctgaatttacatttgatcacagtggtgcaatctcggctcactgcaacctccacctcccaggttcaagcaattctcctgcctcagcctcctgagtagctgagactacaggcatgcgccaccacacccagctaatttttgtatttttagtagagatggggcttcaccatgttggacaggatggtctcgatctcttgacctcatgatccacccaccttggcttcccaaagtgctgggattacaggcatgagccaccacacctggccatctgtattttttaaagttttatttatttatttattttttgagacagagtttcactccagcataggccaacatggtgaaaccctgtctctactaaatatacaaaaattagtcgggtgtggtggcatgcacctgtaatccctgttacttgggtggattaggcagaagaatcaatcacttgaacctgggaggcggagattgtagtgagctgagattgcactactgcattccagcctgggtgacagagtgagactgtctcaaaagaaaaaaaaaggatattacaagttgacaaaactttaactagactgaccaagatgttaaaaaaaaaaaaaaaaaagcaagagagagaaggcacagattaccataatcagatcttaaagaaataaaaaagattgtgagggaatattaccaatagctttttgtcaacaaattagacaacttaagtgactgggcaaattcttagacaccaagtattgaaactgactcaagatggaatagaagatcacttgagttcaggagttcaagaccagcctgggcaacatggcaaaaccacatctctactacaaaaagtaccaaaaaaattaggtgggcctagtggtgatgcatgcctgtagtcccagctactcgagtggctaaggtgggagaatcacctgagcccagggagttgaggctgtagtgagctgtgattatgccacggcactccagccttggcaacaggagtgagaccttgtctcaaaaaaaaaaaaaaaaaaaaaagaaggaatagaaaatataagtagacctaaaacaaggaaaaaagttgaattagtaattaaaaatcttcccacaaagtaaagcccaggcccagatggttttaatcaaatgcttaagaataataccaattctacacactcttccaagaaatagaacattcctaaatcattctataaggccaatattatcctaataccaaaagacacaaagaccagaaacaagaaaactagagatcaatatccctcatgaatatacacagaaaaatcctcagtaaaatactagcaaaccaaattcaacaacgaaagattggcttaatatccaaaaatcaattcattcaacacatgttaatagaataaaaaataaaaaccacatgatcacatcaatggacatacaaaaaacgtctgaaaaacttcaaaaatcattcatgataaaaactttcactaaaccaggaatagaaggaaacttcttctcaacctgaagaagctaattaaaaataatttttaaagatagatgagaacttccttaacctaataaagagtatctacaaaaaaacaaatatcatacttaatggtaaaaggctgaatgttctgcctctaaaattgggaacaaggcaaagatgttccccttgccacttctattcaacattgtactacaggttcaagccagtgcgattaggcaagaaaaagaagtcctgattgaaaagaaaaaagttagcctttctttattcacagaagatctgatccagtatacagaaaatcctaaagaatccacaaaaaaattcttagaacaagtaaatgagtttaacaaggttacaggatacaatatcaatatgaaaaagtcaactatatttctatacactagtaataatttcatctgaaaatgaaattgagaaaacaatttcattcacaacagcataaaaatacttaataaatttgttaaaagaagtgcaatatgtacactaatcactacacaatattagtaaaaaaaataaagaaaactgaaataaatggacagacattccatgttcataaattcaaaaacccaatattgttaagattgcaattcttcctcaattaatctgtgaattcaatataatctctatcaaaacatcaacagttgttacacagaagttgacaaactgaatttaaattttatggaaataatgactgtactagaatataaaaataattttgaaaatgaagaacatagttgatatacttcccaatttccaaacttactacaaaactacaataatcaatacagtataatatggcataaggacagacatatagatcaatagaacataatttaaagtctaaaagctaactcttacatttatggtgaattgatttttgacaaagttgccaagggaatttaatgagaaaaggatagtcttttatacaaatgatactgagaaaattgaacatctgcatgaaaagaaatgaatctagacccttacctcataatgcacataaaaattaatgcaaaatggcatagagttaaatgtaaaaactaaaatatacaactattaggaggaaacatagaaaaaatcttcaaaaaaaattttcatgaccttaggttaggcaaagatttcttagatataacaccaaaagcacaatttataaaggaaaaaaattaataagttggagttcatcaaaactttaaatgttagtacttcaaattacaccactaagaaaatgaaatacatgacacagcctgggagaaaatacttatgaatcatacatctggtgtgggtgcggcggctcaagtctgtattcccaagagaaatgaaaacatgtgtccacacaaagtcttactatgcattatcagtcaaaatagccccaaaccagaaacatttcagatgaccatcaaccagtaaatggataaacaaaatgtaatatattcatataacgggatagtattcagtcataaaaaagaatgaagtattgatacatgctacgacatgtgtgagcctcaaaaacattatgctaattaaaagaagccaggcaaaaaaaggtcacatattatcagattccatctatatgaattgtccagaaaaggcgaattcataagacagcaagcagaagactggtcacctaggaccagaggcaggagctgagaactgactgcatatggtatacactagggatttttctcaggtaatgacagtgttccaaaactgcactttggtgatgttgacaactctgtaaatttacaaaaaatactgaaatatacacttaagacaggtaaattttatcatatgtacattatacctcaataaagaagtcttttttttcttttttttttttttttttgagatggagtctcgctctgtcacccaggctggggtgcagtggcgcgaccttggctcactgcaagctctgcctctcaggttcacgccgttctcctgcctcagcctcccctgggactacaggctcctgccaccacgcccagctaattttttgtatttttaatagagatggggtttcaccgtgttagccaggatggtctcaatctcctggcctcgtgatctgcccatctcagcctcccaaagtgctgggattacaggtgtgagccaccgcgcccagccaagaagtcttcaaaaaaaaaaaaaaaaaaactctacataaatttcaactgtttatattaaatatcttccaaatactattcctttgatctctgacttttaaaaatgacaagatttcaatcattcctgctctgcaaccaatttttttaactcccagtcaattttaaacagattgtgaaagttaattctcagaagtttgattcattttctttaatctacatcatcaagatgacaattttgataatgagtttctttcattcccccaataacccagtgagatgatgtaatcaggcaaaatgaatgatctaatgactcagtctgtaatactaccttacaaagctgtgatgattccaaagctcttaagtctgctggagaaataacaataccatttgtcaaataaaatgatttatacagtttctggtatgtacagtataaatcactgtctaactctggcacagtacccacttttgcatcctgggtttttaaccctttttggcccccttcacataaagaaaaggaatttacattgctcttcactggacttgttttttctcctcaaaaagtcccaaatacagcaccagtctctttccccatttcacaattaaagacctcttccaacgcatctcctccaaaacatagaaccctgacaactaactttcatctgttctcattagtgaatttacccttgtgaagatagaagtcattaaaaactcatatcaatagtttatttttctgtcaatactgacagtctatttccctgttgaccaggcacattcctaattagttgccctctctccatttacaattccattttcagttctcaccagtggctttcatttggcgtgggctatatttgatccacaaggggcctgatggtaggtcatgttctatcattattcccagccaatcttaaaaaagataaaaaggaatctctcaagtctctcaatctgtggtttacaggatgaatctttaaaattataaatatgcacatataaaaatatatttacaaatatatttacaaatagaaaaataaaaacaaatgcaaagatttaatttagagtcttttggtttcagtttcatttcaagcatcttctttcccataaatttctaaatgttaaattctgagaaaatgtagttacaattgaatattcattacattcattaaagttcatgtaggtaggtgtttttttaatagaaaagccaactcttttttttcttaagataggttcttactctgttgccccggctggagggcagtggcacgatcatagctcactgcagcctcaacatcctggactcaagcaatcctcccatctcaacctcccgagtagctaggactacaggtatgagccaccatgccaggctagttttttaattttttaaaaaatagagacaggggtctcactatgttgcccaggctgctgtcaaactcctggcctcaagtaatccttccacctcaacctcctgaacttctgggattacaggtgtgagccaccacaaagccacctctttatgtgggctaacagaagtctatttaacttaaaaattaaatcagagtaatttcaacaaatggctactgaacacccgctacttaacaggtcctggaatgtttagggacaaataaggaacagtttctgccttcaaggaattgaaaggctattgggagagaagaaaccataactacacataatttaaattagattggaaaagtacacacaaaaaatttttttaaggctatggcaacagaggtggcaactgggaaccactgggaaaagtttcaaagagctgacctgacaaaaagaaagtagtgcctcaactggaatgactaaaatagaatggggaagagagacaaatgagatgaggtgtggctatgatactgggtaagtgagagcatattttgggagaccaggctgaagcttaagataataatactagctaatatttattgagcacctactatgtaccaagtactataaatgcactttatagatattaacttacttgatattcacaataaccctatgaggaatgtgctaaaaccttgaaatccataaaaaataaagaggaccaaattctgtcccactccaaccacacttattgtaaaagcagttaacgggtatcttatctacctcttctctcactgattcctaggccatcaggcctagcttgaaaactacattctctgcaaaacctttcttgatcctcccagctgaacatagtctcctaagcttgatagcattttatctgtgtcaatcttatggcatgtccgaatattttgttcttggtattatagattttatgtgcattctttcctcttttttattctcctttagtctgatccacattctgttctccacaactcctagggcagtgcctggcacatactaatgctagctaagtctatggagcacttatctttgccgggcactgtgctaagcattttacaggaattatctcacagaatcctaatggcaacccaattcacacattcaagggctatttttagtccttactgtgacagacaaaatagtaaatactagatgcaccttaaactctaaacactacagatacagtcccttccctcaagaagctcagtctaaagaagttagtactattggaatccccagatatagagatgaggaaaagtgaggctcaaagaagtaatatgtttgcccagaaccacagagcaaaaaagtggcagagagcctgggcaacatagggagaccctgtctctacgaaacatttaaaaaatttgcagggcgtggtggctgaagaagaggatcgcttgagcccaggaggtcgaggctgcagtgagccgagatcgtgccactgcacttcagcctggctgacagggtgataccctcgtttctttattaaacaaaaaagaagaagaaggaagaaggaagaagaggaagaagaggaagaggaaggaggaggaggaggaagaaggagaaggagaaggagaaggagaagaaatggaaaaaaaaagatggcagagccagaattcaaaccagctctcccgagtggatatacaggaccccatgcacgtacaaccactatgttctaaaggaggcacttgataaacccttattgaaggaaatgttttggaataccaataaaatgaaaaaaaaatcatctcaagaataatgtagggtttcactcactgttattcttttttataaggggaaagcaggaaatttgcaaaagttaagtagcatagaaggaggtcgtattggtcggctactactcacctggtacctgataattgctcatcaagccatctgttgagactaggtgaggatggagtttctctcctttttcatgaaccacagaggagacttaaaggaggatttatttgtgttccttaaagtgacccccactgagcgtgtccctcaaagtggaccttcctaagcatcggcgctttgctttgcgctgggtggtgcggctgagtcactaattagcagtgagagcctgggctgtatctcctaccaaataaccagcggagtggagtgacaggtccttacttaaacatggtttaagtaagcattcacagttccttacttaaacatggtgcagtcttcctaaaagatggagtcagaccccaagagaacaggtctccaaaaatatgtgaatccgtacttcccactggaggggagagagagctgcgctgagggattatgagagaccctacaacttctcaggcgccccctgccccgggggccaggaacatctgcagacagccccgcctccgtctcgcctcaatcccgagctgttcccttctccaaaggccaccttggcagccacacagtttggcctaatcacctcctcaaacaagagtagcgacaccccaaaatgtagaccaagcagaaagaggcgcgggaggcacttgccttattccccatgatgtttttgttttgagacgaagtcttcctctgtcgcccaggctggagtgcagtggcgcgatctcgtctcactgcaacctccgcttcccgggttcaagcgatcctcccacctcgaccctcccgagtacctgggactacagatgcgcgccaccactcctcctactgtgtgtgtgtgtggacacgggttgtcgctatgttgcctacctagctggtaccccataaccactcctggctagtgtgtgtgtgtgtgtgtggacacgggttgtcgctatgttgcctacctagctggtaccccataaccactcctggctagtgtgtgtgtgtgtgtgtgtgtgtgtgtctacacgggttctcgctatgttgcctacctagctggtaccccataattttttagctcaacaggagacctgcctttatacccaccaagttaagcagcgcagtagccctctaagggccagccccacgcccagaggctcctctgacagcgtggacagatgccctgggctgctggctcgactcagtcctcagcccccagcccccgacccccgacccccggcccccgacccccgacccccggcccccagcgcccggcgccccgcctccagcgctcagcagttaaccaggcaactcgcgcgcagacgccaaggctgggacgcagaaggcgtgtttggccgcccagccgccccgcctcccccacttctcccgcctctcccgcctctcccgccttccgccaatggcccagctgcgccggcgccgccgggagcgctaggcctggtccctcttcctagaatagcgttgcgcgcatgcgccttgacgagtgagccgggtgagggggctccctaagtagcggaaggggtagatgaaaatggaaggggcgggcgcgctaggcctagtcctggctgggctcccgctggagtgtgcgttgggggcggaccaggagcggtggtctccagggaggtcgaggctggggctcccacccggatttggagcagggtcgccgcggcccagctgacccgccggcgtttgtacgttgtgtgcccactcagggagccatggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagaggtgagggtcgctgtgccgggggccgccccagtccttcgcgccgcggtagcccgctgggagccaggggtgcgcagcgcagaagcagctgaggaaaccttcccttagcggaagctggaaaggatcagaacaatgaatggaaaagtcctttcaaaacgctttacatttgacagattcttgttgggtagctgtagaataacggtagtgttcagccctggttggttacttaaaaaaaaaaaaaaaaattagccgggcgcggtggctcatgcctgcaatcccagcactttgggaggccgaggcgggcggatcacctgaggtcgggagttcgaaagcagcctgaccaacatggagaaatcccgtctctactaaaaatacaaaattagccgggcgtggtggcgcatgtctgtaatcccaggtactagggaggctgaggcaggagaatcgcttgaacccgggaggcggaggtcgcggtgagccgagatcgcgccattgcactccagcctgggcaacaagagcgaaacctccgtctcaaaaaaaaaaaaaaaaaaaaaatcttacagctatcatctgatagtagaggaaagcctgcaagcctgtctcttagatcctggataaattgcatgtctatcttttagagttggaattctttctcaataacatcgttctttctgacataaacttgcagagcctttccaaaagtaaaaaggagactatttccaaaatggcttcattctccagtagggaatcctagagctaacctgtgacgtgccatttattcaaatagagagaagagagacccccaacccttagtgcttccttcagaacaatggctgaattcatggactatacttcaagtcagtgtggggtaagttggtgtgaaccaaaactatgccccatcacctgctgatggaccacatttggatctttctggaatttacggagaatctggacactacctgtttctcctgcccagccttcacggtcagattgtaatcagtcaaggacttaaaccagggggtaaatccaagttagaattcacccaataaatgtttattgaatgcctaaccctgtagctgacaatatagcaatgaaaagtcagaaaaggtcttctgccctcagtgatctttcagtctagtggggggaaaatagcttatttgccgaatttcatagcaaataagttaaatattaggggttttttttaactttttttttttttttttttttgagacagaggcttgctctgtggcacaggctggagtgcagtggtgtgatctcggctcactgcaagctctccctcctgggttcacaccattctcctgcctcagcctccctagtagctgggactacaggcgcccaccaccacgcccagctaatttttttttttgtatttttagtagagacggggtttcactgtgttacccaggatggtctccatctcctgacctcgtgatccgcccgcctcagcctcccaaagtgctgggattacaggtgtgagccaccgtgcccgaccttttttttttttttttaattgagacagagtctcactccatcacccaggctggtgtgcagtggctcagtctcggctcactgcaacccctacctcctggcctcctggttcaagcgattctcctgcctcagcctcccgagtagctgggactacaggcacatgccaccatgcctggctaatttttgtatttttagtagagacagggcttcaccatgttggccaggctgctctggaacgcctgacctcgagggatccgcgcatcttggcctcccaaagtgctgggattacaggcttgagccaccatacccagccaagtcatctttcgatacttagggaatgttgagggcaggccagaaaacattcaaggaaattacctgcatggaaggcactgtcttctaggaattacagcaggctctggcctcatgcagtcttaacacttggtgagtcctacatggttttaaggaggctgatccacaaaggagatggaagagaataccttgtttctgccctgcttttcagtttcatatgttaagatctcaaaaaactctaatctttctacatcttttataagaatccctgactccaagaataggattccaaccaaagaggaatacttcagggaatatttttatcttatttgtgttgttcagtggttttacaaaaatcaatagcctcaactctactgtaaagtgattaaacccttggttcatggttcagcaaaaggaataatatttgtctttggtttgaggtttagcaaattgctgttcttcatttttgttttcagttcatgcttcagttcaagtctctgttatgaaatggagcctcagaacctcttggctttctagagatagaattaagaattgtgtactgggtttgtctccacagtttgaagcagccactaaaacacatctttaggtctgtgtcctcaagtgctttccccagcttctcgttcttctggtcacatgttttttagacagtgtgcctaccctgttcaaaacaagcagggctgtgatgtcattagtcattatcaagggcaagtctaaggctaactttgagggggaggaaggaagcagacaagagaaatgtaactgttttccgatctttcggaagattcttcttaaattagagacttctccctccactcccccacgcgcaggaagcacagagaaaagggctgcagagcagctcttgggtttgtttcatttcctgctgtgtttctaaatctcaggaaaatgtacccctctcttcccgtgtcctggtctgagacttagacaataaacatggaaccgttcatccacattttttaggggaggaaatgaaaggatatgtgcattggacatgggggcaaagatgtgaaatttgtttaacctggcagagagcatggtcctgcccacctttagttagccagcgttcttgccctatggaggcagcaggtggcagcacggggatgccaaatgcatttctttctctgcagccactttgggtgggctaaggtttgttgcatgacttcagaggcctgtcaagagggcaggtaattcacctttgctctcttgcctccctccttaactgcactttgcccaaatatcagggttttttgaaaatttgacaagacaatttggttagctaacatctttgacattacgtctctagaaatattattcatctgtgccagaggaaggaggggcaacccatgtctatcgttatcacagaggcgagtcgaagctgcacatgtgcttggacatagggaatggtcaggtaagtgtactcaactgtcctgcaccatgccttcagtctaccaagatatgacaccctatattcaagagcccctgctagactttgtgtcactggatgcccgtgtgacttggcattacagtgcttaacagaaatgtgtaaattcatagccttagagaacttacagcaatgaacatgaaataggaggttgtcaaaaatataagattgatgccactgtaggatctttagttgaacctgcagtcctgggccatgggattctccagcaggtttaaagaaaagagcttccaagcctggaatgtggtgtatgcaatgatcgcccctgtgactatcccctgcattctatcctgggcaacatagaccctttctctaatttttttttaaaagagctctaaatatcctcttctacatctagggataggattttttttttctttttttttttttttttttttttgagacagggtcttactctgtcacccaggctagagtgcagtggagcaatcatggcttactgcagccttgacttcctgggcaggtgatcctcccacctgaacctcccaagtagctgggactacaggcacatgccaccacacccagctaatttttaatgtttttaatagagatggggttttgctatgttgcccaggctgggggaaaagatttttaataattacattttttactataaggtgataactgtcatgtctttggtaatttttttttttttttgagagggagtctcactctgtcacccaaggtggagtgcagtggtgcgatcgcggctcactgcaacttctgcctcccaggttcagacaattctgcctcagcctcccaagtagctgggactacgtgcacacaccaccagcccagctaatttttgtatttttctttctttttttttttttttttttgtggagtcacagtcttgctctgttgcccgggctggagtgcagtggcacaatctcagctcactgcaagctctgcctccctggttcacgccattcttctgcctcagccccgagtagctgggactacaggcgttgccaccacgcctggctaattttttgtatttttagtggagacggggtttcgctgtgttagccaggatggtctcgatctcccgacctcgtgatccgcctgcctcggcctcccaaagtgctgggattacaggtgtaacccaccgcgcctgacccatttttgtattttttaatagagacagagtttcaccgtgttggccaggcaggtcttgaactcctgacctcaggtgatctgcctgcctcagcctcccaaagtgctgagattacaggcgtgagccaccatgcctggcccctgtctttcataatttttaaaaagaaagtacaagggaagtgtggggacgggggtctcttttaacaaaatactttttgtaaaggtaataacagttacgggcctctcactacaaacttaccttttaccacatgtcattctggggaagccaaagattctgcttattgaactgattcaaaggaggaggtggtggtggtggtttctgaggagactaggtttttgcttttgttttaacctaccctacttgtactcaaagatagcaaactgaagtccagagtctattccagagtctaagttggattcctgacttctttggtctgtcagccattttggggtgttagagggaggaagtttaggaaaaggatgggagagtgggcacagggacatgagcaagggctgagtgcacactcgaagcacctcccacatgcctcccctggcctgggaggtgagtagtggtgccagagcttgagtcctgagcccccttttctggcctagcctgaactcttacctaaacgcacctgaccctaaagggtgcacttaggtacatgtggggaagagtcgttcccatctctccctttaaaatgtaagttccctctaagggaaattggctttatcagtcagcctgttcccttctaggaccacccccactcctagaagaagcacagaagagaatgtattgagagcctaagtgccacttttgcactttaaattttccctgcaatccaagagtgccatgttacagactggaaaaccaaggttcaagagaagttaatctgtcttagtaaatagcagagataggacttaaactcaggcgtggctgattccaaagcccatgtaaggatgaaaattatagtaaatacctgactaaaaatacctcacagaattcacttaaaaatgccttaatgacttagatgacaacttagaaaaagctgacagaacaattactaactcctaataaggtagaagagaacttctctttacaatccaaaagtgaaagcttgggcacaaatcagtgttctacttgtctcttcagagaaaagacagaaaaaagacatcccttggtcctggaggcagctatcaaatatcagagcatgctccagaggcatcccagcctgtgagtacggaactgcttacgcactgggtttcaccaccgttgcaactccatgaaccagttgacatggttcttagagggctatttgaattgagtctatagtatttttaagttgagatgttcttacacttaagaagggcacacaagattttggttcagtgtaaaattaggttttcttggtattcttccttcactctaagcttcagggatactctttgtgcctgaactcatagttgtggttggaaagaatgtgaagtattcacctctcagttcctacagctcagctgggctggcactgggtcctgctggaattccaccatctgttcaagcagcaggaggggcacgatcctcctgctaacaaagtgaaaaccattgctgaaattccgaaacatacacatttggtgagatcaggttccaaaacatttgaaggcatttgttcttattttccacaaatgtttctctgtaaaaacatataatgagtttttcatttttaggataaagtactcattaggtcatgaagccaggggatcctttttggaacttggaagggctagaattctgaggaaaggaacttcattcagcatggtgccgcaatacatttactttttgtttgtatacggtttgctacgagtcaggatttggagtatactagagttagtgacaattaagaatattctgcttctagtacaaatataagttgttaaggcttagacgcctctcaacacttgctgacttttggtaatgctgatgttccaccgtgttggagttctacagccacatgccaaccttacctctatgtttccttgtgtgcaaatgaagcatccttggctttctgcaattctgatataaccatattttctaaaagtgacttttatttacatggttgacaaccaataaatagttaatgacattgtcatacacatttacgtcagttaaaggatggtagacttccaatttcgcagtaactggacaggcatgaaagaatacaacataaaacagctttggaaaaaattggcttcaaatccatctgcaaggtaggaggaagaggggaaatttcataaaaatgtaaacatgatcatttattcctctgagtgcaatttgctggccagtagtttggcttttcctgtgtgtggtagtggaatcgacaacttctgcctatggccccttctcagcattaagcaagcttgtaatggcatcccaggtgtcactctggcccttaattacaggctctcttctggtttgtgactttgtccttttaccatttgaactgagacccatcctctgcctgcacacctgatgtaatctaccagccatgagtgaagtctacccttggaagactgattgtgctcagttcggctctaaataaaatctttccattaactctggcttccagtgttttgtactctgggagaaccagtcctccaagggagagttttgtcagccagctgaattgctgcttcagtgacaaaatggaattcactcaaattgttctgagctttaggacaaaagaaatgcctgtcatcttcctgatagtgaacttagcaaagcaccgtttaaaagaatggctctcatcactcccgagtaccttgtcattactgctcatctgtgctaagtgccactgtctacttctgatccccaaaacagtggcctctagcctttccttctgcctaactccaagtagagtgttctttttataatccttcatgttcatataacactttagcatttacagagtgttttcacatgcttatttgtgaggtattatcacagtgctagaaataaggaaaggctgagacctaccaaaatgacagtgttgtacgtgagcaggctgagccttgaaagcaggacctctgtctcccacattagcgcttcattccatcacacctctgcaaggacaggtagcctgctggggggccatggtggcactggggtataaaatctctaaactgctaatatcctcttttccttctaggctgagaacatctctaaggacctctacatagaagtatatccagggacctattctgtcactgtgggctcaaatgacttaaccaagaagactcatgtggtagcagttgattctggacaaagcgtggacctggtcttccctgtgtgatgttgaccatcactgccatcacatcacctttttttaagtagtaagaataaagccactgtatgattctcttaatagctatacattaatcctgtttttagtgctgactgggtcagccttccgggaactggagtctgtctctttcagtgcttttttgtttgtttggttggtttttttttgagacagtctcactctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaacttgagggtgtagaggtcctccacgcttgtttgcctgaaagtaatataatgatgctgtctgaacaggttttactgcttgctttccaagtaaaggttaattatgataataaagagatttggaaatgaagagaattcatttttattaagaggtgaaacaaaatgtcactcatgtacaactaggctttatgggaaggtggcagagtggctgtggacacatttgcccaaagcaggctgaccccctcttccacggaagaggcatcttaaagcagtttcaccagggccctggcagggagccccagggcaggatcccacattcctatagccctcacaacaggtgccttcctgctgcttatctgcagggaggtcttcgtggggtggagatactggtggttatttgactgttacctgtggcctgtcctctgcctccttccgttgaagaaggccttgtcagccactctgtataactctcctcgaatatttaccatgtttattctttacctataaaagggggaaaaattccatacattgttatgctgactgcaattttaagaatcaaaagtcactgattttaaaaagtcattgattgtggccgagtgcggtggctcatacctgtaatcccaacattttgggaaaccaaggcaggaagatcacttgagcctagtaatcaagaccagcctggtcaacacagtgagaccctatctctacaaaaagtaaaaaatttagtcaggtgtggtggcatgtgcctagctactcaggtcctagctactcaggaggctcaggtgggcggctcacttgagcccaggagttcaaggctgtagtgagccatgattatgccactgcattccagcctgagtgacagagtgagatcctgtctcagaaaaaaaagtcattgctgtgtcccaaatgtcttgaagctgccacagcagaactgtgacatctcccagtttcgttgcctggtgattctctcattttgaacacaaacctttccttgggaaaggtgccagtattttatataatggaaataaagtttaagtagggctatattatcattcttagtgaggaatagactccatattcagagggcctaataaagcagacccctacccaataccatagaacagagggtcatttaaacggggatccttgcacccccaagaagcctgtgattaaattcatgggttccataagccttctgaaattacatgcaaaattgagggtatgtgcatttttctaggacaaggggtcataggttttactgttctcaaaggggatgtgacccaaaaggtctaagacccatgtgaggagtccttaggaagcccctttccagccattctgctttacctagatcctcagggctcttagtctaacgggaattcttgttccactgacatattgcaaggctctgactccgctttctgtgttcagcttcccctggcggggtccgcggtggcttcatgtgggttgctttcgagaccagctccttggtagtccccactactgcagtttgtgctctctgctgtttgtgatccttttcttctttgcagatgttggaatatcttgttcctaaacccaaaagtcaattacttaggttgaatatgccaccattttgatggcataagtagaactaaaacaaggatcactgaagtatctgtaagctcaagcattgttttcttttcatttattatgtatttgagacagggtcttgctattatcacccaggctggaatgcagtggcatgatcatagctcactgcagcctcagccacccgggctcaagtcatcctcccacctgccacccgctcttcactacagcccccagtagctgggaccacaggcgcacaccaccatgctcagctaattgtttagttttttgtagaaacggtctcactatgttgcccaggctggtcttgaactcctgggctcaagagatcctccagcctcagcctcccaaagtgttgcagttacaggtataagccactacacctggcctgttttcttttgccatcatgcaatgtgtccatgtaatgttttctatttttagagaaaaaaattgttatcatttctggaccttatgcttttgggaaacattacctgatacccaagatttggagttgtgaagaagttattggatgtgtcttctaaactgccagtagggcaagcaaaggtaactgactgccaccagttaaaggagcttcgacaccttcactgatcactgataacacagaccacaaagaagagattacaagctgatagaaaacaaatattaagaaattgaactgggtgcattggtgcacacctgtagtcccgactatttgggaggctgaggtgggaggattgcttgagcccaggagtttgaggctgcagtgagctatgatcgtgccactgcccaccagcctgggtgacatagtgagaccctgtctctaaaaataaaaaaaaaattggggcaaaacaaaaataatgggagatgtgacttcctgaggaatagaccaatctaaaagggaaggaatgctttttacgtttcttttaaaactacagattgaatcctgtttcagtcaaaggaggcagaaagtacctccctgccagcagctcacaatctggcctccctaggactattaggatctaattggaacctctcactgcctgtaactgaaagtaagggaaagtgtggaggacagagaaacctatgcaagagcttttgtgagaggcaaagctcaaaattgagtgtcaagcatcagcactcgacagaacggatatcaagtcctgatagcaagaactgattaaacatcaagcatgtttaggagaagcaaaacagcacatttcctttaaaagatacaaaacctggaggggagaaaagcaaagctctggtgtttgccttgtttcagccctgaccctggttttctgtgcttctcttcactagtgagcaggtagtcccacacatgtggtgagggcgggggatggccatgtctccacaccccctctcgggcatgctctccatatatttgggaacatactgatgatgctcatgggtcagccccaggaactttccctagagcataacacaagatccagtatttaacaggaaagcccggccaagtacctgaagatactatagttatcttctttatagtcaattaatagaatttatttcaggggagaaaataactttggagtggatctctttaaatgtggtgatggagagagactgtaggtgtaagtggctttgggcagtagcagtaagagctgtgtaaacttagggccaggggaaatttgtttggacttaatcaggtttggaacccttctagagtttgctatggagcaagtcacagcaatgggaacacagacgtggtatctagggtatgtctggcctccatggcccctctggttgtccctctcccctatgctgggcttggcactgtctcagttgctccccacagacccctctctgttgggtaggtacagctcttctttctccaagctgtgctggagcaagaggcattgggagctatggagaatttagcatgaaaactctagagttcggtgccatcttctttatgccctctctacaagtgataatataaagaaaatggtgccaaactctagagttttcatgctaaattctccataacttcatttctttcgaatggagaaagaaaccggcatttctttcttttctttttttttatttttgcagacagagtctcgctgtgtcgcccaggctggagtgtagtggcttaccctgcctcccagcttcaactgattctcatacctcagcctcccaactagctgggattacagacgtgcatcacaatgcctggctaatttttgtatttttagtagagacggggtttcactttgttggtcaggctggtctcaaacccctgacctcaagtgatccaccccccacccccaccccccggcctcccaaagtgctgggtgagccactgtgcccagcgaaatcgccacttctgagtggctgctgccaaggcttgccattgcaagattggagtaacccatttcacagaagcccaggacccacctccccattttatgttttcaatacaaagtttcctcctggagagtggaggaagagcacagctgggcctatgagagataggggaaaaatcctcatataaaatccaagtgcagcagacacactcctccccacccctcccaaagcccaggggttcagaggagtcaccaggaaagcttctcattacaaacaatttctcaacttcctggaactgaacactaataaaatccttacccttggggcaagatttaaatcttcattggtgccagcttggtggttcacgcctgtaatcccagcactttgggaggccgaggcaggcagatcacttaggccaggggttcgagacctgcctggccaacatggcaaaaccccatctccactaaaaatacaaaaagttagccaggcatggtggcatgcacctataatcccagctactggggaggctgaggcatgagaatcactcgaacctgggaggcagaggttgcagtgagccaaaatcatgccactgcactccagcctgggcaacagagtgagactctttgtctcaaaacaacaacaacaacaacaacaacaaaaaccctcatgggctgagcagtccttctggctcagtggctgtcctagaaatagggctatggtttcaaccagggacccccagtgggtcccagtgtgggcagtgcctagagatctaagcccttagcagtggtgttccttcacctcacagcctccctgccccagatacgttcagtgaccccaggactcccagaatcttgtcaagggccagacttttccaggccacctccttcacacagctctgacaggcttctgctctttccagactccgttgggaatttagataggatgggctccccgaacctagcagggcccgccacacagttctcagctggaggcgatgcagtgtggggctggctgcagactgccagcagcaacaggacacggcttccctgttggccatgagggataagaagcacatcgcagtgcccgggtcctccccgctcacttactgagggaaccagcaggagagtggggcctcacgaccaatgctcaagaccagtttctatgcttcagtgcatcaactctgatcaacacctggaggcatttggactgttcatctagagaaaaaccaaggcctccaagaaaaaaggaggagactaaaaacagacaatggcagtgctctatcagtagagactagtgaagaaagaaaaaggcaggtattaaatagggatgcaaccttagcacaaagatcagttcatccttctgctcctttgggcctcatagctgaaatggaaacctgctatttccctcttgccacagcctcctcttcagcatgaccagactcccaaggattactgcagtcccaacagagtggacacgtgcatcaaattcctaagggacatgtgggagggaagggaggcggggccccagcccctgccttagaaagcaagcccactcccctggtatacctggcttcccaaggcatggctcaggcccgtttctcttccaatacctccactcaggctggcagaggccactctgtctcagaggcatctcaagaaagatgggatctgtgttgactgcactgttcaccatcagtctctggggagggcccatctccagatcattctccacaccgtcttgttcacaggaggaggatgaggaggaagaaacagccaggggagcgtgcattgctactttctcctctttaggaccttccaggggcaaaagctgtgctgtgggctccaactctggaagttctctggccatgacttctgaggtcctggttagaggccaccaagtcgtgccacatggcgggcagccacagaggcagccctggcacagtagctggcagcaggcatgatggtggcagagagggcacaggaatggagcatccggaggaagctcattagtgatgcgcccagtgattggccctagcagagagcagcaaggggcccagtgaaggggcctggggtgctccctggtgaaagacttgtgcagcctctccacagccttcttccagatggtcagggacaccgactggaccccacctaggggcactttagcagctttgccattccagaaatgaacagtgatttctttttcctttgatgctacataacaaaaaatggcaacattttgttataattaccaattatctccttttttttcttttttctttttttcttttctttttttttttttttttttgagacagggtctggctcaggctggagtgcagtggcacagtgatagctcactgcagcctcaacctcccaggctcaagccatcctcctgcctcagcctccgaagtagcttccacgtcctaatcatgggataaagcctctcctacccacacaggcaaaggcagagcttcagcctggccccgctgctctggctgcgtggctcctcacatgcacctctccgtggagagcctgccaggaacatccttcacctgcaccatagttacctccacttcccaaggacttgcctgagcctccctgcctcctggactacagtggcctgcaggggctcacttttcttgtcaaaaccaaaatgcattctcagtagaagcctcattctgtcattctctgaattacaatggtgctgactgaccctgcagaagaggactgtctggtccctggaggacctggtgagggctgggttgtgagtagctaaaccatggtttagctaaccaacatagatatgagagttttaggccatttaccctgattacaattttttttttaataatctgaaagatacactgtgcatcttgaggcatctgttgctgccctcaagattaagcagcaagcaagggggaaaaattctcttcttaatgccttagaaacccctaagctgtagacgcagccttggctctctcctctggcctgattacagcctggctccttctgggcactgatgggtcagagcagcttctcttacctctctggggatctctcatctccaagcccaaaagaacagtgccagggccatactgctgttggcctggctcccagagtgccagcaccttatcccctggtctcagtgagtatcctacagatggtgagagaggaatgacatcctcttctaagaccactctctgctgctgggctggcagctttgggcctgcgacaagaggagcctcgaattccacaagcaggaccccctgtctctccagctgtgggaaagaaaacactcagaataagacctggcattacaaagtacaatagggagcacccaggttccctacgatgccccccaaatcaggcccaggggctgccttccaaacagtgacaggcacctaaagaagggacagggcagatgctgcttcaagccagtcaaagccaagacaggcaggctgtgtggcacggttgtgctcccctgaatctcttcctgcctcgggcaactcttgtggatcacttcctgcctctgcctttccattcccttcctttgcctggttttctttcctcctaccaaatttttgacctgcaattgccaggagttacctgggtcctccctggaccttttctcaatgcaatctcctccttccagcacccccaagaagcgtcgctcctgtgtccaagaccaaccagggatgtgtccaagaccaacaggatggttgttcacctatgaggctcatgtaggcaaggagcgattgtggccacagagctgccctcagcactgcccttgcagtcaacgaggaaagggttagctaagcaaatgaatagcaaaagtgagagaacagtgctgcagctacttaaaagtacaagctgtttcaagtactctgtgatttagaagagaaataaactctggttataaattatttttaccaaatcactggacagaacctatatttgagcaaagctttgctagaatttcattttaattcacatattagttacttgaaaattgacttttttttgttttttccagacggagtttcgctcgtcacccaggctagagtgcaatggcgtgatcttggttcactgcaacctctgcctcctgggttcaagcgattctcctgtctcaggttcccgagcagctgggactacaggagcccaccacctggctcagctaatttttgtatatttagtagagacggggtgtcaccacgttggccaggctggtctcgaatttctgatctcaggtaacccacccttcttggtttcccaaagtgctgttattacaggtgtgagcaaccgcacctggccaaaaactgacttttgattggaaattctgaaattcatatttttaaagaatttacactagtcttcccttcatgaatctacattcacaaagtaagtctgactctgaaaaaaagaaaaaaaaaagaagtgagtagccactgaagtacaggccaggcctggcccccagcatggcgagagtgtgcttctctgtaccagcacacacccatgcatgtgagcaaacatatctcgttccacctttcccttaggctagtgttcattcaacacactgaattttccgcaacaaagtacttttaaagtacactttcttctctgttatgcattgaattgtgtcccgttacccacctccaccctcctcccacaggctggagtgcaatgatgccatcagtttggggctcaagtgatcttcctgcctgagcctcccaagtagctgcgactacagccatgtgccaccatgcctggctcatttttaaattttttgtagagacagggtctcactgtgttgcccaggctggtcttgaactcctggcctcaagcaatcctcccaccaccacctctcaaagtgctgggattacaggcatgagccaacatgccttgccccctgccaaattcatatgttgaagtcctagcccccagaatgtgaccttatttgtggataggggcattgcaaatgtaattaagatgaggactgaatatggcaggtccctaatccagtgtgattgatgtccttataaagggggaaatgtgggcagacacacactcagggagaaagccccataaaggtaaaggcagagatcaaggcgatgcctctataagctgaggaacaccaaagcctgccagcaagccatgagaagccagaagcagggcatgggaatgattcttcttcatagctctcagaaggaaccaaccttgccaacccctggacttccagcctccagaaatgggagatgacacatttctgtggtttaagccactccgtttgttgcactttgttagggagccctagcaaactaatacactcaatggtattacatgttcacttctacaacatggccatgggagagctgtgcttatgcaagaaaccagcctgctagatgtacacagctaaggcatgtcaggtatgacaaggccacccagaggagcacgccagggagatactggggtcagggacttgcctcgggagtggcctttatttgggcccggtagtaaaaaccatctgcttcccttcttgctaggacccatgtgttggcagcatctccagctcttcccagccagccaggcccctgccatgctgggtcggcaacgtggagacatgggcaagaagaggcatgcctggaaaaaagcaaatggaattagtggatagagagcaacaagccctaaacacatcaagaaacacgtttcgcaggtacatctgaggtacaccacagcacatgaggcatgcggaacagaaatccatatggaaagtggcaatctatgacttccggaaggataaggtaaacctccgggaggggcagaaggagaggacagtgaagggaaccatccttggtggattgggagttggttcaaggcaaccaaaatgtaattcgccttgatacattcaagttaattgatgcttgttcctacactagacaacagactggaaaagtgtggctcaagcctgtaatcccagcactttgggaggccgatgtggatggatcacttgagctcagaaattcaagaccagcctgggcaacatggtgaaatcccatctctaccaaaaatacaaaaaattagctgggtgtggtggtgtgagcctgtgatcccagctacttgggaggctgagataggaggattgcttgaatctgggaggtagaggttgcagtgggctgaaatgacactactgcactccagcctgggtgacaaggtgagacccctatcaaaaaaaagaaaagaaaagagtgccaggggccgggagcagtggctcacacctgtaatcccagcactttgggaggccgagatgggcggatcacgaggtcaagagatcgagactatctggacaacacggtgaaaccccacctctactaaaaatacaaaaattaggtgggcgtggtggtgggtgcctgtagtctcagctactcaggaggctgaggcagaagaatcgcttgaacccaggaggcggaggttgcagtgagccaagattgcgccactgtactccagcctggtgacagagcgagactctgtctcaaaaaaaaaaaaaaaaaaaaaaaaaagtgccaggtaggtcaatcctaaggcggcgtgtgggattccaggatgaggcgtggaagcttggatagtaatgccgagggtgtgaaattgtaatgccacttgatgctgtggggtcagagggatgaggaagtgtttgggcagggacaacccagaggagctaaggggctgtgggacagaaaaaggagatgctagttccagaaaatgttgtggtcagggccagttggcctaggggagttgttgagtcagggtttgggtttttgaagaagccattttactttgtgggcaaggctgaatgcaaagggggcctgtctgcctcctgctgccatcaacatgccgtcactgcacccaggctgttcgtgctgaggagctcctgcagacccatgctgagctgccctcagcccccctcagcctccttcctgtgcttgttggcatctaaagtcccatgcttaactctagccttgaacaggatggtccaccgggtggatcacgaaagggagccattaaggatctttcaagctggcatgtccctaatgtgggcagaatggatcaggcagcaggaatgcgagtccctggagatgacacgctccacatgtgtatatagggctgtggtgcctttggcctcttgtatccacgctttagaaagcagactgaggatcctattcaggaaaatcctggacaaaggaggggtaccgagggaacctgaagagggacctggagaccccacattagctgatttctcatatggtggctgagcaagtctctttttttttttttttggttttgttttgtttttgagacagagtctcactctgttccctaggctcgagcgcagtggcgctgtctcggctcactgcaacctctgcctcccgagttcaagcaattttcctgcctcagcctcctgagtagctgggaatacaggcatgtgccaccacgcccagctaattattgttttttctttgagacagagtctcactctgtcacccaggctggagtgcaatggtgcgatctcggctcactgcaacctttccaccttccgagttcaagcaattctctgcctcatcctcctgagtagctgggattacagtcacccgccaccatgcctggctaatttttatatttttagtagagacggggtttcaccatcttggccacgctggtctcgaactcctgaccttgggtgaaccacctgccttggcctcccaaagtgctgggattacaggcatgagccaccatgcccagccaattttttgtgtgtttttagtagatggggttttgccatgttggtcagactggactcgaactcctgacctcaagtgatctgcttgcctcggccttccaaagtgctgggattgtatacaggtgtgagccactgcgcccagccaagtctcagcattgatggtaaaatgagctataaacttggtaactggctatccctaactgccttctcttactcatgccaactgcagcatctgcaactctgctaaagccagatcaaccctggagggctctgggagcacaatgtaggctggagtgacagaccccacacagatatgccaatcataggccaaacaatgacgacccctttccaccttctcaggaagcaagtctgtccaccaaggtctaccaccaacagccaagaacaaaggaaaaagaaaagggcatccacttcccccagaggggcagagacaggtaccttgcaaggggcttgtgcccggtgagccagggtgcttggagggcaaaggggtaggtgaaggagaggtcccaaggtggagcagcaccgtcccagccaggggccttcaggcttgtggccacgctgcagtatttgagcaaaggcatcctgggccccgtggaggattccatggccttcagaggatccacctgagaataggcaccaccattacctgagctgcagcttgaagcaagcagtggccaccggggcgaggcagggctcagctctgcagttagctgcctctggggacagttgagtccatgcacggccctacctgctcccacaaactctcacagtttcctctttgagtcacctgccttgggaacctccactcaggaaacagggaagggattggaagagcaagtgctgtgagtttagagcagcccagctttaaatcctcccctacagcctgctggctgtgtgctcacttaacctctgctctccagttacactcaggatagaatacatggaaagcacctggcgtattcagcagctcaacttatgttagtatttttcctccttcctcctccccggccacctacaaggctagttctggcctcaggcaagctgagatctcagggccgtccatcccctttccagccctgttcagaggagacagctgccaccagggcccaagatcaagccgcactgctgcagcccaccagagccccgtgagggtctgcccctgcccaagtccacaggtctgaccccacaaggacttacccacagccccaaactcccagcctccacctcagcctcaggctccttctgacagttggggctcagggtctcagcccaaccgactcctggttgccacgccggttaccatgggtgcagcctggggacgctgtcgtctgtggccagtgagtgcaccgagcatgcggagagggggacaggaggccttgggaggtaggggtggggcaggaagtgatgggggagggggtgttctccaggtttccctttggagagaagaggaggaggaagaagggaaaaaggccagtgtagcctcagttctccaaagctcaggctgctccactgctggaagagtcagtggtggtgggaagccctcacggatcccaggagactcctgtgagggaggagccacctccgcagaaactgagggcgtcctccctgtacacactagaggcaggaatgggggagccactggcggcctggggactctaggatagaatttgtccctagtctaaaccaaaataaccaaaggtgtgggcctgtttgtctataacaggcaggactctgttgaggagcagaggtgttgtgaccatttggagtgagaggtgtggacactggcaacaaaggaacagaagtccagattctgcttgtgggaggggctcgtatttggaggcctctgccagtcactgtgcactggttatatgcctggtatgcaggcacgtttggatgtgtctcccccacattcataccccgcttctaccaggtcctgtttcagttggcagatccatgtggatagggaggccaaagtacccacctccaggggtagagtgggtgtcagtcaccccttccatccccgtctggccccaggggttggtcaggcagtggcgtgttcctgaacctctccaatcagcaggaatctggagactttggttgggaatcctgggatataggctttctctttcttcctatgcctgaataagaaagctgatagttctgagagcctctgacagccttttgggaacactgaagctattcccagagaaagagaggatagacctcaggaaatagagggttggttggtttgtttgttttgagacagggttgcccaggctggcctcaaactcctgggctcaagggatgcttttgcctcagtcttccaaggagctcggactacagccatgcaccccaacgcccagctgaaaataggttctcggtgacagtactgagtcctgcctgcaggcagtgctgctactctaggcctcagctctgtgagccaataattccccttattgattatgccactctggattgggctgtttcttacttgcaaccaaaagcctcttaactgatgactgccctcccgaagcatcacttcatagtcaggagaatgactgctgcccaggaccgtataccaaggcggagttatttggcacacagagagtctaagaaagacccatggccgggcgcggtggctcatgcctgtaatcccagcacttgggaggccaaggcaggtggatcacgaggtcaggagatcgagaccatcctggctaacacagtgaaaccccgtctctactaaaaatacaaaaaattagctgggcatggtggcacacgcctgtaatcccagctactcgggaggctgaggcaggagaatcgcttgaaccagggagtcagaggttgcagtgagccgaggtcgcgccactgcactccagcctgggtgacaaagaaagactctgtctcaaaaaataaaaaataaattaaaaaatacccgtgaagtctctggcagtgaaagaatgattcttgaatgagacagtgggatttcagtggaggaggggaaaaggagaatattctagtttaggtaggaagtaagagagaagagagaaggatacatttgcgagactgtgattttctgtttgggggaaatgggttcagcacatgcaaaatcacattgaacttgcttaggagtcacattaaagcagactcacatcagagtgtgggtgtgagagtaatcctgcttatagattacagaggcatcatcgctaatcccatcagatgttatcttacatataggaaaaggccaaaactcgggtcatttatcttttaaggaatgtagtgactcaggcaggagatgacggggtggaggagggagaggggcgtgtactctgtcctgtcgtgtcttcaaagcttctttctgaagagcgaaagagctgcctgcggtaagagtcaggggctttgtgaaatgttgctggcaaggagaaatgagaaaacacggcttcttatgtttgctgctttgttttgcagtagggagctttgaaaactaagctgataaatttaaacaaggtggcgttcagaaggaagtcatcaggcagcttaagcgatgaagtgacatgaaataccttcagagagagtgagggtggagcctgttgagaacgcatcccaagaggccagacaggagactgctaccaataacccagacacaggtgacgggattggaataagaaaacagtgacaacagatattcaccgacaccttcctgatttgaggctctttgctgggtactaggaatagaagatgaataaggctggatgaattatcttcaaggaacttgcagtctactgaagaagacagagataggtgtgtaaagtgtctaaagatagcaggatagcaaccacaagagaaatatttatacaaaataaaggaagaagtaacggctaggataggaagttggagaagacttcatagaggcatagcagtggagaggagtgtgatagacagtgtgggataggtcactgactgggccttgggacagatgggacctgggagttaaaggagaaggaagagctgaagctggccatggaagcagaaatagacacactttgaaggcagaccccaagatacggggcagggactgtccttcccaggtatgaaggaaaggcctggcagctccaagttttctagcttagagaacctagagaatggtgatgctatggacaaaacaagataatgataataataatcagtaatgatggccagccacagtggctcacacctgtaatcccaacactttagaaggcaggggtgggaggattggttgaggctaggagttcgagaccagcctgggcaacataggaagaccccatctctaaaaaaaatgtttttggctgggagtggtgtctcatgcctgtaatcccaccactttgggaggccgaggcaggtggatcatgaggtcaggagttcaagaccagcctggccaacatagtgaaaccccatctctactaaaaatacaaaaaaaattagctgggtgtggtggtgggtgcctgtaatcccagctactcgggaggctgaggcagagaattgtttgaacacaggaggcggaggttgcagtgagctgagattgcattactacactccagcctgggcagcagagtgagactccatctcaaaaaaaagtttttaatcattatgaatacttattacatgtcaaggtctgttaatcatcatcataaacacatgggaattgctgttgttgttattctcattttgtggagaagaaccgagacatagagaagaggtagcagagttatactgcagatacaggtctggtctcgctctgtcgcccaggctggagtgcagtgacgcgatctcagctcactgcaagctccgcctcccgggttcacgccattctcctgcctcagcttcccgagtagctgagactacaggcgccctccaccaggccggctaattttttgtatttttagtagaaacggggtttcaccgtgttagacaggatggtctcgatctcctgacctcgtgatccgcctgtctcggcctcccaaagtgctgggattacaggtatgagccaccaagcccgactttcttttttttttgagatggagtctcgctctgtcacccaggctggagtgcagtggcgcaatctcggctcactgcaagctccgcctcctaggttcacgccgttctcctgcctcagcctcctgagtagctgggactacaggagcccgccaccatgaccggctaattttttgtatttttagtacagacggggttgaccgcattagctaggatggcctcaatctcctgactttgtgatccgcccgcttcggcctcccaaagtgctgggattacaggtatgagccaccaagcccggccacagctctgccttcttagaccctatactaagctgcctgaagaagtctgcatgcaggaaaatgatgcatctgaaataatttcaaataacaacaaggttttgtaaactactttcactttagccccaagacactttcccatggtggtgacttcttgtcaatccccaataagtaaaaatctccaaatgttgacaaataaagagaagttcattgtgattgctcagcacgacgcttcagcgaagtgacgaccggcatcaggtagttagcagtcacgcttcacaagcttccgtgagagcttctcacatgctcagcctctggccgagcatgtgagaagggcagggtgagacatgcagaaactctggggccccctgctcccctagagttcgtgaaagaagcagagcagctcctcaacctacatgagatcatgtttagtacaattgaagcccaagcgagtaatacccagcataggttagcatttgagctatttcctgcccacatggaaattacatttaggaaaaactattgaatgatgccgtaagagaccccattttgtgatattattcatttctatttggaaacagcaactcaaacaattctgaacatagggtcagcatggtggctggtggttgctatcatggaggaaacttttccagggttattcttggtctcagctttatcagggtacagaagagactgcaggtagttaatgtacttgatcgcagctctgagggtttccactttgctgagtcgcttctccaaatactcctctggcagatgatggcggagctgggcgtagccttcattgacacatttcacccgctgcctttcccgctcattccttttccgggtgaaggctggcccgtaggagtactcgcaccctctgtaatttggataaggcatcgggaaagagaaggggcagggttcactgtaatttcccaggataagagagtcgctgggaaaaggcagccgtggcagctcctcagagtaaggggatgacaccggggcctctgggtgcacgtggaaagtgaccatgggctccagatagaaggacctggtcagtggcaagcgggcagaatcagggaagataggaagtttgtcaggtagactagagttgcctctgttgtccatcatttcctctttaacctgcaaacataaccaagtttaacaatgtggtcagatagagagcagatatgatctactttcttggagatcaatgttttattttattttatttttcgagatggagtctggctctgttgcccaggctggagtgcagtggcgtgatctcggctcactgcaacttctgcctcctgggttcaagcaattctcctgcctcagcctcccgagtagcttgggattacaggcgtctgccactgcacccagctaatttttgtatttttagtagagatgggatttcaccatgttggccaggatggtctcgatctcttgaccttgtgatccgcccgcctcagcctcccaaagtgctgggattacaggtgtgagccaccacgcccggccggagatcaatgttttaaagacttttctgctttgatgaccaatttctgagctcatgtggacaatgagatggtgttataatattctgtgtgtagtaagaggatttttgatggtacacagaaacagcactaaataacattgaatcaccttatgagaaagttattgtccttccgttctttttcaatccttgtggttataaagatacaaccttagtctgctgagaatgtgtcttccacaccacaccactagaattcttttttttttttttttttcctttgagacagggtgtggctctgtcacccaggctggagtgcagtggtgtgatcatggctcactagagccttagcctcccaggttcatcaatcctcctgcctcagccacctgagtagctgggaccatacgtggccatcaccacgcctggctaagttttgtatgtttttgtagagacagggtcttgccatgttgcccaggctggtctcaaattcctgagctcaagcaacccgcctgcctcagcctctccaactgctgggattacacacaggaagccaccgtgcctggcctagaatgctttctaatcctcctaagatcaaagccttcaacaagcaatagcgtctagttagaattcagtgtctttactaacttctatttattgtgagttctagtaatttcacatttatggtagcgacataaagttcctttttttctttttttgagacagagtctcgcgttgttgcctgggctggagtgcagtggcacgatctcggctcactgcaacctctgcccccccgggttcaagtgattctcctgcctcagcctcccaagtagctgggattacaggtgcccgccaccacgcccagctaattttttgtatttttagtagggacggggtttcattacgttggccaggctggtctcaaactcctgacctcatgatccacccgccttggcctcccaaagtgctgggattacaggtgtgagccactgtgcccggccataaggtttgtcttaaaactaaatctacttgagtaagaaacgtgatttgatttaaagacaaagagtgagtaaataatagtacaggtggaacaaagatataatggtgatcgtgaagacatgcaaataaaaaaagtgtgggaaaggctgaaacaccaaaatacccaaatatatgcaagggaaattatgaattagttaatgatcatgcaacctcagaggcatagccttcttaaagaatacctgatgtgctagaggcaaaaccaaaaatacaaataaaaaaggaatcatttgctcttaaatgttcactatgggactcctttaggtgagaaacttcccctacacatttaaaacatagtcaatatacaagtttttacatatgtagaactgtaaatatattgagtaaagtgcagctatgtttaggtttttaaatttttttatttattttatatttttatttttagaggtggtgttttgttctgtcagccaggctggagtgcagtaatgtgatcatggcttactgcaatctcaaactgctgggttcaagtgatcctcctacctcagccttctgagtagctaggactgcaggtgtgcactaccatgcctggcttttttttttttttgtagagatggggtcttgccttgatgcccaggctgattttaaacctcctagcttcaaaagatcttcccacagcactgggattacaggcatgagccacttcacccagcctatagttaagttttgttggtttttgtgtgtgtgtgtttttgtagaactcaaggatgaagcagtataacccaagaggttccacaccaacgcatttcttctttgtgaataggtctatatccttctcctgttttaaactactgttactttttgcctctgcctgtaatcatgtagcaacaacagattttacagagccactgcagtgtaaccggttaacttggaggcggggggagaaagagctttttctctcagtcataacaccctcaggtttcaatatggccttaccccttcctagctatgtgtccttaggcaagtgtcttaacctctctgagctttcgctttccccatgtccaaatgagctactaactattctgcagggtggttgtgaggataaagtgaaaaaactacagttgaccctccatattggtgagctccacatctgtgtattcaaccaactatgggtggaaaatattcagggggaaaaaagggatggcagcatgggtactaaataagtactgacattttttcttggcattatcctctaaacaatacagtgtaacaactatttgtatagaatgtgcattgcattaggtattataagtaatacagagatgattgaaagtgtttgagagggtgtgtgtaggttccatgcaagtgctacgttattttctgtaagggagttggacctctgtggattttgttatccgaaggggagtcctaaacccaaccccccaggtacagaggagtgaccgtgcctataatgcacccagcatttgcctctttcctttctttagagatgaatgaatccttatgtagcgttcctttctaaactgcaccttatagaaaacctggtttatgttttccttaacactgtagagtcacagcactgatctatcctaaacacacatgttgagagatgaggaacatacctaaaatggagaagggaaagcagcttgaagtctaattgtgggcctccatcaaagaaggaaatatggtgttaatttctcagcaggttgatttttcagcatctttaggagtgaggggttattatctgtgcttggcatactaaacacacacacacatacacacacacacacacacacacacaccagtcctaatgtttagggcaagattagataatattggcacttgtttctctacctgaatacagcaaaaactcagcaggctgcactgtgtagtgggaggagcagcccctaagaccagaattcaagtatgaaggtcaggggactagggaaacagcaagggcagcaggggcaggggtgccgggagggaggagtggccagggttaaaggctatagtaagtcatggtgaaagaggctggaaaagaagtcaatgccaggaaaagctcttcttaaaagcgacggggtggtgggatgagataagtgggatagctccaattaaaaatcgaaacagaggaacaggaaatgaaagattccaaattactgaccaaatgacctaagataactaacaaaacaaaaatctctggaaaactaaaaactagccaggattctgtcaaaaagaaaaagttactgagagaaacaagttaggaaattcccaagccaggaattctagagggtaagagagaaagaacgggtatggcagaagctgcaaaatggtggcaaatgggtgtggagcccgtattactgcacttccgacaacagcagagccatattgttgcctgtagttaacaagctggaattaacaggctaccaaaaagtaaagcagatgtcatcaaacctaactatacaaaaatcgttcttttggtgatggttttaccctaaaagaccatttaaacaatatcttaaatcttgacccagatgaaatctgagtaatttgtatatgccacaagtaattaaaactttctaggttttaacaatattttcgtaattcttgaaaaaagagcatggtgtctctggaggcacattgatgagaagtttttttctgttgagcatttccaataagttcaccaatcaatgtactagcatttaaatatgatcaccttttattcaaagaagaaaatttaaggcaacagagtgagaaaatgaaataaaatgcagcaacaaggagaatcaagatagaaagcctagtggggtctggatgtgtttgtaggaattgagtataagtttttaaaagaaagcaacacagattggtagtgctggggctccatggttccagatacagacacagctaacaaacacacctatgttgggaaaatctcagattctgccttagagcgattctgggaaataaatgatgaggtcttaatgataaaattgtaagagattctggatgctctgctgagcataaaagcttcaaatttcagagatataaaagatatgtagcatgtaaaaaataaaaagctacaactgccgatataattgaattatggaatgttagagctagaaggaaacttaaaacttcctcataggttgtgatatgttgctaaggttacaaagctagtagcagagcaggggccagaacctagtgtcccgacttccaaatcaaaactccttctgctcttctagatgatttaattgccagcaaaacctggatcttccattatatggggaataattggtagtttgaaataatggaataatccgatagctgacaaaattcagtatttatcaactgtacctagggattttcttaaaaatcatgttcttattcttccccacgggccactctggagaatagtctcttacctgagttttgtcgtcaggatgctgtattttgggctgagttggacttaacctgatttataggtgatcatttaataacaatatgcaaagtagcttacagttaaacagaactgctcagttctggtttggctgtttttcctatccaatgtgtagatatgacaacagataaccatactaaatagaaaggcgtgcttacaaaactggatacttgtaacaaattcttttgtttaaagaatgtcccccattcttctgggttatatgatattatatcaaaattatttatggagcaatagactcataatgtgcaaatattggccagtattcttttagatagaggttaaggccagaactaggaaggtcaatacgaacttacatcttttttttactttttatttttttaaagccagttggatttagcagtggggactttagtgacacgaatgtggatgttaaattctgataacccagtatcataggaactagccaatacctttttcttaaatagccattttattttttcttcttaagtatacttttatctttttaaaaatataaatattagaagcattccttctctccttatttatttagagacaagatctcactctgtagcccaggctggaatgcagtggcatgaccgcagctcattgcagcctccacctcccgagcagctgggactacaggtgcgagccaacttgcctggctaatttttgtatttcttatagagatgaggtcttaccttgttgcctggctggtcttgaactcctggtctcaagaaatcccacccaaagtgctggaattatagactgctgcaccatgccgagtttaattttttttgagacagttttgctcttttgcccaagctggagtgcaatggcgtgatcttggctcactgcaacctctgcctccaggatcaagtgattctcctgcctcagccacccaagtaactggaattacaggtgtgcaccaccacacccagctaattttgtatttttaatagagatgggttttcatcatgttggccaggctggtctcgaactgctgacctcaggtgatccgcccaccttggcctcccaaaatgctgagattataggcatgagccaccatgcccggccccaactttaatttttaaagcaattgtaggttcacagaaaaattgaacacaaagtagagctaattctcatacactccctgcccccacgtgtgcatggcctcctctgctatgaacattccacatcattatggtactgtgttagaactgatgaacctgcattgatacataatcacccaaagtccatagtctacattagggctcacccttggtgttgtacatttacattctgtgggttttgacaagtatataatgacatgtattcaccattgtggtatcacagaatagtttcactgcctaaacatcttgtgctctgcctattcatccctcctccttctctaaccccttgcaaccgctgatatttctgtctccatggttttgccttttccacaatgtcagatagttgttaattatgcatgtagcattttctttctttcttttttttttttttttttttgagacggagtctcactgtgtcgcccaggctggagtgcagtggcacaatctcagctcactgcaagctccgcctcccgggttcatgccattctcctgcctcagcctccctagtagctgggactacaggtgcccgccaccacgcccagctaattttttttttttgtatttttaatagagacggggtttcaccgcgttagccaggatggtctcgatctcctgacctcatgatctgcctgcctcagcctcccaaagtgctgggattacaggtgtgagccaccacgcctggccgcatatagcattttcagattggcttctttacttagtagtgtgcatttaaggttcttccatgtcttctcatggcttgaaatctcatttctttttagcgctgattattccattgtctggttgtatcacaatttgtttatccgttcacctactaaaggaaatcttagttgcctccaaattttggcacttatgagtaaagctgctataaacatctgcatgcagggttttgtgtggacatgatttcaactcattgggtaattattatggagcacaattgctggaccatatagtaagggtatgtttagttttgtaaggttgctgtaccattttgtattcccaccagcaataaaagaaagttcctgttgctccacatccttgagagcatttggtgttatcagtgtcgtagattttggtcattctaataggtgtgtattggtatcccattgttgtttcagtttgcatttccctgatgacatatgatgtggaacatcttttcatatgcttatttgccatctgtatctcctctttggtgaggtgtccaggacttttgcccatttttaaatcaaattttttgtcccttattaagtattttttgtatattttagatagcagtcctttatcagctatgtcatcaccaccatctagatcttctcctatgttatcttctgaaagttttgtagttttgcattttacatgtaggcctatgatctattttgaattaatttttgtgaagggtacagggtatgtaactagatttctttgcatgtggatgtccagttgttccagcaccatttgttgaaaagactatcttttctccattgtattgcttttgctcctttgtcaaagatcagttgactgtatttatatgggcctatttctgggttctctatcctgttccactgatctgtcttttttgccagtagcatactgtcatgattactgtagttttatagtaagtctcaaaggtagtgttagttttctgactttgttgttctcctttaatattgtgttggctattctgtctttggcttttttataacctttagaataagtttaatatccacaaaataactttctgggatattgattgggattgcattgaatcaatagatcaagttggaaagaaccgccatctaaacaatattgagccttcctattaatgaatatgaaatatatcttcatttgtttagttctttggtttatttaatcatttttgcagttgtcctcatatagatcttagatacattttactaggtttatacctaagtattttattttgggggtgctactatgaatagtattgtttttaatttcaaattccactgtttgtggctgatatataggaaaacggttgacattttttagagacagggtcttgctgtgttgcccagactggagtgcagtagctattcatgcagcaatcatagctcactgcagcctcaaaactcctggcttcaagtaatcctcctgcttcagcctcctgagtagctgggactacagatacatgccactgcacctggtttgattgacttttgtatactaaccttgtatcctgcaagcctttataatcacttattagttctattattgttgttgtcaattcttctgggttttctacatagacaatcattgcatcagtaaacaaagacagttctattccttccttctcaatatttataccttttatttccttttcttgtctcactgcattggctaggacttccagtacaactaggacttccagtgcaatgttgaaaaggaatagtaagagaagacgtcctcgccttattcctgatcttaatgggaaagcttctaatttctcattattaagtatatgatgttagctgtggtttttttgttagctcatttctttatctagttgaagttctctattcctagtttcctgagaatttttatcatgaatggggttattttgtcaaatgctttctctgctattgataaaattcatgtaatttttcttctttagaaatgttattttcaaatgttgaaccagcttttcatacctgggataaatcccacttggtcatggttgaaattaaattttttaatactaacaataaaattgataatttatatatttgtaggtgcttaaaattttactaaaccccaaaatcccattaatggctcctaaaacctcacttttatgaatttaattctgatttttttgggccaagaatttctcagaacaagtactccttcaggaatttgaaatctcccaatttatcaaaatattagtatacttttcagagatccacccccaaattcatatattctgtctatacatgcaaacacataatttacaccaatattttacggttagattggtataaaacagtagtctcagaacagggtacaaaatgtctttatatcttcaatctcattatacagcaaaagagggaggaggaaaaaactaggagacatagatagatacactgatggatgtttcaaaaattatttttattgttacattccaaagaggacataggaagaaaaaagccagttatccaataatggttagacctttcagaagaggcacccacaaccccagccctagttcaaagctgcacacattggagctcaaacagctgcctctcaccacgaccggaaatgctgacaaatgtgtatatattatcaatccagggaggcttgggtttaaaataaaatttctttattgcaagtgtccaagtccttaggatttgtccttaaaggtactagaagatgagtaagaccacacacaccaagactatgtttagtctttagagtaaactagcaaatggccagtttgttctaggatgcattgcatcagacatcacagtacatgaagaaaatctgctttttgtgaaaagccaccaggcattttagatcccgtttaccatgaagtgcagacacagcagatacccagataatacagtcagtgcaaaagtcaaatgagtaagtcagctctttgatgaggctggctacactgcaaaatataaatgaaactcgaaaatagaaggtaaggtctatttacaaaagtttgtttagtaaagtgacttgaaaaaagttgttaaccacttcccaggcatccctcccctctcccaccaaaacaaacaaacaaaaaacaacaacaacaaaaaccctgaaaattatcttgaaagtcaagttaaaactatgtggtgaaaaagagagtgcttgttccaggtaaaggacttcaagataatttacaggcagatttatttttattagtaaaagtcacaaataggaaaagacttattggctgactttgagctgtgtgcttttaaaaatgtctctattattacgttaacaagaaaaaaaaatcaagcaagtttttgcttccagttttgaatcttccagcaacagttggtgaaatcaacaaggtattaaaatgaaacccagcaaaacccagtcagttctttccagttgtctgcctgtttctttctagtcaccttgaattcaattcccaattagctgaggacaacatgccggtcaaagacagactttcgctgctcttggacttgaagcttccagcgctgctgtgcatattctaccttgttcagcacgttggctcgactgcgggagcgggctagcacatcgtgtgcatttgcaaaaggctggtgatcctaaaagtccaggaatggagaacattagagatggcacagtcagtgtaaaacatagacacacaacagtgaccagcccgccacagaaataggggtaggtggacttttcaaacaacagagcatctatttagctaagcactcctaagcgctcaactaccagatagagtatgaactcaagtacagacctaggtggttcaagaaacataagcgatgacagagtatttgtgaaacgttcccatggattgccatttccaaagatatttcccttaaagaagtggagaccaagcaaaagacagtggtcatttgtgttaaagagaagccttccttaactgatagggaaaagaaaatctattttcatgttaacatctctccatgttatagatatggaaagtagggtctttccttgctttattcgatactataaagctaatctgtggcagaggaaagatctgtcttttaatttcctgtctccattagaattgttttcttgccagcttggggccacatcactctgggagggtgagcgacagagtcttatcttgggttgtttttaatctctccctgtaccctcaacacacacactaaatggattagcttccaaaagcttcctcatttccccacttccccaatgtgtaatgaaaagagacacagctcaagtgctacaatcaccctctctattcaacaaagattgaatcttccattgttaagcacccagtggcttccatgtaagttgctgccttgggaaagaggctattgaagggttgcccaggtatctgtatagaaaaccaacctaacctggtcaaagtaaacgagtacaactggatgtttgtagtcattacacaggaaaccaccatgctaatctatctatgaatgagatataaacacagctgtctaaatgacaaaaagcattcaatagtaatttattgcttttgtttgccttttccttgatctctttttcttgaaccccgtgttagcaaagcttctcaatgttccaacagaagatccaagtcacaagttgtacctcttatactaaactttgcctctaggagagaaacaacattattttgctgtgcatgtttgaaaaagctctattatatatccagggcaggagtctgcatgtatatggaaagctatatacataaccacataactatatatacaactataattataggagttagaacacctggtcttgtttttatagcaaggcatttatacaatgtctacatttgaaagatatcaaagagtttttataaagaatctttcctcctcttctttgtcaaaattccttcaacttttcactttatttaggtaatggcttgtacaaatcctaaaactcaagttatttaaaaagtggattttttttttttaaagagatggggtctcactatattgcccagactggccatgaacttaattttttttttttttttgaaatagggtctacccatgttgcccaggctggaaggcaggggctattcacaggtgtgatcacagctcactgcagccttgaactcctggcctcaagtgatcctcctgcctcagcgtcccaagtagctgggacctatagcctatttttaaacttttaaccttacaaatgaaaataataaaggcaatttcatgaggcttaaaatgttttaaaaaatgtaagaaaaaagctaaaaaagaaaaaaaaaaaggaggcaggctaaagttatagaattgcttgattttccattatggcaataaattgacccaaggtcatttaacaaattagcataaagactaaaacttagcctgcctaaccctgacttggtgttatattgtctcaaaacagattttggtcaggtagattaaaatgacactataagaatatggtgcttcagtgaatttgtgtataaaatatcatcccctgaagtcaaggaccagaggaggaaaatattatcaccattggtttgttttgacataagcaatactgggaagaaggatgtacttgatcggcagaggacctctcagttgcctagtgctgttatctattcttcaaggtaggggagaaaaatcttcttaaggaacaagttcaaaagactaaacaaaccagctaatcctttgggtctgctctctatccatcagaacgagattgaactagctgctcatggtcacagatgctgggggaatgcaaatagagatttaccctttttatgtttgttcttttcacacctgataaaattacaataaatacaaaacatgttttactgtaatgctttggtaataacgatgatgtgtcatggatatatgatatagtaaatattgtgactacttgcagtgagcttaactatttgtactcacttttatttgctttaaaatgctctacactgaacaaaaacagaaaaaatgaaaactgatagttcaacaaaaacatttttaaagtatataaatagtgcagaactcacatcttggataagcaacagttttaaaaattaaaattcacttatttttgtagagttgttaccataaattcacagctctggtcagaaaacctctctgcctagaatcagtttaaaagacatccaagagtcagccaggcctcacagagacagtgttctcaaatagtcaatacacaagcagaatcaatcactggtggacaaaacaattactgagcatgtgatcccaccaattaaatgcctgccctacatgttttcatctctacatccatttctcttatgttttgtgttattatattgtctatttctgaaatcaggaacagatatttaacgctgtaaaggaaggatgtcgtttaagactttcaacgtctatgcctatagatgcacgagccattccagggtaaaaggacttttgactggctggcaagggctcactctgggtttggcttttgaattgaaccttaaaactattctgaattttacccattttaaggaacatagtccaatataataatccacgagaaaaagtaatttctaaaaaaataattatatataataatgaaagaatggaaaattcagctgggtgcggtggctcacgcctgtaatcccagcactttgggaggccgaggcagggggatcatgaggtcaggagattgagaccatcctggctaacacagtgaaaccccgtctctactagaaaaaaaaaatacgaaaaattagccgggcgcgatggcgggcgcctgtagttccagctacttgggaggctgaggcaggagaatggcgtgaacccgggaggcggagcttgcagtgcgctgagatcgcaccactgcagtccagccggggcaacagagcgagactgcgtctcaaaaaaaaaaaaaaaggaaaattcagaaacaatttcatacagggtaatgatgaaacaaaaatatccagccaggcgcagtggctcacacctgtaatcccagcactttgggaggccgaggcgagctgatcacttgaggtcaggagttcaagagcagcctggccaaaatggtgaaactccgtctctactaaaaatacaaaaaaaattagccaggcgtggtggcaggtgcctgtagaaccagctacctgggaggctgaggcaggagaattgcttgaacttgggaggctgaggttgtagtgagccaaagtcacgccactgcactccagcatgggcgacagagtgagactccgtctcaaaaaacaaaaaaaacattctctaagctacactgaaaaacagatttgtggactaagtcaatttctggacatttttgaataaacgaatattaaaacaaaaaggagaccatgaagcaatttatacagattatgccaactatatacacacacacacacacacacacacacacacgctatatatatatatatataaacatatataatgtacacacgtgtgtgtgtgtgtgtgtgagagatttaaagacaggaagagaatctggagtgatggtagtcatggttttatttttctctaaagatctcagattttttttttctttttttttaaacaggcttcttgctgtgttgcttaggctggagtcctatggtgtgatcacagttctgcagcctcaaactcctggggtcaagtgacactcctgtctcagcctcctgaatagttgggaccacaggcatgcaccaccacacccggctaatgcttttattttttgtagagacagggtctcaccatgttgaccagggtggtcttgaactcctgggctcaagtgatcctcccaccttggcctcccaaagtgctgggattacaggtgtatgcccccacacctggcccacagatttttttttaagcagtagaaaaaaaggaaatataaaacatcagcaggttatcaagttgtacttcattaagaaaagaacatcatgatcttcacacttcccttgatgaaaacctctctgccttctaaaatatttggtgatattgacagagaaggtgtttcaggcaggagagcttggagagaaaaccatctctgatacttttctcaatgtaaacagggaatggcaataaaattgtgcctttggtactgaaagcaaggccctgtatagcatgctcaccaaagatcatcgtttaaatcatcacatttatggcttcatcaagcaatttcttcataaagaggtatatactgaaatcagagctgtttttagcttctctagttgaggatctgcttcagcacgtgaacatctatatatgactatttttcacttgcacttcacatcgaatgatgacagggactggccatgagcagctagggcaggctgggaacttaccccaatatcatcatcactctgtatcaactgtgcatgtccaaagaggcgcctcttcagtatgggctcaaccagagtaagatataccatgtacagaagtagaaggcccaaaatggagagataaattataatggtaacctaaaggaaattgaaaattaagttacatctttgttcaagcccataaatcagaactttgtatgataatagtaaaactgactgacatatctgctaagcctataggatttctatacaaaccagatagcaatataagaaataaactcaactcttcaccaaagtattatttaagaaaaaaagaggaaagatctttgggatttttttgcaagtcttcaagactccaacttcacctactgctaatcacctgtcaccactgctagcacagcagtttgtttcttttcccagctgaacataatgtcctaaattcagctactctttagctcaatttagatatacaaaagtattttctaggccggtgattttttcttgtgaccttaattcatgtactgagaaaaagtacagtgtgacacacccactagaaggactacaataaaataaatagacaataccaagtattagcaaggatatggagaaacagccctcatacgctgtggtgggaatgtaaagtggtacaaccactttgggaaacaatctggcagtctcttaaaaagttaaacataattttaccattctaaggaattaacccaagagaatggaaaacatatatatccatacaaagacatatgtgcagatattcacaacagtattattcataatagtaaaaacccagacataatccaaacgtccatcaactgataaatgcatattcatatagtgaaatactattcagcaataaaaagaaacgaagtactgatacatgctacaacttgcataaacatcaaaaacattgtgctaaatgaaagaagccagtcacagaagactatatattatatgattccatatacatgaaatgtccatgtatgcagagacagaaagtagactagtgaccgagtagggctggaaatgggaattaactgtaaatgggcatgagggatctttttggggtagtgggaatgttctgaaactggattttatttttttttttttgagacagagtctcactggagtgcagtggcacgatctcagctcactgcaacctctgcctccaggatcaagtgattctcatgccgtagcctcccaagtagctgggactacaggtgcgtgccaccacacctggctaatttttatatttttagtagagatggggtttcaccacgttggacaggctggtctcgaactcctgacctcaagtgatccacccgcctcggacttccaaagtgctgggattatagatgtgagccaccatgcctggcctgaaactggattttaaaatgttttaaatctactaaaatttatagaattgtatacttatagtgagtgacttttagggtacataagttgtatattttttacaaatctgttaaataatagtacagtgaggatttatctaaagttcagcaccctgctggagcaagagctcttccacagggtcaatcacagcagaaatgtttgtgactattataactaaccaccccacattccccacagggccttttggggggaaaggaatgggaagtgccatgtaaaaaaaaattaggccaggcgcggtggctcacacctgcaatcccagcactttgggaggccaagatgggtggaccacgaggtcaggagttcgagaccagcctgaccaacatggtgaaatcctgtctctactaaaaatacaaaaattagctgggcgtggtggtgcatgcctgtaatcccagctactcaggaggctgaggcaggagaatcgcttggacccaggaggcggaggttgcagtgagccaagattacaccactgcactccagcctgggcaatagagcaagactccatctcaaaaaaaaaaaaaaattggaagaaaaaccattagccactataataaagtaactgaactcattagaaatacaaatggtgatgagagtgatctacatcccatttactacagcaatactccacaacctttttggcaccagggacgggaccagtttcatggaagacaattttttcatggaccaggggtggtaggggatggtttgggtatgattctagcacattacatttattgtgcactttatttctattattattacattataatatataatgaaataattatacagttcaccataacatagaatcagtgggagccctgagcttgttttcctgcaactagacggtcccatatgggggtgatgggagtcagtgacagatcatcaggcattagattctcattctcataaggagcatgcagcctagatccctcacatgtgcagtccacaatagagttcatgctcctatgagaatctaatgctgctgctcatctgacaggaggtggagctcaggtggtaatgcgaatgatggggagcagctgtaaataagatgaagctttgctcacttgcccactgctcacctcctgctgagtggcccagttcctaacagaccacagactgggctgtggcctgggggctggggaccactgtcctacaggaaatgaagaggggaaatcttaaaatccagaagtaatagttctagaataattactatatatttaattttttcaaagggctggaaaggcaaggagaggagggcttataaatgctgctctctcagcctctggcacacatggcctacacagaagctgggatatctttctggaatatgctaattacacatagggcatttttgtgccatttcacatatctatctaacataccctaactaatccacaaaccatgtcagtgaggcaggcagaacaggcccattattccttttggggtaggggtccaaatttttctgtcttgtctagaaaccatccagaagcagaaaagacgtagacagacagacagacaggtagatagagggatatatattttaccttgattgtgacagagcttctttcttcatatttgcattcacagcgtagacagtatgcttctacatcaggcccccgcacaggcatgggctccacaacatgaaggcaatcactgaaaaaacaaagataaaatgctgcttaagcccagctagctcttctgcttgctctgaccaaaagtttcctgaaatctagaataatcactaaacttacccaatgaaagagcataaaaaacaaataatcaataagataaagtaaaataatttctgctctcaatattagcattttggtaagttttaaccatttaagaagccacaaagtcacacatatagtagtgtctattttcaaagctgctactgttaacagttacaaaaacgcacacaaaaaatcccaaatgggatgaaaaactacttaacaaatcaagtcacctttagacttgttcagttactaaggaaaactacttaaaatggtttaaagtgatatggggcactgttcaaatataagattatctcttttgtgaattaacatcattcttttttgttgttgttttttaagagacaaggtcttgctctgtcacatgggctgtagtggagtggtgccatcatagctcactgcagcctcagactcctgggctcaagtgatcctcctgcctcaacctccagagcagctatgattacaggagcctgccaccatgcctggctaatttttagatttgttgtagagatcaggtcttggtttgttgacctaacttgtcttgaatacctggcctcaagtgatcctcctatcttggcctcctaaagtgccgggattacaggtgtgagccaccgtgcccagccaacatcattcttaactgccagtgtggtgtatgaatgactaaccacgtttaacagcgtggtaaattctgaaactctgaaaattgaaccctcaaagccacacacaggaagaaacaatcacttttcttaatgagcaaatctgaaaaagcaaggagaaatagaataactaaaatattttaaaacaaaaactggttattccaaagaactaaataaaaactaacaaagggatgagtgtttttgttgaatgttacttatttccccaaccccattttcaaggctaattatttatggtttgtgtaaacacagtgctatcagatttttcctagaaatctgtcaattctaagcaataactaaattattattctcctcaactattaagagtctatgactctgatcaccttcagcaaaattagggaaagctttcctgtcctcctgccagctgttggacaattttctttccttttggcatctcttcgttaggcattcctggctgcctcaagcactctactacaccatcctatcttatcttacccattctcttggggacacccaatactctatagagtgattccttctctttccccaccaaaatgtactttttggaaacaaagttacagcttggtgggaggaataagttctagtgttctatatccctgtaggatgactatagtcaacaataatatatattatagtttcaaatagctagaaggaggattttgaatattttcaacacaaagaaatgataaatgtctgagatgctaaatattctgatcaaatcactatatcttatatgaattgaaacatcactatgtatcccataaatacgtacagttattgtgtcaattaaaaattaatttcagccgggcgcagtggctcatgcctgtaatcccagcactttgggaggccgaggcgggaagatcacctgaggttgggagttcgagaccagcctgaccaacatggagaaaccccgtctctactaaaaatacaaaaaaattagccaggcatggtggtgcatgcctgtaatcccagctactcaggaggctgagacttgagaatcgcttgaacctgggaggtggaggttacggtcagccgagatcgtgccattgcactccagcctgggcaatgacagcgaaactccgtctcaaaaaaaaaaaaaaaaaaaaaggccgggtgtggtggctcacgcctgtaatctcagcactttgggaggccgaggcggttggatcatgaggtcaggagttcaagacctgcctgaccaacagggtgaaaccccatttctactaaaaatacaaaaaattatctgggcatggtggcacatgcctgtaatcccagctactcaggaggctgaggcaggagaatcacttgaacctgggaggcagaggttgtagtgagccgagatcgcgccattgcactcagcctgggcaacagagtgagactctgtctcaaaaaaaaaaaagttaatttctagaaattcatattttcatgttctgttccctctaaactgtggcattagaaaaaataaccaaaacggtatatgatagaagttgttaggttattctttttttttttttttgagacagagtttcactcttgttgcccaggctggagtgcaatggtgtgatcttcctcaacacaacctcttcctccagggttcaagtgattctcctgcctcagcctccctagtagctgggattacaggcatgcgctaccatgcccgactaattttgtatttttagtagagatggggtttttccatgttggtcaggctggtctcaaactcccaacttcaggtgatgtgcctgcctcggcctcccaaagtgctggcattacaggcatgagtcaccgcacccggcccaggttattcttaacaggtaatttaattttaacaaaggtagtaatgaaaaattaaatttccactgatggtatttcaaatacgggtaaggccccacaactctcaccataaaagtgtgtgatatctgttccaaatatacagaagaccaggcatgtacccaactggatgcaggcacaaaatgggcagagggaactatatcccataacaggtgttatctatctgaggatcagagagctcatctagcctcaggcttagagaaggtcacagagtaaaatcatatttgaaaaaggatcaggccacgcatggtggcttatccctataatcccagagttttaggaggccaacatgtgaggatcacttgaagccaacttgagaccagcctgggcaacatagtgagacccagtgtcgacaaaaataaaaattagccaggttgatggtacacacctgtagtcccagctacacaggaggctgaggctggaggaccactggagcctaggagatcaaggctgcaatgagctatgatcgtgccactgcactctagcaataaaaaaaacagaaaggaccagaatccaggactcctgcttcctacgtcagttctttacctctgaacctcgggaaaatgaaactgatctatttagtttcctacttcagcttcagaagctttggcaacaatacctaagaatgacttgggaattttaagtgctaagtaagtattgagtatttcttttgaaggatatattttaataacaaaaagatacttgagtgctgtgcaaaagttgtgcccagctggagagaaagcaggaaggttgattttggctgaccagtcattacaaacagagctagacctagtcagaggttaaccacttaaggaactaggcaacacctccccctagtgccaaaagtaacacatcattagctttaaatcaccccaaacacaaactagagcactccaactactcttaagttttaagtcagccagcataagtcaatgaagacttaaagataaaaactggacaaaatgaaaggcccagaaaacaaaaggtaaaactatatctaggccctcacagatactggaggcctcgtaaagccataattctggtgaatcataacttgcctgccccgtaaagtcagttaaaatttttcagtgccagctgggaacttatccctagaaaaatgctaagctgcagaaaagaaacaagggagagtgggagagagggaagaaaaaccccaagcaagccttattctcaactgtttattttctttgtttctgttttttttttttttttttttttgagacagagtcatgctctgtcacccaggttagagggcagtggcacaatctcagctcactgcaacctctacctctgcggctcaagcgattctctaccttagccttccgagtagctggaattacaggcgtgtgccaccatgcccagctaatttttatatttttagtagagtcggggtttcaccatgttggccaggctgttcttgaactcctggcctcaagtgatccacctgccttggcctcccaaagtgctgggattacaggtgtgagccaccatgtcctgcctcaactgttttcaaagccaaagctatttttactaataaccaggggttaatgacatatggtcctgtctgagtctgaaataatgaaaagttagtgaaaagattagtgctaaccacttgaatagtgagttcatttgctactcaaaagacaggcattgcatttcattactgataacagaataaactgtaagcactgaataaatttggaaaatttatagaagtaacataaagatttatttgaacattctttttttttttttttgagctagggtctcgctctgtcacccaggctggagtgcagtggcgcgatctcggctcactgcaagctctgcctcccgggttcaagcgattctcctgcctcggcctcccgagtggctgggattacaggcacccgccaccaagcccggctaattttttttgtatttttagtagagacagggtttcactctgttggccaggctggtctcgaactcctgacctcaggtgatccgcctgcctcagcctcccagagtgctgggattacaggcgtgagccaccgtgcccggcctgaacattcttgtatcatataaagtaacttcctgatataaaacctttaagaatatggccaaatcgcttggttaatatgacaccacttacagtggaacatagaggttcacaagaagttctcaagaacacacttaacaaatatgagactgaacctaaatgcgtatcagggaagaacagacagtggcatcagagaaactaaacatactcaaaggctgccttttcttttttaaagtcaggttggaatactgttaactgaatgaatttaatcttgctttctaactctttgatggctatttagctatgaaatcagatacacgtgaaagctcctaccatttggaactatttttcctaaattcctatcccatccatcttccaccgtggttacaaaccataaaacatcacaattctatgggaaggaacacattcatcctgctgtaatacaactgcatcccaactgcttcatggcacacgtagaaaaagctatttgtcaggtctgctgggataagcagagaaggctgctggtggctagtcagtcaggatcccccagtcatcacaggcctgcctgactgcccaaggactgaacaggtcaatatcttggcacaactgtaacttcttcatttacaccaaatgggaaactctgactacatagctcatttccacttcttcttgagccttctgacacttttaaacatagcttcccatacttggcaatacatcatcaaaacctacaagttgtaaaaattataacccagacaaacgaggcttgctaaccttccactgaaaagcaagagggagaaaggtccctcaccaaaacttgagggagtacagcaagatagctatgggtagtttaggtgccacaaacccagtcatatgctcccatgaaactctgcctacatgggtcttagtgttttggctgtatacctttaggcctgcaggcatcatgcacgtagggcctcactctcactttttcaaatggaagtagaatttcacatttttgcttcaaatgaaatacttaaaaagaaaactatgcatttgatgaacattctgggataacactgacaaccacagaaacaaatgtgacaggtaattcagtaatccagatacttaccaatctttctgagatatgttcttattataaatatgcccagaattttctttatagggagggcagatacatttacatctgacatcctcgaaattctgtaaccaaaatggaaacagtatagtgcgttgacagtttatcatcaatatttttaaaaactgtaccatatacattttgccaagcatcctctttagaataccaagtattctaaaatcattcatttaaaactttaacagacacagtttttaaaagccacagtcctttatggtaatgccaatgaatcattatatattacatgtagttattttgaaataatacctaatacatgatctaagacttattaaccatatttatgggtcacatgacaatcaaattatgttaatgttattaccatctatctgccactagaaagacacatggtaagcagatagttgtgcctgtaaataagaatattcattactaaaggatgggaaagaaactaaaaattattcacaaaaaaggtcacaattctacctatcatcctttcaccctctggtagaaggcactgacattgataaaacgggttgggccagagtcccgtagaagggatgaaatgttagaggcacccacctacaactagaaaggaagtacacacaggaagtagcctgactctgagatcagtttagtatactcttcccaggaaactttgcttctaattcctggttgacagacagaacaactaccaacaaaacaagtttcaagaggtggaggaacaggtgactaagtatctggatagagaaaagaagagatgcttcctcagcaaaggggaatctgtttgagaaggaagtggcttatcattccccagaggaccttgcccactcctcctatatacagtgatatgtctggcagagctattgacaattcacaaacgtattcagcaaccacttagtgagcatttgctctgtgttagatcttgtgctcaataaggtggattcagataagcataagacatggtttctgcccataaccaggacacaccctagtaaaggagactgaaaaataaatacatgatcacaatacataaagttatgaggcaagatatgcagagggtgccagcaatgttttcaaagtcaggagacgtgctgctgtccctgtttctggtaggaggtagagatggtttcaaaaagaatctctgaatcaaaaacatttgcctgcctgtaacctttccccactcctacatttaaagatattataaattaaagctcttatttttaaaaacgcaatgtcattctgttttcccatcatactaatgtgaatcccttctgttctcccccaatgatgagctagctcatcaaagaggaagcacaggtatgcatggagctagggcaggtctggagagctggggcaccagagaacagtatgagggaactagaaggtcaagaaatcgaaccagggaggccacaacctcacctctcttgcagtttggttcttcccttacccactaaattatcaggaagagagaaagcaagaaaggcaccaagggactcgtggagggagttaggtgagaatatgaagcaggtgagagatgctccgtaggccctattgggagggaagtaggccaggaggggcaagttcccaccacaggaagggaagtgttcaggggtgagctgagctgagtcggcccttgacagggaaggctctgtcagatgggggcttcctatcattctggcttggggcatgcggggcctgtgaggctggcggagggcgcaggtgggctgtcaagagcttagggtggaaagttaaaggctctcggaggtgaaaaggttgtcaagtgtaagatgcgtgcagccggggctgggaagggaaatgttaaggcggtggggggctgctgtccggactgtgggcactgtcggggctggggacgaccgtggggcgctgcctgccaggctgtcggggctgagggcgagagtgccgccgggcagtcgggaggggcggggctggtggcggcgggggtctgccggagctgtgaggccaggcgtatggctgtcaggaatgggccaaggagcaggttggcagacccagtttccgcaaggccggtggtaggggaggagcttccgtcaggagcgaggctgggcgggactcaccttggcggcgtctgacagctgcgccagcagcagcacggaaagcgccaggcacgacaggctgagcaaggagccaagccgaagaaggcctccccacagggtcgccatcgctgggggcccagcggtcccacagcccggagcccccgcgaccggctcccggctcgggctcaggctcaggctcaggctcaggcacaggcttgggacccggctggggatcctccgcccgcacttccgtctggacgcgaaggcgtcaccgggcgcgccgggtcagatgcaaaaagcatccgccccggaaccggttaccagtgcgaagggccgggaggctgggcagtcctggtgcccgccttggcctagccccggccccgggacggaagggggcctctggggtggcagcctgggcccagtagagctttgcatctcttggatatctttcccgggcgcagaagctgcggggcttagggagtcgccattgcgctggaaagtcctcccgcccacggagaccccagcaaactccgagtgtcacacagtcgcctctggcgacccgtgcgggccggagccgttcgcgcacaggcagggcgggtgctgagcgtggaaacggggctggaattggccgagccatgcctttccgggatgcccaccgccagtcaaagggttgggggtggtctctgcaccttaagtactaacctgccgcccacgcgcctcctgaccacagcaccccgtcggctttctaattctgtgagctgccctcgtgggcgtggcctccctgtggagctccccatgtgcctccccttggtccagcctgcagctaggaagtgggtcacagcgacggggctgggctgggccaggccaggctccgggagatgtggaattggcgaaacaactgccccagtagtatcctccgcctaggactccaagaggtggcgaattggggcactacgcccgggtaaggcagtgcctgttcagggctgccgacctgtctccccagggctgtcattctcagcaagtactttaggagtgccttagatcggcacattctcccattgaaatatttttgttagtggagacaagggaggtaatggcaaggacacggatcatcacagcccctagggatttgttgaatgacctttggcaaatcacttcccttctctgggcctgtagttcttggctgaatatgagggaatggatttcaaattatgctccatgtaatacccgtgtttttacctctgtaaacagatttttttgttttttttgagacggagtctcgttctgtcccccgggctggagtgcagtggcgcgatctcggctcactgcaacctccgcctcccgggttgacgccattctcctgcctcagcctccctagtaggtgggactacaggcgcccgccaccacgccgcccggctaattttttttttctttttctttttctttttttttttttgtatttttagtacagacagggtctcactgtgttagccaggatggtctcgatctcctgaccttgtgatccgcccgcctcggcctcccaaattgctgggattataggcgtgagccaccgcgcccggccccaacagatttttaaagatggtcttttcccaatttgtggaaatgttttaacagaatgctctcaatatttttcgcccatgtgattcttagattcatgtgaatctaacacaacgtatctgatactgttcccaacaggaaccagggtggcagggctagatgtcctctcaccagactgcccagtgaaggtgctgtcactttgatgaattatcaaggctttgtagtgggtcttctactggacaaaggacaaactggagactccctggatcaaatgtgttggtgaggcactgaatctgattgctgaaaggtgattcagctgcaagttaggcatcagtttagggttttctaggcttggcatctaaagggagtgcctgctgtagctgaaacctcataggccttctcttccttccgaattgttttcaaggccttgggggtacagagacttagagaaaatacatagttgtgcctcagactgatgggcctcatctgtttaatggagaaacaccaagcacactcagtctgggcggaattttagagctccatagtataaccactatctagctacatgtggcaattgagcatttgaaatgtggctagactgaattgaaatgtgctgtataaaatatacacttaatttcaaagacaatatttttaaaatgtaaaatatttcagtaatttaaaaatatggtttaaatattttagatatgttgggttaaataaaatatattagtaaaatatttcacttgttttttgacctcttaaatgtggctgctagaaaatgttatagtgctgtcaggaagtgctgttctggaatacagaatgtggctgccgtgagtggagtgtgactatgagatagtcgcctgactggagacaatgaagcctcaggccaaggtaagagggctgacaaggaagaactggcacaactagagccgaatgtttgggggaggtatatgtctgccaaaaaatgaatataatttcaggtgactcaatagaagtggagggatcagtttctcttgttctgccctgctcttatctaggtaactcttacttttcctttaggtcagggttcttctaagccagaaaaccttcactgacttaagtgcactcctttctatgtttgcatagatctctttcttaactttaccccattatagtaaaattatgttttcacatttgcctttatacccaaacctccaccaaaatattgtgagctctctgagggtaaggactttgtcttattattgttatacctggagacagattaaaacaatatgatgtttgtggggaccagggaaaaggggaatgggagaggctcctctggttagtctaaaagaaaagtatcaggcacctacttgaatcctcatttgatttctttctgaccatgagaggggatgctgagatgcccaaagatgtgcaaatggcgggatccggcgcaccatagtaggcaggggagtgaagatttctcacctcgggtcttcctagaccttcaggtcacacgggaattgttctgtttatagacggcgctggccttagtactcactctccctctattttccttgcttccttataactaggtttccctactcacttcctcaaaaagagtgatgtaggtccacgtgtaccctcccaactggcctgggtcctctcccttctttgtaaggcctgaaaaattccctggtgggggatggttagaaaaggaagaggaaccttctttgtaagtgtgcaagtcagaaggggagggagaaaagtgacaatttatatatctgggacaaatatatcttggacccaggttttgccacctgtctgcatccccccatgccctttcccctccagtgatcaaatagctctctggatgccccttaattcttccaccccatccattctgatctacccagcacttgcctaggcaacaccagtccaggagaacaaatggagttatgcacaacattggtgatttccttgtattgtggctccagtggttatggctggggacacacacatccttccagttatttctgagcatactctggaaacgtcttatgagccctcttctttattgtgtgcacccactaggatgctccctcctactcagccctgtttagtgggatttttcagcccactgtaaagcctactgctgcctgtaaagccacctaagtgcatcacttgctggtgttcaccatgataacaacaatttatggggacagaatatgtttctagagctgctggtgccactgctgatgttactgggttccctgaaataaaacaccacagtgcaggtgagtaccaaagtggggagaatttttagttccttttagaggtgctaaatcaatattgttgatttcccagtaccttagaatatttaatgaaaacaggtcaggtgcagtggctcacgcctgtaatcccagcactttgggaggccaaggcaggtagatcacttgaggtcaggagttcaagaacagcctggccaacatggtgaaaccccatctctactaaaaatacaaaaattagcagggcgtggtggcaggcacctgtaatcccagctactccggaagctgaggcaccagaatcgcttgaactcaggaggcggaggttgtagtgagtcgagatcatgccactgcactccagcctgggcgcatggtggctcatgcctataatcccagcactttgggaggctgaggcagtcagatcacttgaggtcaggagttcaagaacagcctgaccaacatggtgaaaccccatctctactaaaaatagaaaaagttagccaggcgtggtggcaggcgcctgtaatcccagctactcaggaggctgaggcataagaatccttgaacccaggaggcggaggttgcagtgagctgagattgcaccattgcactccagcctgggcaacaatagcgaaactccgtctcaaaacaaacaaacaaacaaaacaaaaaaacttaatgaatacagtccctcctaagattttcaaataaatgaaataccacattaatcatattgttttatttttatcattacattaaaaatcaaatagtatcactaggtttataatgaaaaacagcagaccctgtcccagccctccacactctcagtttctactccctagatataatctctattcacccagctacctcttctggtatttatctccgtatttctaaatagcatgcttatactactaattcttaatttttcagtttgggccattattttactttttctataggaaataagatatgtgtttatactctgaagactggtaatacacacatgtatttctccatcttccatccttcagtttatctatatcaccctatataggtagagtactattcattatactattataaaggtatgtaattgatccagttagcataatatgattatatttcctttattttgattgaagttaactattgcctctttctccatgcaactttcttaagtacctagcattcaagtgtctataatcaatttattccaaactgtcctttcaaaacattgaaacacatcaagtagtctatcaatcagtttattttttaaattggagacaactctctaggagcccatcatcctccttcactgtggactagtttttctctaagcctactgcacagcttttgtcctgaaataattttatcctttctaccctgttttccacttctttttgtttttctgaaagatttccaccttccagcttttcttttgaattttaaaatttctgttatgttttaaatttgccagaatactttcttgtcaacctctcttttaattaaaaatattttttatttttgtaatttaaaggtttattgtaaattgacaagtacaaattggatatatttatggggtacaaagtgatgttatatgtatacaatgtggaaagattaaatcaagctaattaacatatccatcactacaaatacttctttgtggtgagaatacttgacatttaccttcagcaattttgaaatatacagtacattattattaaccatgctatactctttatctcaaaaaatgtattccctttatctaactgaaacttcgtactctaaccaacatctccttgtttcccctaccaccccttccccctactctctgataaccatcattctactctgattctgtgagtttgttttagattctacattaggaatcatgtgactttgtctgtctgtgcctggcttattccattcagcataacgtcctccagggaagcactttcttgtccacccccttcccctttttaaatagcagtctgttccatttggtggatgcagtatcttattactctaagaatattgctaatgttttcttttgtttcttgaattgtctgtgttgaatttttaaggcttgtttctgttttgtgttggaagcttttcttaaacgtctagagatccttggccatccattcatatgtaagagtggggcactagaaagccaatagaaagttctgtgtacactggccagtgaggtggctcacacctgtaaccccagcactttggaaggccaaggcaggcagatcacttgaggtcaggagttcaagaccagccttgccaacatggtgaaaccccatctctactaaaaatacaaaaattagccgggctggtggcgcacgcctgtaatccttgctacttgggaggctgaggcttgagaatctcttgaacccgggaggcagaggttgcagtgagctctccagcctaggcaacagaccaaaactctgtctcaaaaaaaaaaaaagttctgtgtacatacttaggacttgtaattggtaggacatactgcagtatttttcaaacttctggtcgcaaacccattagtagtttgtgaaatcaatataatcagttttatttcccccaaatgacagaacagaatagaaaacaccacctcagaatacatctacatagaaagagaattattttatgaaactttggtttcttacacatatcatatatacatattatgtactggtttgatcccataaaatgggagttttttttttttattgtgggtgtttcttcaaagaaatttgaaaaagtacaacttaggataatcaaagagatctccaactgtcaggacaggtaggtcttttctcttagagaggttaagttccggcccagtgcggtggctcatgcctgtaatcccagcactttgggaggctgaggcgggcagatcatgaggtcgggagattgagaccatcctggctaacatggtgaaacctcatctcttctaagaatacaaaaaataagtcaggcatggtggcacgcgcctgtaatcccagctactcgggaggctgaggcaggagaatcatttgaactcgggaggcggagattgccactgcactccagcctgggcgacagagcaagactccgtctcaaaaaaaaaaaaaaaaaaacggagataagttctcctggagtaaaattctctaaacttttgcctgcatgctagtctgatagacagtactcattcattcaggtattggttgaggacttactatgtgccaaacactgttccaggttctgggtatacatcagacaaaactgtctcctgggactagattctagtgagggagataaacagtgggttatatagtatttagatcttgcgctaggtaacacagcaacagaagggaaagctgaacatatgcatatagatgctggtaagagggtggatgtggtggatgaatgaagtagaaaacaaggtcatcatctgagagtgaaaatggggaggaagtgttggaagaaaagagaaggtgtgaaataatttaggacacagcacagcaaactatagcctttggtcaaatcctattttggtgcaatccacaagctaaggatacttttttacttttaaacggttgggaaaaaaatttaagatgatattacatcatagcatgtaacaaataaatgcaattcaaatttcatttatttacatattgcctctggctactttcatgctacagtgacaaagctgaataattgcaaaagagactatgacctgctatgccaaaaatatttatctggccctttacagaaaaagttggctgactcctgatctaggaggatgggaaggtatatagagtagggaaatatgattatcaggcagcattaaggcctgaaggttatggacatgaatttaaagtaagactaaacagcatagttgctgcacagaagtaggtacaaaggcaaagagctggctttaaagttgtgattttgcaaactgaaaatgacaaaaaggggtagactaagttaaaagtacatgcaagttgcatgattataatgagtgatcctgggatttaagttgattatgacaggaacagaaggaacttggagattagggacaatgaaaaggtggtagtgaaaggagtgttggagttaagttactagatgtctggaagacagactgtggtggtcagataatgagatagattatggaggggttacagtttttggtaataacgagagagatctaaggtatgactgagagtgaatggatgagaatagcagagaacaaggtcagtggaaaactactcttcaaagaacctatagtcagggtgttgaaagattaaaaattgctaagaattaaatcaggagtagtgctgcgggaaatgaaatgagcagtgaactaaacttactgagaaatgagaggggatgacccaggggtttgtagattttgtagatgatagcaatgaagagaagagatattatttgatggtatggaactcaaagctgagagttttaagggaagataggagacgtgtctagaagtagtaatgaggagcaagaacatcatctaccccatctccaggaccagtaataggaggactgtgggagaaaaaaatcaccttgagagggctgtagtgaaagcagtatcctaaggtagcagccaagtttcagactgctgggatccaagccagggaaaggtttctgactctttagaatgctgagctttaggctgggcacagtggctcacgcctgtaatcccagcactctgggaggccaaggtgggcagatcacttgagtccaggagttcaagaccagcccaggcaacatggtgaaatcccatctctacacaaaatacaaaaattacccaggtttggtggttcatgcctgtagtcccagctactcaagagactgaggtggagaatcacttgagcccaggaggttgaggcagcagcaagccatgatcacaccactgtactccagcctgggcaacagagtgagaccctgtctcaaaaaaacaaacagaatgctgagttttaaatccctatattcagtaggatgtctcccctcagctcccagttgttgttggtggcttcaactagttcatcttccccaggagataatgaatgaacaaatgaatgaatgaatgaatgagtttataaggggcgaggatctcaggacttcatagtctttcaagtaatcatcttgtttttagccctctacctactacctcttgcttttcagataactgatgcctccaattcctaagccttttctggggttctgtggtacaaacatgcttgcttattgctagtaacactccaccagcccctgccccagacttctgctttctctggtctactcagtttgttccttgttttttgctttccggattcaaagattttgttgacattgcctggatgctgccatcttttgtctcatattctttgtccttaatcatttaacattcctttactgtcattttaatggcatttcaggaggaagccatgtttctagtccaccgttcttttttgttgtttttgagacagagtcttactctgtcacccaggctggagtgcagtagcatgacctcagctcactgcaacctctgcctcccgggttcaagcgatcctcccacctcagcctcccgagtagctgggaccacaggcatgcgccactacaactggctaatttttgtatttgtaagtagagatgaggtttctccatgttggccaggcttgtcttgaattcctggcctcaagtgatccacccacctcagccttctaaagtgctgggattacaggcatgagccaccacaccgggccaatccactgttttttaaaaagttgtcaagagttttgttaaggggtcagacatgtctgactggttgacttttcccagaatgctgcttagtccctcaaacacacaaattcctgatgggtccacccactaggcttctggtatacacagacagatctgaatcccagtggtggaaacaacctaggctgattctgagtttcccactgcatttcttcttctaattgtccctcttttccattcctgtcctttccctcatcccttacctgctgaaaatgaatcttaccatttctaaaattccactcttccgggggcatccacagctggatcctcttcttcactgccattcctcaggccttagaacaggtccccttcttacacccttgtgctccaactggtctttatgaaacctgttcacttcaatatacttttaggccaggctcacgcctgtaatcccagcaccttgagaagctgaggccggtgcatcacttgaggtcaggagttcgagaccagcctggccaacatggtgaaaccctatctctactaaaaatacaaatatatatacatatgccaggcatggtggcatgtgcctgtagtcccagctactcaggaggcagaggcacgagaatcacttgaatccaggaggcggaggtcgcagtgagccgagattgtgccactgcactccagcttgggcaacagagcaagactccgtctccaaaatatatcttatctatatatagatatagataggtatatatagatctatatatagatatatactttcaattctccaattgttcccgtataccatagagaaactcttatgagctcagtttctgcaggacttacaaaacagggtaattgcctcctcattatggtcagctccagcaccattcaaattctctgtccttacccatttccagaacaagcaggatgaaaatcacttatcactatagcacccacccttaagcacaaggttatccaatgttttcaaggagtccagcatttcataacagaaccccctgattagtttgctaactgatgaaagcagagttaaattcctgttatgcaggtttagagtacaggagattctatgtccccatatcctctgccccccaatctatcccttggcaaacacaagtacctctactagaataaccatactccctcttcccaacccacttctcttgtttaagggcactggcagtgtttgtgtatgtcaacaacatcggagtatctggggtccctggagagttagattttctgtattaattacagactgggagattactctggctccagtaaaagcaataccaggattgaagtcccctctctgattatggtggctgggatttgctggaagaggcataggtccagaaaagaatgtaaaaaaggtactagaaagaaagaataaggcctatagccatcaggctgctagaacctttggacaagtcactatctaaaagcaggtaaagacccagctttttgtccatctggtcaggcacctggtggcgtgagtctttcagaacatactggtcaggcggtggctcacgcctgtaatctcagcactttgggaggctgaggcaggaggatcacttgaggtaaggagttggagaccagcctggccaacatggtgaaaccctgtctctactaaaaatacaaaaattagccaggtgtggtggcgggcatatgtagtcccagctacttgggaggctgaggcaagagaatcgcttgaacccaggagtcggcagttgcagtgagccgagatcacaccactgcactccagtctggatggtaaagtgagaacccatctcaaaaaaaaaaaggaacataccacaacccttcaataaaaaggtctctgagaaaacagttgtcacaatgtccatgtacttgtacttgacaccatgtgagaaacagcctccagtaggtcactggccagacaggtgagtatgaaataggacaacactgtattatagctcaggatgcattgataatagaagtttgaagcagcagctgacagacgagtctaagcaataacacacagactagtttgtctctgctcttgagaacagcagcctgcaacccttcaaacaagccataatgtgtgagtcaacaagaagctacatttgattgacaatgccattttaataaagatgttctagagtcaaagaatttggcgtgagaaattgtgcccaggctggggtgcagtggtgtgatcatagctcactgcagcctctgagctcctgggctcaagggatccccctgccttagcctctgaagtagctgggactacaggcatgcaccactgtgcccagctaatttttaatttttttgtaaagatagggtctcattatgtttcccaggctggtctcgaactcctggcttcaagtgatcctcccaccttggactccgaaagtgctgggatgtgctcaatattaaatgtcatgaagatactgttaaaataataattgtgctcaatagttgtatctttatactattctgagccttaggtttcttttctgtaaaactgaacaatactaccttctttgcaggggatagcatagtccctggtttacagtaaatgctttcctccaattgaatcaagatatacctctctgctacctccccatctattagaaatgcttgccttctggtaccagaaaaaaaaaaaaaacaccttccacatgacaactctgaagacaataatcacactaccattgtgtttttctggatgtgccacacattgtatacatgtccctgccttacaaatgacatctcctatacacagagtccttaatatttctacatgcaatgtataatcaattaaaacatcagtatcatcttaatgtgaatttctgttaatccaagttctcccccactatgcaagtgcaataaatatttaaaaatgaaggtaacaatatatatatatatttttttgagacagagtctcgctctgttgtccaggctggagtgcagtggcgtgatcgcggctcactgcaagctccacctcccgagttcatgccattctcctgcatcagcctcctgagtagctgggactacaggtgcccaccaccactcccagctaattttttgtatttttagtagagacagggtttcactgtgttagccaggatggtctccatctcctgaccttgtgatacacccctctcggcctcccaaagtgctgggattacaggtgtgagccaccgtgcttggccaacaatatatattcttaactgtgtaaattttaatttgttggttttattcttttgagattattatgaatattgattctgtcattcatcgcttaaggaccaggcaggtgaaccacttgacattttttatcatcagaataaattgacaaaaacaaaacaaaatactttgaggtggaatggaagtatcttgagtagtagtaaaaccatagttctagatggtgataatcattgtcataatgaaagcgtgttgcttgttgactatttaaccatgctgtttaagtcatattaaaaacatcaatacgtccctctccctctcccctctcccctctcccctctcccctctcccctctcccctctcccccttcccacggtctccttccacggtctccctctgatgccgagccaaagctggacggtactgctgccatctcggctcactgcaacctccctgcctgattctcctgcctcagcctgccgagtgcctgcgattgcaggcgcgcgccgccacgcctgactggttttcgttttttttttttttggtggagacggggttttgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatcttggctcgctacaacctccacctcccagccgcctgccttggccccccaaagtgccgagattgcagcctctgcccagccgccaccccgtctgggaagtgaggagcgtctctgcctggccccccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggcctccccgtctgagaagtgaggaaaccctctgcctggcaaccgccccgtctgagaagtgaggagcccctccgtccggcagccaccccgtctgggaagtgaggagcgtctccgcccggcagccaccccgaccgggagggaggtggggggggggtcagccccccgcccggccagccgccccgtccgggaggtgaggggctcctctgcccggccgcccctactgggaagtgaggagcccctctgcccggccagccgccccgtccgggagggaggtgggggggtcagccccccgcccggccagccgccccgtccgggaggtgaggggctcctctgcccggccgcccctactgggaagtgaggagcccctctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccatccgggagggaggtgggggggtcagccccccgcccggccagccgccccatccgggagggaggtgggggggtcagccctccgcccggccagccgccccatccgggagggaggtggggggggtcagccccccgcccggccagccgccccgtccgggagggaggtggggggatcagccccccgcctggccagccgccccgtccgggaggtgaggggcgcctctgcccggccgcccctactgggaagtgaggacccctctgcctggccagccgccccgtccgggagggttgggggggggtcagccccccgcccggccagccgccccatccgggaggtgaggggcgcttctgcccggccgcccctactgggaaatgaggagcccctctgcccggccacgaccccgtctgggaggtgtgcccagcggctcattggggatgggccatgatgacaatggcggttttgtggaatagaaaggcgggaagagtggggaaaaaattgagaaatcggatggttgccgggtctctgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctactgaccttccctccactattgtcctatgaccctgccaaatccccctctgcgagaaacacccaagaatgatcaataaaataaataaataaataaataaataaataaataaataaataaataaaagagtgactcacatctctggctggattgccaggggaccttgggcagatttcttagcctttctgagcattcagttataagggcaaatatttttggaggcacagtgtggacgcgtagtatgaactgaatgaaagaaatcggtttcgtcaaaaataaacagagttgaattagttgttaaaaaaaaaaaaaaaacatcaatacttaaaaggtaagtttccatcatcttgaaaatacatttatttgagatgccatttggacaatgactttaactatatattaaggttcattcaactctttcccttcccaaacctctcctatttgtttgaactaaatatttcctttttttttttttttttttgtttgtttgtttgagacagggtcttgccctgtcgcccaggctggagtacagtggctcaatcatggctcactgcagcctagacctccaggcttcaagtgatcctcctgcctcagtctctcaagtagctgggactacaggtgcatgccaccactcccggctaattaaaaaaaaaaattgtagagaagggggtcttgctatgtggtccaggctggtcttgaactcgtgggctcaagtaatcctccagcctcagccttccagagtgctgggattacaggtgtgagccaccgcgtccagctatatttccttttctagaagtgttctctcggactgctgacaggtccaccataaaagattgttcccgtatatgaagttctgagtgactaccatatgccaaccactctatatggattttcttatttgacactgtgaggtaagcacttttattacttctgttttatagattacaaaaccaagctcagtgaggtttgctaatgtgctcgacatacagtcagtaagagacacctgaagggccagtagcaatggaggaacaggagaccctaagagaaaaatgctgatgcaattagactttacctagtctcccccaccttccagactggagccctgacacaaagactttgtcagacaagcacacagaggggaagatttcactttattgttacatcagtctcacaaatgaacccaacacagccagaaacactgaaaggataaagtgccaatgcagagaggcctggcaacaggaggagggaggaatccagttcgtctcctccacgtccccagcctggcaatatatttctattacacaagagtgagggcagctgacataccaggcaacccattgtatagacactttgagctaagaaatagaaaattgtaccaggtagggtctgtgcagggcaagaaaatagaaagaagtcagaaaatgttattttcccgagtcaggcatggaaatatcaaatgataaaaccaatatttttcaaactctgttatttgagatagacatctaataaggaatgagacaggtctggtgcttcatgctactgcctattttcagaactatgacaccctttctcccacaccctcaatgtaaggtaccagaattttttaggactcctgggaaaaactgacctcaccttcttaccttctcagcccccaaaaattagacccagtgctccctcatgcacatcaaggagatatgagctaggagaataatcaacttggaggcatttaaagaaagtgaatgaaggccgggtgcggtggctcacgcctgtaatcccagcactttgggaggctgaggtgggcggaccacaaggtcaggagatcgagaccatcctagctaacacggtgaaacccgtctctactaaaaatacaaaaaattagccaggcgtggtggcaggtgcctgtagtcccagctacttgggaggctgaggcaggagaatggcatgaacccgggaggcggagcttgcagtgaaccgagatcgtgccactgcactccagcctgggcaacagagtgagactctgtctaaaaaaaaaaaaaaaaaaagaataaaccagcaggaaccttcaacatgcctcactgtggctaagagtcaaggctcagagtagaactttcaagtagggaagtaaagggtgagctttacttcaacttagtaccaggataagaggcaggccaaagtattgccatgaaaggtagggaaggagcatggagaggcctcagtggaaaggtacaaatccccgctaggtaagagaatggggtgttgctagagggagtgctgaaggctggtaaccccgggatcacccctcatgagctttagatatagcctcccaaccatggctgtgcttagcttcctatctagcttctttaggtagaggctgataggaagggggcctagggaatgaccccatgacaactgactgcagtatggctgcctagttgttcaaatgatagtcaccaagttcctaggctttagggagcttctgtgaggcccaaatcattcagagttccaaagggctgttcagtaggggcagttgctgaacaccagacaaggtagttggtagtacttggcaaagttcaaagtgggatcctttaaacaaacactctgagaactactgctatgacacagggtagacttgggaatatcttaaagggatacccacagctagctatttttctgacttgtccaagcacttctatgaccaaactgaaggggagattccattatagacacctgtgtgcctaatgtgacaccccagtcaaaaagcttcaagaaaccttgtattctccccaacctttgacaggggtcaggaaatactgggcagttataaaaagttgtccttaacattgccggctcctgctctgcctctttccttgtatcaggacagaactgaacatctcaattccctgcctgaaaatgtcattccctgcctcccagaaaggtttatctagataggcctctccaccaactgattctactcagtctactcccttctattctggccttgctctttttttccccccatctttctctactcctggtttccagctacttcagtccttgacagacacataataggatgggcagaaatgctgatcggatcttgggagtaatcaacgtctgacagtgacactctgatttacttaagccttcaattccatatcagagagggattaatattcctctgtctgtggttcctcctttcctccaagaggttcacagtgagaaaccatttcattcatctttgtacgctcgtttttaggcaccaagatgagggcctaaatgtgacagtttggggcaaggaacttttactgggcttggcacacaggagggagagctacccaaatcatcctagcatccatctccagagaatattcctcccatgctctgcctttttttttttttttttaacacattctcacctctttgccctcctgttaaaggcttgaatacaaatgaggcagcatgggagtcttggcttggaaatcaggtctgcgttcttggtcccttcagtcactgacctaatatatgaacttagacaattcacttgcctctctggacctttaaatgaaagagttaaactgtaatggataatgtccctgggctctttcacataatccatacttgagaaatcaatgaatcaatttgaagaaactctaattctaagacataggtatcctggcacctgtttgaaacagctgaaaggaggtaaaggtcaggttcctgtttattatacatttagctataggaaaagaagcacatatatctatggagacacagaacctggcagcccctatacttgactaataaaagcaaattcctggaagaagcagagaaataggccacaagtgagactggcagtgtcaaaaaaggtctataagttaagtgatcaaagtagtaaaaaacaatggccataaccagacaagatctctaagcatagactatagtctagagaggtctgaatgggaaggagcccctggagcttctattagatggaaggacttggtccacagcaagtcactacggcatttggttcaaacccagttttctctatctgtcaacccggtgtgtatgcatgcacacgtgcagacatgctgcaggctgtagttatgcttctgaagtgctgaaatgagaaataaatatcaggagaaataatgccaaattcaaaaaaagttaagctgaaggcaagtaaaattttgctttcaaagctagtcatttccctaccactctgtgtggcatcaccattgctcattctgatgtgtgcactacagagttttgtggggtgatgaactctgggtgtggggaagggtggatttgtagtataattgaaagccaaagacaggatacaaccccatgtcctgtctgagaaccaccaccaccctgctcgcagctgatgacaaatggatgtgacttgatctgacccatttgggcactcacttgtcttcattcaaagagactgtctccacaaaagggatttcttccttgtctgtcttccccatgatcagccggtgcttatccaagtttatgatgcactgaaaacaggtaacttgtcagtgataccactatgagttcctgtgtaagaggatacctgcctcagagaggaagtatcaaggggtaagtggagtcaatcttaccttcagagatcggagagtctgtagaccaagggacaagtttttctcattgtcatctaataaaaacaaaaaaatgattaagatttagccatttccatgcttgcttagaagttggcctaatcactattaggttccatccatccatccaataacatccaataaacatatattgagcatgtgttattttttttttattttttttttattttttgagatggagtttcgctcttgttgcccaggctggagtgcagtggcgcaatctcggctcactgcaacctctgcctctcaggttcaagcaattctcctgcctcagcctctggagtagctgggattaccagcacccaccaccacgcttggctaatttgtgtatttttagtagagacagggttttgccatgttggccaggcttctctcgaactcctgacctcaggagatccacccgcctcagcctcccaaagtgttgggattacaggcatgagccaccgcgcctggccgagcatgtgttatattaagtaattttcctagatcattaaacttacaaggcaatagagccaagattcaaacccaggtcttttttactctaaaggacaaaggcctttacacaaaaaccaagaacttggagtagtcaagagtaaaatgtagagaagtgtggaaactggtgggaaattatcaagggatttatggcaaaggagtaagtaagttgctctctgtctctaactagttcatggaaagctctcaagggacattttcacctatacataaaaatgtgttttcttgctccttttttttttctttcttttgagacggagtttcgctcttgttgcccaggctggagtgcaatggcgcgatctctgctcactgcaagctctgcctctcgggtccaagcgattctcctacctcagcctcccaagtagctgggattaaaggtatgcgccaccagtcccggctaattttgtatttttagtacagacggggtttctccatgttggtcaggctggtctcgaactcccaacctcaggtgatctgcccgccttggccccccaaagtgctgggattacaggcgtgagccactgcgcccggcctcttgctccttgaatttttttttttttttttttttttgagacggagtcttgttctgtcgcccaggctggagtgcagtggcacgatctcagctcactgcaagctccgcctcccaggttcacgccattctcctgccttagcctcccgagtagctgggactacaggcgcccaccaccacgcctggctaattttttgtatttttagtagagatggggtttcaccgtgttagctaggatggtctcgatctcctgaccttgtgatccgcccgcctcggcctcccaaagtgctgggattacaggcatgacccaccgcacccggccgaattttttttttatctgaccacatttgttttactgattgattctcaacatgtcttgaatgtagctcagggcccatctattactttggagagcaaaaattgggacaaggtctacagtacaaaaaaatgggaaccattttgaaaaagtcaatatttacaggcatgagatgacatgaggttttgttgggggtagggagagggtttccgttagggtccataggtccagccctcaattctgcttaccaaccacagctgctgggcagtccaggcggagggagcccagtgtgatcactaggtgctcaatctggcccactactttgagatgccggggtagagaaagcttttctccttcatgcttgtgggatttgacatgctccttgagtctgtaccaaagaggaagataccaaaatccccttgacagagattcctggtagaatcctgcaatgcctaccttctgacctacaattggaattctccagggatctcctgggattaatctaccgaaaagtgctagccatcctacatatgttgttccagcactttgtcctaaacatgccagggagatataaaaacactaaagactcatctcccgttctcaaaaaccttacatcacttatgtgtattggtgaagagaggagaactgatatattcagagaatcctattctgtatcctactatccccactattgtgtgaggcaattgagttgacacatccttttacccatctgtgagtaacagatactagagaagtcagattaatcctaattttataaggtgctttgttcaatgtgtaattttctcattgtcctttctatttcactctgtcttcatcagtctgtcttagactataatgttaatggaggcaagtacttatttggtaagtgcactgatattcatatcagcaaggaatatcatggagaaaatccttgttaatttaacttgtctgtgcaggggaggaaggaaagaaacagtaccaaggtttcacatgttacataagctgattggaatagctagcacccgagctattatgggttggtggataaatacttaattatgaactttctgtgccaatacttctgctttcctctatttcctctcttttggtgttatagcccatccaaaagaaaaataattgcagttttacagatggttattaattcctctggaatcatggcagtctgctgcctaattatgcaccaggacattgttagtctttctggaaccatcatgttgcactatacttcatatttttaccacacaaaagctcagggctgggtgcagtggctcacgcctgtaatgctagcactttgggaggctgaagcgggcagattgcttgagcccaggagttgaaaaccatcctgggcaacatggcaaaaccccctctctacaaaaaatacaaaaaattagctaggcatagtggcgcacacgtagtcccagttactcgggaggctgaggcaggaggatcacttgagcccaggaggcggaggttgcagtgagctgagattgcaccactgcactccagcctgggcaacacagtgaggctccgccacacaaaacaaacaaaagaaactactggctaattacccttatgatggcccaggcccagtagcagctgcagtcctattctcagttctgatggatgtttcttggggacctgcaatgcatcctccagaaagactctgagtaagctaagccccaccacatccctacttttactcatctggatggagtataccaacaggacagctccttttaatttgctatctagtggatcagggcagggcacacaatgagccagaggtctcaggctctctcattcaagtttagaggtctttgctcaaaacttaatagggggagttaacagaaagccaaaggtttccctgctcactgatttctcccacttgccggataacccactactcctcccctctactaaggattctggttccagctgagatctgaactctgcatacttctctttgagctgctgtagagaccctcaccatctctaaccataaaatagagtcaagcgaagagtacagtcacatctaagttccactcagcacaagtgcctacttaccccaatctgtccacacaggccaaagagatgagattatataggcagcctgtgtcaaccaaggctttcacatcctttccagcacactgtggggaggaaatgtactgttcaataagagccagagaagcgaaagggaaaggagatgcagacagcaagcagcagatgtcatatgaaaggcagggttggagagcatcctcccaattatgggttatagtgtcccatctttacccactgctaagtctgcctttgactggctcttgttcctgctgaatccagagctgacagaagatcccccaaaaactctaggtgtttcatgctatacaccaaatagctcttaatcttttttaaaaaaatcacatacccatttgtaaatctgatgaaagctttgttccttcttcccataaagatgcacatgcttacaaaatgttgcatacacttccagtgttgcatggagtgccccttttaaaactcacttatgaattccatgagacccacactctataaagtcaggaggagagggccccacatcctactttccagaaaaccctggaaaagctgttctcagaacattacctggcaagaaaccaaaatcatgtcatcctcctcagacttctttagcccctcagacttagcctgattgagtttgttcgtcttagaggcccaagggacacggggaccgcttcggagcttagacaggttggtttccatgaggcgcctctgcagaatattatgaggttgcttgagggatagaaagcagagacttcttagtgacaggccacatccctctttcccattgtcccccaggtgccataaaaataatgaaggagcctcccataactgagctctatctttgcttcttatttatacttccttcaagtgaggacttcactggtattgtcagagcaggtaccataaaccaatttgcagtaggccaccctgaatgaatgaaaatgcaagatatgacactgggaaatgtggagagggccgataaatattctagggcttaagagaactgagaacccttgtgatttggactaacctaggcctgctacctttcttccccttacaagagcatttcaagggaaaagtggtcttagtctagagtaagtaatctctgtatcttcctaggtgacagcaaatcactgccttatagaaagggcagctcattttcataggctgaagaaacttagctaacacaggtattcagaagctctgcctacttctgtgtcaagtctcactctcttatctttcagatgcagcctgcagaagccttagtggctggctgtcctgtggactgagtcacccatgggtggatagggtgaaaagacaggaattcacacttgctgagcaagcctctcagcagacacactttgaaacctgagcgaacacacaagaatcatcgatgctggcatcccctggtcctcaaaacactggtttctcctgccctatcttgtcatccatttcccttcccttcaatggcccaaaaagtggaggtatgaaggggaaagacactgaccaagaagcaggggacttaattagaccttatatgcatgccaggatgcctaatgttaagaagcagaatgagaagtgtgagtttaagtctacactttgatagagcttaggagagttcctagggcagatataatcatgctccactgtttctattcaaagtggcctccagaaagtttaagatatctcttgaaaagaaatcctttgactggagaaatttgtatacacaaatatcttatgtcccggctacaataccatttaaaatccctcaaaggagagtgtttaacctaaaatccctcaaaggagagtgtttcaccccaagtttctatctaacatataccagatgacactttcattctatggggaaggaagtcactcttagaagcccagagcctagaacctttcaaggggaggggctggcactggaggtcttcagtgtatctgccacctttcagattcctaaggaagaatgcagtcacagccatgactcattgtaaccctagtgagatgaagaaatggattcccaaaatacactgattcttggcaaagcacattctaaactggtatctttgggaaaagtggagggagaggcacttgtaaagaaaatgagagcttcttagcttgactaggagctagaggaagtgctaactctgtcagattttgtgatgcaacactgggataatgctttgcttctcaaaagaaatgaaaatgtttcattcgaatctctctcaccaataagaatggattcctagctcaagccatactaaagcagggtgtttgtttctgttacatccatgcttaccaggaccaactcagataaaactggacttgtagaagtgaagattggaaggagtttcaaagaccacctaaacaaagccctcttacctaaagtttggggatgtcttcctacattggtcttgctaaacactttatctagttcttaatcttgcaaaggaacctaatcattagtggacagatgagacaaacgagggaagttctgaaatcattatgcttgaattcatcccttttctgtattttcctctttctactggattcttcttccaaaagttataaaacatactaaaagttcctagatattggggagcaaactcctccacaaaatgtcagatcctgctgcctttactctacagcctcctttaatcaccctccttatctggaatggtctttttaaaaaaagactaaaccatgacatctattttctgatatcccatattttcttcactgagatcacttcttatcccataccaataattacctctgatttccaaatacaatagacattttcagccttaattttaccagacttttctagtgcatttggccctgctgactattcctttacttgttctttagtaaccaaaaaaggttcaaacacatgctcaatgtaaaatacttaagtatcactgaaatatataaaataaaaagcaaaggccaggcacggtggctcacacctgtaatcccaacactttggaaggccgaggcaggcggatctcttgagctcaggagttcgagaccagcctgtccaacatggcaaaaccctgtctctactaaaagaaaaaatacaaaaattggccaggcatggtggcatgcacctttaatcccagctactagagagggtgagacaggagaattgcttgaacccaggaggccgaggttgcagtgagcctagatcgcaccactgcactccagcctgggcaacagagcaagactttatctcaaaacaataaataaatgaacaaatacataaataaataaaattaaaagcaaaaacctccccaatctctcaagcccttctcagtcccactcccaacaaataatgaccattaaatttagaaatatatctttcaaaaaatattaatacatttataaacatataaaagactaatcatactataaaactgttctgaaattttctattttcatttaatatataaaagcattttctgtccaggtgcggtggctcacacctgtaatcccagcactttgggaggccaaggcgggtggatcacgaggtcaggagatggagaccattctggctaacacagtgaaaccccgtctctactaaaaatacaaaaaattagccaggtgtggtggtgggcgcctgtagtcccagctacttgggaggctgaggcaggagaatggcatgaacccgggaggcagagcttgcattgagccgagatcgcgccactgcactccagcccaggcaacagagcaagactccgtctcaaaacaaaaaggcattttctatgtcaatatacataattcttttcattctctttgataattaaaaagtactcataatatagttcaggaatagaaaatttacagccaacaaacccatatgaacctcagagatgtttttctctggtcattttattatacctacatatactatatcttaagtaacaatatagctgcatatttacctctgctttcagccaaaatttcactaaaatgacagtaaaagaataagtcctaaacccacaaaacaaaaagaacaataaagaagaaaaaaaagatgttgacaaaattctggaatctgaatagcaggcagaaaagcagcaattaatgacctggactagagaaagctaagtgctttataccatttcacttcacagagagctgaagcagcagaggctgccagttgctctttaaaatcctctttaaaattctcctcttcctcatgagaagatacctagactgtttcctagccctctttgtagttaggcatagccatatgactgagttctacagaatagaatgtgagtggaagtgacatgcaccatttctatgcctggcccataaaaatctcctgtgcatacttctctatattcttttcctcttctgactggctggagtggagatgaccactatggttaccttctcagaggccacatgttgaagacagaagagctactgttagtttgagtctctaaaggactatatggaagaggctgtcttgttgacttttccactaatactgttacttaagaaaaaataaactattttgtttgagctgttatatatttgcatctagctgtaaaagcagttgtactactcaaactaaaattaaaaggctgaggagttacaggtatcagaacctctacagttgaaggatgcaattagggttggaaatagactaaagtcttcatgagactcacttgatctggagaactgaggagaatgccaaaagtttactcttcttgtaagagtaaataaaaagactgattagttgatagcttggctaggctttcagatttcgagaacagctgaagggtagtgtgggttatcatactaagccagaactgaaggacatgagtttaaagattgaaagggcccacatggagcctaccataatgaaggaaaaaagatccacatcaagatttcacatcactgtgaaattttggaatagcattgatgacaaagattccacaagattccaaagagaaaaagatgatcaaaatacaaaggattaggaatcagaatagtagaggactattcaacagtaacagtcaaagctaaaagacaatagaataatgccttcaaaaatctggggccgggcgcagtggctcacgtctgtaatcccagcactttgggaggctgaggtgggcggatcacgagatcaggagttcgagaccagcctggccaagccaacatggtgaaatcccatctctactaaaaatacaaaaattagccgggcgtggtggtgggtgcctgttatcccagctactcaggaggctgaggcaggagaatcactggaactcaccgtggaggtggcattgagctgagattgtgccactgcactccagcctgggtgacacagcgagactccgtctcaaaaaaaaaaaaaatttgatagtacataatttgtaaacctagtcaaactatcaatcaagactcaagaaagttatttcctgtgtcttctcaagaagctactgaaagatatgcatgcttcaccaaagcaagggaaacaaacaacaaggagaaaaacatgagatctaagaatgaaagaatccaatagagaggcaaaggcagttctaagaatggtgttgaaggaaaagtccaggatacaggttgcctacaggccttaaaagcagccagtccaaaatgaaatgaaaagatagggggctctaggaaggatcctccaagaaaacaatggacttgctagaccatctatagttttaagttacttgaaggagaattaaattttacatggaaactttttttaaacaccaaggaaattattaattttgagaaaaatgtttttatgagaaaagaaatagtacatttgactcagctgtaaataacaagaacatagtcataataatgtaagcaataaatgcttatttgacccaaaatagttatttaacagaatgttagtataatagaagagtgaatatgatgggaaggtgtaagagaattaagtttttatccattataatagaaaatcagggctgggtgcggtggcttacacctgtaatcccagcactttgggaggccaaggcgggcggattgcttgagcccaggagttcaagaccagactgggcaacatggtgaaattctgcctctacaaaaaatacaaaaattagccaggcatggtagtgcacgcctgtagccccagctacctgggaggctgaggtaggagactaatttgagcctagaaggtggaggtggtagtgagccaagatcacaccactgcactccagcctgggcaacaaagcgagaccctgcctcaaaaaaaaaaaaaaaaaaaaagtaagactagatagatagtgatgaaaacagttaattaagaaatagcagtatcaccatttacttggagatatggagatccctaacacaagcaacagctttaaatttttaaaagttttaaattatttacatttttaaaaattttaaataaaaatataccccatgtagcagaaaagagttcagccacaagaaaagccaacttaccgtagtttaaatggagatttatttttctcacataacaagaagtctagacatagaagctgctgatactaactcagcagcttaacaacttcagggctattgactctgttaattctcttggacattccttcatggtcacagatgaataccccagctccaggcattatatccacattcaagaaatgaggaaggaggagggactacactaacaccatcaattgcttttatcagaaaaggaaaagctttcccagaagttccttcagcagttttttgcccatatcttcttggtcagaactcatatggccactcctagctctaacagacattgggagagaatttagcttttataatctctatagaggagttcagcataaagaaaagggctaaggatgggtgataatttagccaactaacagtgtctgccagatgcaaaaactaaagcatgtgcacacacacaatgtaacttaggcaggtataatgccaggttatcttataaccagcttagcatctattttcttatgtctgccctactttctgcattttaaaacagcacatccttgacagacaagtttgtggtataagcataccttaactatttactaatgggcatttagattattttcatatgtttgccattagaaacaatgctgcaataaactcaacatttcatttatcctgaaacgctcctccactggcctctaaaaccacctgtttattctgttcctgtctctctcactggttcctttgcctatgttcatttcttaaatgttagtgttcctcatcgctctatctttggtcctttgtcactctacatatactcccagggcaattttatctgttttcattgcataaattactacctttatgatgatgactctatctcatgtccagatgtcacctcaattctagacccatagatccaactgcctttttcaacttctctacttagatattccacaggcacttcaaatgtaaattatcccactgatattttctatcaaacttgcgcattctcccttattccctatctcggtgggtgaaattctgcctcctcttattttcttcttcatttacgttactgctaagcccaatctcctaacattactttcatggtcctcttcccccacagtggttctcttgctagttgtaacaaagaaaaatcctcaatttaccattcaagaccttccactaccattcatcctccttcccaatctcatctttttaattactactccatgaaggctttctgctttcagcaaattaccacttgtcacatattagcttgggcaaatcactaacctctatgagcattacttttctccaaaccttactctcttgatcagtcataaaggaggtttgaactccaaagacttgttcagttttaacatattgggttaattcctttccaacaaccttggtaagtggcaccaccatacatccattcttgattttttcatttcctgacctcccatcaaaagtgatattgtactctgaaacacacctggaattgatctgcttctccccatctttactacctccaatctaatccaaaccactataatttcttatctgtactgtcacagcctcctaacttgcattctgcctcttcttttacccttctccagtccattctttgcatggaaaccagagtaagctttttaaaacataagtcaggtaatacagtactttactcaaaacccttcaatggcttcccattgttcttcagaaaaaatccaaactttttacccttctctatacagctctgtaccaactggcccttgcctctccttccatatacaaaccactctccctttattcattcagattcaacaccatccacactcacttccttgctcaaaatttctttcccattccaatccctttgcactggctgtcccctctgcctgaaatgttcttcccctaacatttctaatagttaggtccctcttatcttccaggtctctgttcaaatgtcatttcctcagagataccttccttgaccatacaacttaaagtaggtaggtcacctttttagttactaacaaatctcactatttctttcatagtaattatcaatatgaaattattttgtgtatttacttgtttatatttcacccctgccctaccagcatgttaactgcacaagggcagggaccatgactgtcttgatttcagctatatcctcagctcttgacatagtactgaaagaaatctctaccccttctttcttcaaaaagcctttttttccttttttttttttttttttttttttgagatggagtctcactctgtctcccaggctggagtgcagtggcgcaatcttggcttgctgaaatctccacctcctgggttcaagcaattctctcacctcagcctctccagtagctggactacaggtgcgtagcagcacacccagctaatttttgcctttttagtggagatgaggtttcaccatgttggccgggctggtctcaaactcctgacctcaggtgatccacttgccttggcctcccaaagtgctgggattacaggtgtgggccatcacacccagccaaaaagcctttcttgattaatatcattgaattctttctttcagaatcccttcaatacttgtatattaaagaatttctactatttgtatccccagtctatgactgttttataaatatggttaagtggttctcatttgtttattgacatattggctttccaagggccgtcctgtctttcaagatacacagtactgaccaggtgcactggctcttgcctataatcccagcactttgggaggctgaggcaggactgcttgaggccaggactttgagaccaacctagcaacacagtgaaattgtgtctctacaaaaacaattttttttaattaaaaattttaaaaatttaaaaattagctgggcatgatggcacacgcctgtagtcccagctatttgggagctgaggtgggaggatcacttgaagccaggagttcaaggctgcagtgagctatgatcacgacactgcactttagcctgggtgacagagtgagactctgtctcaaaaaaagaaaaaaggaggccaggcacagtggctcatgcctgtaatcccaacactttgggaggccgaggcaggtggagcacgaagtcaggagatcaagaccatcctggccaatgtggtgaaaccctgtctctactaaaaatacaaaaattagccaggtgtggtggtgggtgtctgtaatcccagctactggggaggctgaggcaggagaatcgcttgaacccgggaggcggatcgcaccactgcactccagcctggtgagagagcgagactccgtctcaaaaaaaaaaaaaaaaaaaaaaagaaagaaaaaaggatacacagtactaatttgctagatggatgctgcagataccctggtggccatttagacataatttttaagtcgtctttctgacgtggattctgctttatgctaaacttcaacaaggcagctactaacctaagcagtccctgcttctctactcttcctgaaatgtggctgctagaggcatctaaactctaaccaggcaagttcaaatattctgcctccatcgccatcaagagcttctaaaggaaatgaacactatgggaagtgctgtattctgggtgaaaatagctacagttcctcaatctggcacccacactgcttaaacatctcttctaaccaaactatagagtttgaagaaaagagaggtgagaggaatcagactatagtgcaggataccatagaatcataatttgagcaagaactttaaagccactctctcaatccctttacccaagctacccagacagaaactaatggatttctgtggtccacagaatgaaccaaactagaaaacagaggaaatggtaggggtctgctttctttgtagcatttattcccaagagagaaatccaaggtcactagctagcaacagagccacaactagagcttagttagaacaagggtcatggataccattcactttttcttttaccccaaaagggcctgaaatcattctactccattttagtcctcatatacagtctatagataaacatggactcctgagtcaagcccagtatacatgtctctatctctgaccttggaaatccaaaaggtcaccaatatttgtgccttctctttgcttactagctgagtatataacacgtgacccattctaccccatggaaacacagattgttcttcagtttgcagttgctcaaaaacataaggcaggctgttacactgccccaggccttctgtgttctatttctttgcctttgctcatgacccaacaaacaacctattcctcattattatctgttttgtggattagtctgagataatggtttctcagctgctcacggaggctgcattttgttagaaaggattcacaaatgggcaaggaattagaccagataacctgtaaaattcttcctactctgaggttctacaaagcacactctagaggcagccttctctccataccatctcacagtcagctggctcaaagggaatggtaaaggtgtaaatagatgccagtctccatccttatcatcacatcaggttagagaaatcacttcttccgctggactcctctggcacatctgactattacatcttggcaactagcacaggctttctggtggtgttacttatcttcttctagaattgtctattcagcatctacatttaagtaactaattgggaccctaaacttgttcaaaaatcaaactcttcatttttttttttttttttttttttttttgagacagagtctcgctctgtcgtccaggctggagtgcattggcacgatctcggctcactgcaagctccgcctcctgggttcacaccattctcctgcctcagcctcccgagtttcccgagtagctgggactacaggtgcccgccaccaggcctggctaattttttgtattttttagtagagatggggtttcaccgtgtttgccaggatggtcttgatctcctaacctcgtgacctgcccgcctcggcctcccaaactgctgggattacaggcatgagccagcgcgcccagcccgcaaactcttcattcttatttgccatcctcaacctgctccccgctgcaagtcttatccacttcagcaagtgataattctgttcttccaatggctaagttaaaaacctcatggtcttccttgattactctttcactcttaatccaatgcatcaattacatttgtcagctctgccttcaacatatatccagaacctgatccttcctcctctccttcacagcttatcacactgctctgaggtaccatcaactctcacttcaattactgtataatagcttcctaatcagtcttcctgcttcatctactcttgcccctttacagtgtaacccacatagtagcctgagtagtctttttgtaaaataagtcgtatgtatcatatcacccctctgctcaaaatattccactcgtttccaatctcaggttaaaacccaaatgcataggtatgcgctgaaaagagtggaaaataaaaaaaataataattttaaaaaaccacccaaatgcctgcacaatggcctcctactacatctctgatgttatcttctatcaccctcccccttgctcattttgatctagctacactggtcctcttacagttcttcagttatatcaagcacagtgacacctcagtcctttgcacttgctgttccttctgcctagaacactcttccctgagaaactttgctccttaattcccttcagtatctcctcaaatgtaatcttatcagataggccttgccggacaaccctgtacaaaatagccagactccaccccaccccagtcactgccttccctattccccttaccctgatttattttctccatagaaaatatttattattattaccttatatacatttacttaattttactttctgcctccttcctcccacaagaatgaaagttccgtcaaggcaggaactcagttttggttcactattatatctccaaagcttaaattattgcatgacatgtgtagtaggtactcaataaatatttgtatattaaattaactgatctgtccttccctgcccccaacctataaacctgtttataatgagaaacttttctgtcttcctatttgtgtcttagcccctagactgtgtcctgaacacagcaagtattcaaataatgtttgctattacgaggatgcaatcacgactctgcaaatcttcagtttgtgccagatcttggtgttatactggtatttcacgcttctcttctaagcctctgaaattctccagcccatgatttgtggtgatatggatagctaatctatagggcacaccacacagacctgctctaatagacagagattctgttcaggtattttatggtaagtttgctttactgtgttcaaccatctttcccccagcatcattcctaattctagtcagttttgaaaaagcatttagctatgatcagaagcaatcatatgtaggaaagaaaaactctattgccagacaagtaagaatatggcctaatgcctacaggtaagtataatatcatttaggaaagacagcatattaccacataacatgactgtttttaaaaattaaaaagtccttagcacaatgagaaaaacttttatgaacctggtagctaaaacaagataaattacaataggcaaatttccaagaacggagatgtttttctccagcttcactgagttaaaaaaaaaaatcagggctgggtgtggtagctcatgtttgtaatcccagcactttgggaggctaaagtgggcagatcgcttgagaccaggagttcaagaccagcctgggcaatatggcaaaatcccatctctacaaaaaatacaaaagttagattggtgttgtggtgtgcacctgtaatcctagctactcaggaggttgaggtgggaggatctcttgagcctgcgaggtcgaggctgcagtaagatgtgactgcagctgcattccagcctgggcaatagagtgagaacccgtctcttaaaaaaaaaatcaaatataatattactcactcatatctctggttttagttcttaatctaatacagaatgaacaatacaagataaaaggataaaagcaaaaggggcagacaaaaatataatttccacagaagactttgtatcagccaactccagatacacaggaataggcaaaggcactttcctggggccaagagaacatgaccccctttgatttcctatggttgccttctgccagtcctaaaagagctggcaggctggtatcaagcagtgaacattacagaaacagcatagtaagaggtagataattcagaaatcccagcggtatattcaaatataggttgctggtatgaggaaaaacaacctacaatcttcacaaacccaaaagtcaataacaactaatttctcctctctcttccttatctccctctgatgctatcctctcccttttcttggactccttctatcgagattatactataaactactccaagtaagaactattcaattaattttaacatcctccaaatttcccttgcagtgagagaaaattgagtcaacactggtctatcccacatgtatttataaagtaaaagaataataatgtacttctaaggtcacttctaagattgtactaaggctgcaacaacagttccaagagagtttaagcatgctgcctcaccccagcgcttgcggctctcctagccctacctcggtctgccttggtttctgtaacctggctgttctgtgcaatcacttgtacattataggtgtgaaaacagtgagagagggaaatcaactccatgacggtggggcacagaaagcgtgaaccatgattcagagccttacagtcaactgtcatgtgtatgtgtcatactcaaggcaatatcctgcttcttgaggctccttcctctttgcagcctgctgcctgtgctgtatgctatcagccctttgtgactcaactgagacagactagagtcagaaaagcggatggaattcttacacagcatgaagtagtataagaaatcctaggcagaaggaagttcaggtagctctcagggctaggaaactcctcgacaacgagggacaaccaaatccagcatttaaaaactctgtattttaattcttctcttaatataatacttccttctttattgattgctgagcattctaggaactaggataggattatttggcctgaaggaaagaatacttctcgaacctgatttgttaaatgaatcgagattgctttaaagtgaaagaagggaaaagagagttatctcttttgcaggagcacatttcaatcacttatcactctgggttagcataaatcagataaactatcctgtgggttgtgcaaaaagcaaaacaaaacaaaaaaacacaacttgtaaaaaaaacagagcaagataactgaagtagacaaactctgcacagaagtaactaatggcagggaggagaaaaatttttgtatattatattatactgtgtataatataatgtacctgtgtatcattagagctgttaaattaaaaaaaaaaaaaaaaaaaaaaggaaatggatgcagaagctctgccctcctggggccagaaatggcaatttcagtgaactagggccgacaaccacatccaaaattaaatatttcaaaagcttaaaataaaaaatactagaaaaattatgcagagcacctatttcatttgttaaaagacatttaattagtgtttcacatattaccacccaaatgaataaagcgattgtgaaattcaagaaaacaatcaaactacaagaaaactccagataaaactacaaagttaaacataaacttggcccaggaccactacagtggctgagggatgacaaatacagttctttatattggtaacccttagccatccatcccattctatagaaagaggacagtaccatctttgaccccaggccccctgtcctgaggtgcttctacttaatgccaggaacaactgtgctagaaaaaaagactgcacccaccccagctccagatgcacacattagctggtcggtgagatgcagcagcctggcttcctccctctacccactccttgggggcggggctggaagaggagaatgatgaagagatgttgggggttcaggaaaccttcacatttggccccttttctctctccccactcaggatggaaggtcaaagttaggaccaaaactagagaagtgggttttgcatagggggacaatggattcaacagaagtcctctggatctggcaactgtcaaaaaaccctctttccacttctttccccctcacggaaagccattaggaatcacctctgtctgggtcataggaacagccacacagcataggaggcacaagccccgtgaacaaaattcggtattaagaataaggaaaaagaaagaagacccgagggcaagagggcagggcaggacctcttctttctactggagaagagacatccagggaggaggcacagccgaggggagcgcaagctagaaaagctacgacggaatccccaccgaaaccgcagcaggggtactggaaggggaggaatccgcgacgcagcgaccgcgagccaagggcagcggcgggccgggccgtgactcagtgaaagccgcaacggccgggcctcggaaaacggcgggcgcgaagccgccggggccggggcgagaacggcggcgggggctcaccatgtccttggacgagcccagcttcttgaggccgtccaggggcagcaggtcggcggagtccttgtggatgaactgcaccgcctgcttcatccggcgctgctgtcgcagtgacgccgcctcccgcatgtcggtctccttgcggccgccctcagtgaggagccctgagtaaaacatcgctgaggcgccggcggcccggtagcccacagccccccggcagcctcagcctcgagctcctccagcgccgcaagggccccgagccgcgccttttatagccgagcgtgacgtcgcggggagcagccagtgcgcgcgcggggggcggggccggcacagagtccacgccccgcgcggctccctcgcgtcccgcgtcccgcgtcccgcgtcccctgctcacccggtggcaaagccggcgaggaggcggcggcgctggtggggactgacccggcagtccgagaatccaccgcggccttttcacccaaccgccccctcctgcgtgggggccccgcatcccctggactggcgtgggctctggggcccgatgccctggcagccccggccatctctgccgctggccgcgggtacctgctcacctgtccacgccgtggccgacccggggatcaccgacagccgggccatgcctcgagtcccgccgcccgcgccgctgctcggcttctcagaaacgcacctccacgccgccagccggggctccagggtccaccgcccgggcccggaggactggcgactccctccgaggttgggagcgctccggatttctccaacttcaggtcggtccccacccaccgggccacgtgactggggagggggcagccggtgcaggcgtgtggaggaggctttcgggacctcctcccccgggcaccctctgcctgcagcccggcacccggcccgcgtttccgagccgggggagcaggtgcagtcggaagcccgcgggtgggcgtggggcgggggagtggcgagggtcccccgcctccgcgggagcgcacgcggctgcgagccctacacctgctctccgaccaaagaagcacctgtttttctcaataagtgctagggcttaccatctaaaggatcgttcaccatccctccagcgtccttagtaggagcgattggaacccgtttttcttcctgaataatccatacttttaagccattctaatcgggccttcaggcatcctggattctggtctcgacattgtgatttgacacaaatcacgttttcactctggaaaccacaactactccctccaccccatcacgcaggagcagacctggataagaaatatgtgcactctgcaaagaaccaatgataaaagtaacaatatcgacgcttactgagcctttactatgtgccaggtactagactagacacttaaaatgcagtatctcattggatcctggcaacagcttgtaagatagtattctcatcacccccattttacaggcaaatacctgataccttctgtctggcctcctgaatgctccttggttccattccaatacgttgttcactgtgctgccagagtaatcttctcaaacgataagtgtgatcatctcacttccctgctaagagcacctcaaaaggcttcctattgctcttaggagaaacccacattcttgcatggtctgcctagaccctgcatattcactctgtacttcagcctcatgggccttcttccagttccttccagtcacctgttgccaaatggcctgcctttgactgtcctgttccctctgtgtgcagtgccccctcctaccctcttcaggaaactcctatgcttcttccagacctcagctccattatcatttctttaggaaagccttctctgaccttccagagagagtgaagtctctctaattatatactatctatctcttgggcatttgacactttctgtgggggtaggggtaggggggtactggttgttggattaatatttgtctcctccactgattggaacctccaggaaggtgactgaacccattttttgcttagcattgatgccctaatatgcagagggttctcaaatactagtgaaaggatggcaaaaagttaaggtcgtaccaaagaaatcaagtggtaaagctggcatttactcccagaacctgtgctggactacctagacctggagagactgggtttggcctcatgaagctgcttcttttactctgttctgccttcaacacttgccccagtttcaaagactgtttgtgggaaaacaaatacagaaggctgctcacttggcttcaaggaagccccagggctggattcctccctgtgtgcccatcccctactttcccctacacacggaggacagagtctctaggagacaggtgggattgctgttcaccttccagtcccctggcacacttccagcagtgaacaacagtggctgccctggccccttctgtcccatcacctggatccctgcctgatcactcctccaggtgcagatcacccagggaacagtgaaagtcagctttgccttgtccgtctaggagaggtgcctctgagtttggcaaagcatcagggcaggtccaacagtgagggcccctagggcttgggctgggacagtgactttcctcagggaggaagccaggcaggtagacactctcggggggagttggaatccccactctccaggctgctcagctcagacctgcagccttttttgctgaggatgtcctgacagaagaaaggggctcttttcagagctagatccccctgggaacaccaggaagctgaatctctctagttgaactggaatttgcccatatcaagtgttgctgaaaaataaatggtgcccgactggaactgggaatctttttgtgaattcagagccctttggtgtagtgggatttgtgttctgcagttgggtctgtggctgcaatacctgttggtcccctcacctgtctgagaccttccttggacagactgataccatcactgccctcaaggttcagtgtggtgaggccagctccttcctccccccacacattatgagtattcgcagactacagactgcctgcttaatttaaggagagttatctctgggtggtttatcctgtttgcccaaatgactttgagtaaatcacttcctacctctgagcctcagtttccatatctgtaaaatggatgtagtgagactgcatatacaattgtgctttgtaaactctctagggctgtaccaacagaaaagattattattaattctccatatagccaatcaacgtcccctgcctcattgacccatcttggaggaagtaacatacaatatggttgttaaaaacacaggttttggagtctaatacactagatttgaatccctgctctgctgcttactagctatgtgactagttagttactgcaccattgtgagctttcagttcttcatctagaaaattgtgccaatatctctacttctcagggctgctgtgagaaataaaacgatagacagtgtaatacattggtcatgtagcataggctcagcagaaggtagcaaccatcattacctggaacaacttcaggaaaaactgtaggttgcagaaccctcgaattggggctggcctatcctttctccaggcttccctacagagcttcagacatgaagccagacttgagtatcttaccctatccctagagcagaggcctgctgaggcaggggctggccagctctcttcctctcctcagtgtctccagattctggactttccatgtgcaatggctctatcctaaagttctctgcatcctcccttggctgttatagaagacctgtacttgaaaatcatactagaaaatccagtactgtttcagtgttagaatgctattcacgttattcttcttataagtgacagatacccagttgaaaatttcttatgtgaaaatgcaaatttttggtccccttaatttaaaagtgcagggcttcaggcatggctggatccaaagactcaaatgacattatcactgtgtttcagctctgctttcctctgagctgatgcccctgtaggcagacccttcctgtctgatggctatttgtgactctaggcttacaacctattctcctagcaaccctcttttgggtcttcagctaacagagaggcctttaagaatgagaaacaggatgagtgctgaggcttggaggcctaaaaagtagaggagaagagcagaggataaaggggagactgccaagaaattttcctccccattccctccctacccatgcatattgcccttggccataccctgaagtcagaatggccactcctaggaccctcatcatgcaccaccccatccttatagctgtaggatccctttcctcctcagatgtcctcaccactaccccaaccccctttggcaggaagattcttcgaacagctatccagatgtgtgccaggatctctggctacatggtacccctgacttggcacccagctctaaaaactgtgtctgctttggcagttaaagcaaagataagagatatttctgtcctcttccttcagagtgattgccaacatcaccatgacctcaagaaacagggctgatggcagccctgctggtgttttccaaagttgcctgggtcttttggatccattacagtcaccagtgatttggtttcatttcccgggatgagaacaggctttgacctcaactcagacagcaaaagaggagaaataatggaaagaaaacaaacaccagtatctgaaggacgtgtgtctggtggaagtggggaagtgaggagtctaggcttagctttgaatctggttccaccccttgcttgctatgggaccttggccaagttactgaagctctctgagcctcagtttatccatcttgcagggttctgtctcatttgagtgaaataatatataaaggcacaaagtgggctctcaataaatatgtcctgttcctctttccttcccctctccaacataggtagagaacccagaaaaagagtggcccttctgagcctagtgggaaactctgcagtatagaaacaagaactctgaagatggcaagtctctcagaatacagcaaagcataggcctaacccacctgctccttatctctttatgtcagccccagccaaaggggacaatgcctgcagcgtggctcacactgatgggtaacttctgtctacctcaggagcactgagggctctacctccttccccccagttaactaagcatgttgctcagatgtgatggtgtgcatgctgggcaagccacaggggctgggggccagtgacagcagagaggtgaagtgctctgtggaacatgtgtagactcccaggtgtgcaaacatgtgcatgcgctcacactcatagtgttccgtctgaccagttttcgcacagatctacactgcccaaagagaaaagtcattcaggattatttaaaaacttttaatttgtaaaaaaaatttgaaacttacaaaaagttgcaaacataagaatagtagaaaaaacacctgtatatccttttcacagattacctgttactaacattttactccatgtgtttttcaggtgcttattggccatttgtttatcttctttggaaacatgtctattcagatcctttgccgatttttaactgagttctttgtcttcttattattgaattgtgagagttctttttttttaatactttaagttctggggtacatgtacagaacatgcaggtttgttacataggtatacacttgccatagtggtttgctgcacccatcaacccatcatctacattaggtatttctcccaatgctatccctccctcagccccctaccctgcaacaggccccagtgtgtgatgcccccactccagtgtctatgtgttctcattgttcaactcccacttatgagtgacaacatgcagtgtttggttttctgttcttgtgttagtttgctgagaatgatggtttccagcttcatccatgtccctgaaaaggacatgaactcatccttttttatggctgcatagtattccatagtgtatatgtgccccattttctttatccagtctatcattgtgggcatttgggttggttccaagtctttgctattgtgaacagtgccacaataaacatacgtgtgtatgtgtctttatagcagaatgatttataatcctttgggtatacacccagtaatgggattgctgggtcaaatggtatttctagttcttgttccttgaggaattgctacactgtcttccataatggttgaactaatttacactcccaccaacagtgtaaaagcattcctatttctccacatcctctccagcatctgttgtttcctgactttttaatgattgccattctaactggcatgaaatggtagctcattgtggttttgatttgcatttctccaatgaccagtgatgatgagcttttttcatatgtttattggctgcgtaaatgtcttcttttgagaagtgtctgttcatattcttcgcgcactttttgatggggttgtttttttcttgtaaatttgtttaagttctttgtagattctgaatattaaccttttgtcagatggatagattgcaaaaattttctcccattctataggttgcctgttcactgtaatgatagtttcttttgctgtgcagaagctctttagtttaattagatgtcaattgtcaatttgggcttgtgttgccattgcttttggtgttttaatcatgaagtctttgcccatgcctgtgtcttgaatggtattgcctaggttttcttctagggtttttatggttttaggtcttatgtttaagtctttaatccatcttgagttaatttttgtataaggtgtaaggaagggatccagtttcagacttccacttatggctagccagttttcccaacaccgtttattaaatagggaatcctttccccattgcttgtttttgtcaggtttgtcaaagatcagatggttgtggatgtgtggtgttatttctgaggcctctgttctgttccattggtctatatatctgttttggtatcagtaccatgctgtttttgttactgcagccttgtagtatagtttgaagtcaggtagtgtgatgcctccagcttcgttctttttgcttaggattgtcttggctatgtgggctcttttttggttctgtatgaaatttaaagtagtttttccaattctgtgaagaaagtcaatagtcgcttgatggggagagcattgaatctataaattactttgggcagtatggccattttcacaatattgattcttcctcttcaaggacctcttcaaggagaactacaagccactgctcaaggaaataagagaggacacaaacaaatggagagttctttatatattctagctacaagtctcttgtcacacatgacttgcaaaatttttctcccattttatgagttgccttttcactttcttgatggcttcctttgactcataaaaatgttcaatttcatttgcttccctgcaaaacacacacacacacacatgcacacacacacacttttttctgaacgattttaggatagattactcatacattatgatcctgtaccactaatacttcattgtatatttcctaaaaatagagatttttctcttatgtaaccacaatacagatagaagcttgataaatttacattgatacaatacttttatctaagctactattcatgttccaattttgtcagttgaccatttataacacattcctccagtacaggatccaggctaggagcaggtattgtatttggttgtcatgtctctttagcctcctttaatctggaacatttccacagctttctttgtcctccatgacacagacatttttgacattcaaaatgttaaaattcaaaactgtcagtgtcattaaaaagggttaactggttaacacaaaaaccagttaaccctttttagttactggtttctgtgtgtgatataattcacataccataaaattcacccaattcatacaattgtacttaatgtgtacaattcaagttttaaataaattcagagagctgtgcaaccatcaccacaatgacttctagaacatttcatcgtcccaagagaaacttggtacccattaatcattccccattgcctaccaatttctccagccctagacaactaacttgtaatccacttcctgtctctatgaatttgcctattctggacatttcatgtaactggaatcatataatgcatggtcttttgtgactggcttctttcacgtagcacagtgttttcaaaattcatccatactgtagcatctatcagtatttaactatggccaaataatattccattgtatggatctaccacattttgtctagctgtacattagttgatagatatgtaagctgtttccacttttaaggtattacgactaatgttgctaagaaatctcatgtggaaatctttttgtgccttttattcatctcctggagtagaattgctgggtcacatggtagcccgtgtgacttttgaggaattaacagactactctccaaagcagctgcaccattctgcatctccaccagcagtgtatgagggttccaatttcttcacatcctcttcaacactttttaccatctgtcttttttattatagccatgctagtgaggttgagatggtatctcattatggttctgatttgtgtttccctgatgactaatgatgttaagcatcttttcaggtgcttattggtcatttgtttgtcttctttggaaacatgtctattaaaatcctctgtccatcttctttttttttttttttttttttgagacagagtctcgctctgtcgcctaggctggagtgcagtggcgtgacctcggctcactgcaagctccgccccctgggttcacggcattctcctgcctcaacctcccgagtagctgggaccacaggtgcccaccaccacgcctggctaattttttgtatttttagtagagacagggtttcactgtattagccaggatggtctcagtctcctgatctcatgatccacctgcctcggcctcccaaagtgctgggattacaggtgtgagccaacatgcccagcctcctctgtccatttttaattgagtgatttgtctcattattattgacttgtaagaactctttacatattgtagctattagtctcttgtcagatatatgatttacaaacattttctaccattccatgggctaccttttcacttcttaatagtgtcttttgaagcacacaagctttaaaatttcactgatgtgcaagttgtttttcaacttccctcccctttttaaaatagagcattcttcattttgtgtttgtctgcattttccttgtattgagattgaggtgatgcatttttggcttgagtacagtataggtgatggtacgttcttctcaggctatcacatctgtaggcacatgatatccatctgtcctttattggacatgctaattttgatcatctggtcaaggtattgcctgatttctctgctgtataattactggcttttttcctatctcattcatgatgtttaaaaaaatgaaattcactcttttcagtctgtctacactccgttagcacattgcactttgagttctgtactctccctggcacatgctgcacagtggtcagacccaccttggccaggcctgtgtcctcatgtctcaaaaaggggctttgtttcaatgaccacaggtttcatgcaaattattcacaccttgccacagtgagtgtcttcattgaccttgcctgcctagagacctgagtactgccttcttggactctgaagttggatgttgccatgctggaaacatcgaatagaaataggcagttctggaaaacatgtgcttctgggctcagcaaggagatgtactgtgatcctcacataccaggggctgaggattggaactcagaaaaaatgaaggattgagaggctgcgctgtgtatgtgcacttgtgtctgtgccgtccctgacctaagagaagctcaggcgattggaagagctcattttaccttcccagctcaggaggacacgggtgtttggaaggccttgtgtgagaacccaaatcaggcatcatagcctttcattcctacttcaagctttaatttttctgttgctaggacataccccactagaaaaactgtgactaaagaactttccatctcagtgaaatggggaaacccagcagagagtgaacccctttaaagaatgtttcttgggtttaacttctaaagtctcaagaagtgaaatgtaacgatgaggatgacagttaacgtttattgggcccttactacatgccaggcaatgtttcaagagttttccaggtattaactcatttaattctcaaaacagctctatcttgtaggtactatcattatctttatttaccacatgaagaaactgaggcacagagaagttaaataacttccacaaggtcacatagctaataagtggcagaactgggatacaaatccaggtaccgtaaaggacataatgggagtcttggagaatatgagcattatgaatcataaatcttagagaaggcacctatcagtgtgataaatgtagataatgcattttcagagaagtacattaggaatactgggcccggggggtactgggtgagtgatgctgtttgagtcatcccagttcctcatggggagccttagtgatggtttatcaagcctctttttttaaattgttttgttttttgtttttgagacagcatctcactctgttgccaaggctggagtgcagtggcacgatctcggctcaccgcaacctctgcttcccaggctcaagcaattctcctgcctcagcctctcgagtagctgggattacaggcatgcgccactaccgcccggctaatttttgtatttctagtagatacagggtttcaccatgttggccagcctggtcttgaactcctgacctcaaatgatccacccgccttgacatcccaaagtgctgggactacaggcatgagccaccgtgcctggccctatcaaacctcttatacttggcacctgcattacttaaaactccagtttaggtacctgatgtggctgctaaaagctgacttcttcaagccaagtcacctggaagtaacattggggttccaatgtgctacactgtccacagttttatagcatgatcaggcatcacacacacaccgctgcattgacagtgtgtgctgatgaccaatttgtggtcacacaggataggttacccacaaggctgcagagggccgcacttagcaggcttggccagggttcaccacaagctcacactctgtacctccatgctgttctgctgtgcatgctgcttcagacattactgggctctgtcttctctggggcattggttccaattcctgcttagcagctgttaatttttttcaactgccacacatgtaataaggcaaagccagcaccgaagctcaaatttgaggtaggcttgtatttctactttttgcgttttgtagggaaaagacagaaaacttcaacctgtggcccaaaattatccttcagtcctaggatactgtgtaggatcagagaacaatccaaggcaggggagtgtggtagggagctcctggaactacaaagtggtaaaacatgcaagattataattgaggagtagattttgtcctcatcattccttcaactccttttcccttctgactcaggactatatatccagcctaccctggtgcctagaccgtaacagtgaatgcatgaatatgcggtgtttgtatgtgagattcagagcgttgttgatagtttgaaatgacctagatcaatgagtttggacttggtcactagtttttctctgccaagcagagaaaaaaggaaaatatctaaacaaaataaactccgagggctgtgtcaaacaacatgcgaccaatcagttgtcaaatcacagccctagtccccagggccccttgggtaagatcttgtcttgaattatgggcatgtaaggtctgaggcagtgggacgggagacagaaacacaggtcgactccatattgcaaccactaggtggcacctgttcgaggaactgccaaatggcttgttcacagcttgaagctttggtcagcttggcttgacatgaaatgccaaggtcttgctgggcggataaaggagcttgccagggccagtgctgccaggcttggtttgaggagccagtgctctaggaggggcctggattcatgactctaatgatgagctcatcctaagacagcagctccctcccaccacctcctcattctctgtcctttagcccttccttatttataccactcatcactacttgactttacagtatatgttcatttgtttattgtctgtctccccagactggaacctaaattccacaagagcagggagcttcttttgctccctgcagtatccctggctcctacaatgtctagcacttaataggctctccataaatatatgttgcataaatgaatgaatgaccaaaaacataataagaaattattagtaactaaggtctgtagttgcatcccctttatgagatactctgaaaaccaagcactactgagttactgtcattgcttgcagtaggtaggtttaatttgtatcgcttttattcaactaaggcaaactgcctatattagagtggtttcattttctaaatctattttgatgccactgtgttctctggaaagtgctccctgctgagtagtgatatcttcatggctatatcactgacatggatcacaggagcagccttgctgtgttaacaggtccctaagggtggtctcctgcaggctgatcgagactgcctgaagggagaaggaggcagggcactacaaatattaggacacctctgagctgggctcacaagcccctggaatggaagatggtcacagaaatgaagcctcaccaaggcctctaagtttctgtggatgggcccctactggccactcccaggaccttaaattgtaggcagctgatggcttgcctagctagagggccgtatgcaacaagattccctcaacttggtgaggaactgctttactccagcctcagctagtccatttgcctcccaaatgctggctagaagtagtgcagacttgagtaaggctccaagacgtatcctgctgtgtgaaaagaagcagagatgctgacagtaagaggcatctcttcagggctaagaagattacagctgggcctggaatgacccctgggttttccagcacataggcccaccagctgtggtggtcagctgcaggcaacagctccggtgcatcttcctgcaaagatctgccggagggtaagcaagtccttgcactgtgctgtgcagccactgccttttccaggttgccacatgacattttaatatcacctgcaaacctaaatccagtgagtgcctacagacgacacacttaacagctcagggcatgattcagaggaagcaattttccaaagtgaagataattgtctgttagtgtgaaaaggcaaacacttttttattagcattggaaattcaagggagatgttgttaaatccatagatgcagcacttcagtaaatggctaaagaacaatatctacagctagaaggaaggactgtacagatccatgcccattcagggttcacccatagaactagctctcttggagggaagatggaagctcagctctgacctcttcctgtttacttaatacgcagctcctcaaagtcctggttcctgtgcccacacaggaaatcccagaattaagagttccccggtcttcttttatttacatgtttcccaggtgaccttaaccggggtaaagtctcatgcctttactctgtgacattaaaacttatattccagccctgacctctcctggggctttgtataaccatttgcctatttgaaccctccagttggacatatgataggcacctagaacctagaatggccaaaatggaactcttaaccatctccccttttcactgttatattactgcataagaagtcacctcaaaacctatcaatcatttaagataataatcattaattttgcacacaaatctctaatttttctgtggttcaatgaggactgctccatgaagtgtcagctggagcagctggagaatccctttccaagatggcttactcacgcagctggcaagttttgctggctgtcgcctggaagctcagcctggccggtgggtggagggactgtggttcctctccacatggcctctccacaggctgttatggcttgcttcctcatgacgtggtgactgagtttcaagtgtgagtgtcctaaggagaggaagtggaagctgctagtgtcttaagccctgggcctcgtaaagcattacttctgccatgttaatattggtcaagcagtcacagagcccagagtcaaggggaggtgacacagaccccaactgtccatggaaggaacctcaaagaatttgcaaacatgttttaaaactgctgcatatcccgaacctgctcctcctagtctcctccatctaccagtttcttaggcaactaggagtcatctttgacttccttctttccctcagcacttccatacaatccccatcagcaaattctgttgactgtcccccaaaacacatccagaatccttctacttctctcatctccactacaacaccctaatccagacaataccttcatctgccaactggatggctgcttgttctgttgcagtagtctgtgaataactctctctgcctccgtgctggcttcctattcacacagtagccacagctacccttttaaaacataaatcagattatctcactcctctgcttaaatccattcaaaagtttgcaacatatttagaaataactcaaacccctcattatagattccaaagcccgatgtgatctggccgtgtctggttctctagcctcatcttgtacgacctgccttctcactagactacaatatacacaaatggttgctcctgcctgacagcctttgcacttggttttcctctctctggaaagctcttccccctaattttcccaagactggtttcttcttgccatttagttttcaattgaaatgtaatttccgcatagaggccatctataatccccaatcctaaagtagccacacaatcatctgttacagtaacctattttaattttcaacatagctcttaccactagctgctacttttcatgttgatttatctgttctttgtctgtctcttccctctaaaatgtaagcttcatgagggcagggaccttgtctgtcttatcgccgcatccccagggcctagagtaccaggcagaagtttgataaatattgatgtagcaggtagaaatagtatctccagatagccagcccccaacaggatcacagcatctcttaaggtagttgagggaatagagaggaagctcctctttatacctcctgtgcgtcagtggtttgtgcgtgtaccagcaacacagctctggtgcatggggctgccccgtggaggatgctcctccatagtgaccgggtttatgcagcctccttccaacccccagagtattcccatccctagccttcttgtgaaatcagcaagacaggatcacacagtcatgagcacaaagttgctaacatgcctggacagaatggtgcagctcagctcatctcaccttcacatcagtgcggtcactaactcgggtttatgtgacattcgaattttcatcttatggttagactcagaaatataggccaagctccagtataacaaagtccaagtgcttgttttaatgctattttttttttaatgatgatgttcaaacttttgaagagaaatctgaaaatgaatatttagggcccatccaaataaagaagtttgattaggactttttaagaatcaatgttattaacaggttaaaaaaagcaacactgagatgaaaagcaagtttaaccataatgaagttctctttgttttcttcaaaaatgcttgttaaacatttttttagtactttggtatggagaattggctgtgcatagaattgttattgaaataacaaaacactatagttgtaggtagtccatccattagggaagtggtggcttgtttgattggattcctttttattcactgtaatgagatttttgcttggggatttaaatgtttaaagattcaataacactgaaaattcaagttcaagaaatgatcgtgaggccctgctggcctgacccaaagtgagatgatcgtgtggcattcagggggtgtttctggcagtgctgttactgttagagaatgagaccacccttcaaggggctgctcatgtccacggagcagagtccgtctctcacatttgagactggggaaggaaggcatacatgacaggctgggcctcaccacacccacctggacctcagatcccttgtgatgggaagcccacttggggagtagaacccttggcaataccgactcagggttggtgaaatcgccttttcatgacaattgatgattctcatccactgaggaaattacatttcacctgaactccccagtccctcaggcaatggccagcagagtgtcagagggcacagctgaaggtgcgagagtcagcatagtgcatttgctgcagggtggaagcttgcaacgaggaaggctggcaataaatgtacattattatgtctccagaagtgcttagtttttatttatttctaattctttctgcttttttttttcacgagcactgcttagaactcaagttcctgggatcaaacttgtatcacacaggctggagaaggctgtggagaaactgagtcctcccaggtctcaaggtgggtggagggagcctgcaggggtctccttccctcccctcttgcctgttctgcctggtcagagcctgcacacgagtgcagagggctcccttagagagggccgggctagaggaagctgaagtttcagaataagcagcttattctgtggcctcctttccactacagactccttgaggaggagtaagaccccagaaggacaggtgagtctcacctaggctgaccaaagtccagctcagccagcccgtgatctatccaagacatccgcccacagcagtgagaagctgatgccactcaaagccattctcagtctacatccacgatgctgggaaagaaaaaccaagttcaatttaccaaaatatctgtattatctataaaaattgaactctaatgagtcactgatacgggaggcagcaatacccgactgtgctgacatgcagaaggaagacagctctgtcccaccaaccctatagcagaacatttgtattgagtggcacgtgggctgagtcatttgtaaggtctcaaaaacctggacactttggaacgtagcaatcggatgaacgatcttggaaacatctctcgggactcctgggctgtgtacttgaaatagttctggggatgggccaggacatcaaacagagccttgataagtttcttatcctaaaaagaacagaatttttgttactgggccaaaatatttaaatatgctgacattttgcccatggaactataatgacccagtattaggccgtagcttgcttagctgaaaaacacttgcaaaaattgtttcctctgatttttatcttctttccagtttttatttttcctaattagttttaagaagtatgaattacttttataaataaaactttaatatgtaaaatcctgttttctttttcccaaccagatgaatgcaacactgggatttgggagtatttgtaggattagtgataccacaagtgtttattgctaattatttataagtatttaaactttggtgaattttaggcttgaagtatacataaagagccaaggatcctcaactatttggaattaatagaaaaacattatttgctgttggtttggatttataagcaaatttctccctgcccctccacaagtttccaaattgaaaaatacaacttcacttgacaacactaaagacagcaacctgatttttttaaaaattaagtctggtgaaggtataaaactgaccttggcccaggacaggctccgtgtctgaaaggtggcaacaaggagcaggaggagaagccttctccaacagtactcgggaagctctgtggataactgccatgtccacctgagccaggcactcaccttaagtatttcctgatggttctcagatgcatagagcctgccatctcgaactatgtcttcaatgagttcctggtagtcctctgttggaataaagaacatgttttgcattcttatgatttagttgcttccaaactcactctttcactttttgataaggttctgagaaatgccccttctgtggctgctatcacttaccattctgcttactgagaagacagtcagaagaaaacttccacagactcccaccaccacctctcttcacctaccagcatctgcacccatcttccccgtcccctcttccctcagacgagcctctgtgcatccagtccaggctcatccctccacttagcatgccaggtccatcttctctccccaaatcaaaagcattgttctagtaattctgctctttctttcctacatgatacatttttctctctattcgtctctcccaccagcatgcaaaaatgctgtatgtctctgactttaaaaatccctcccttgacctcatttctccctccagcttccatctcacttacctgctcccttttgcagcaaaaatccttaaaaaaattgtcagcacccactgtctctaattcttttcctttctttctctcttaaacccagtccaatcagctttggcccccatcactcctccaaaactgcttggtgagaccagcaatgaccttcatgttgttaaatcccaacggccagttcttggtcttcatcctccttgatgcatcagtagcttttgacctggctggtcactcctcctccttgatccagttcttcactgagcttccaggacaccatgctctttggttttcctcctaccttaccggttacttctctgaggcttctttgcttttcttcttctctctgacctattaccaaaggagggtcccagggcttagtccttggtcttctcttctctgtctatactcacttcctgttgagctcatcaggctctcctttccctctcacctccccacctcccgcttttttctctattcttgtattatgtaaaacaatcaagcttcttatccaccaagaaagactcttctctcctttatttgaatggggctggagggtggagaatttggctggtcggggaggaagaaaactgtgtgtgttctctcattaatattttttgtcctgatatacacattaaatgcagtgcatgctgtacttctccaaatgccaatcttccccctttgaagtctagcttacttcctataggcatcattcaaattaagcatatgcaaagcacaatcttttccaaattccagacacagaaaaaatgcctctttgtatgcatatcatgtgcgacaaagccaaacacattatgagaacatcattgaaattgtgtgagaggaactcttgaaaagtttctctcagttaagggatggcaaatggaaagtaatggtataatagtcacaattactaattcgatatgtttacaatagcattggtactccattagtgtggtgtctttcttttattttagtgaatataaaatatgagaatacattttcttttcatcttgaattcctctgcggcagtatctctcctctttttgttgatgggacttaccattaagaatgtcggttgctgtgctgcgttctggtgtaatagaaaactagacagctgtttgccactccaccaaatgcttcccgactgctatcgtttaaaaaaaatatttcttctgcttttaagaactactgtgtttccttacttgctccaactcattagaaacgcaggaaagttacaggtaagaatccaggctctggagtcccacagtcctggttcaaaccttgctttgcaaccttgccatgctgggaccttaggtcagttccttaaatctctaagcctgaatggcctcatctataaaatcaggaaataatcaagtctactttatggagtgattgtgaggaaagcaccatgtaaaagtcacttcagcatgtacctggcagtcagcaatgctcaatgtgtgttagccccagctacagttctcaccgttgtccagcgctcagagggcccgtctgtagcagcctcatgtgcaccttctaaatgtgatttctatccttctgggtttgaaaagaagatatcaaactttttggaaatatatgtttgaaaaaaaaaaaactctgagtgaaggccttgggagcttctctgtggggaaaatagcagtttccaactattctctactgtgacacatgcaagactcactctcgtgggcatacactgcattatgcgtaattttccccagttggagctacaactctttttcattttaaaaaaaatcaagacattttcatgtgtcacaaaggcagagttgagaacagccatatttattttgaagtctcagtgtctttttgctttcttcctgattccagataggagaggttgccagttggttgcttttgggtagatgaggctctctgtctctctcagcagagccatgtgggaggcatttgggtccaccccaagagatactaaaactccttgtcttgggtgtttgtttgacattatttcaggcatctgtaggacaaagatgatgatccgtgcttttgttactttttaggaaagccatagaatattgtcttcccaaacaattttggcacttgtcatcctaaaatccttcagtggcttcctctaagattaagtctatcctccagagcttggccctgaaggctcttcacagctgaaccccattcccttctagtctcctctctcactgccaagccccacacacccaacccactgaccaaataagaccattcgtcagtccacacgtacaccggggtacttcatcctttgacttatgtccttccctctttctgaatgtccttctcccccatttatgctcaaaatgtatatgttatttcaagacccacatctctcaagactttgctctattccttctaaaagctcatgtaaaattaactgctgctgctgcttccatgctcacatagggctttgggctgttatagcagctataacaatatatatattttgtgtttctgtcactaaccatgttgtttccagcacttaggccaatgcctgacatagtagatgctcattaaatatttgttggctaggtgaacaaataagctcaggaagaaacaaatgactcctctcctacaggactgtgtagtcctccaggacaaagatccagttcattttatgctcctagtcaatgttttccaaccaagtctcagagctaggtagagccccagggctcagatgggccacctcttcatctaacatgaagaaaattaaaacagaagtcatctgacttgcccaagatcccacagtgagtcagtgaaaaagccaggaccagaactaaggtccttccctgcctcaggattctacctaataaaagccacaatcatcagaagttaatatttactgaacaattgctatgtgccaggcactgcctcacgtcctttaggaactctcactgaactcttaaataagtctaatgattatcctcattcgcacattaagaacttgaggcttagagatggtggcatacacagtcacagagaaatcatagccaggctaatcagtctgactccagtgcccatgttcttactcaccaagctatgctcacttttaatatattttataaaacatcttttcctcctattgtcagtgtccccaaatgcctgttaaaatttggcacttgtgagtcagcaatgtcttttcccctcatcttgcctgcctttctgagcatgtgtgcttgtcagcagtttgccagctggctccgaagttggctctgttcaaagcagagacgctctttccatgtgctgcaggctgtgcttaccatcatatgtcacgtatgggacctggaaccctctagcgctgttcccttcattggacttgaactgaatccacagcttctttgacctggaggtgaaggcgatggggcgttcgtaggtctggcaggtttcatatgttgtcacagaattggatgaagctgccaagggaagttggagaagggtggggttcaagactcatcactgatcaggcatagagtagatgctcatctttctaaacactcaaaccatacaataagttatgctcaaaagctcttcaggcccagctgagccatcataagtcaaaggtcctggaaacagagtagattcagctggtaattgtggacccccaggggaggctacacctgaaagacctggggcttggcaagcagcagcagcccaggctgtaccgttcactgtaggagctgggtgagggcctcccattccagaactgacctgctgtcatctaattgtcatcaccaccatttgctgcctaagatcaggcagcatgctaggcaatttatggactttgtctcatttaatcttctgaaaaccacagaaagttggtgcaaccgttacctttttaatagagagattaaatacttgcccagggtcatatagccagtatgtggtaaaacaaggatttaaacctatacttgacttcagacattttaaccactaataagaagagcaaacgtttatatagtggctccatgtgtcatcatcattctttgtttgtttgtttgtttgtttgtttgtttgttttttgagacaaggtctggctctgtctaccaggctggagtgcagtggcatgatcacggctcactgcatcctccacctcccaggcttaagcgattcacccatctcagcctcccgagtagccggaaccacaggcatgcaccatcatgcccagctaattaaaaaaaaaaaaatgtatagagacagggtctcaccgagcctggtcacaaaatcctggttcagcctcctccctcagcctgggattacaggtgtgagccactgtgcctggcctattctaagtgtttcacatctatgaactcctttagcccttataaccttataaggtagcaactgttactagccccattttaacagatgagaagacaagtgcagaaagattcagaatgtgtgcccgagatcatagaactagtaagaggtggaactgggacagagatccaggcagtctggctgcagagagcccctcattacactgcccataagctgtgttgacagcagtcttcctttatggacactggaccatgaatcaggataggaggacaggtccccacctggccaggctcggtcagtctccaagccatcagttgcaactcagtatgaggccttgtctggggccaacactgcatgatcctcactggctctctgggtccttgtggaagagggtccaaaacgccccagtgagcacagaggggaagactgacctgcaggatcactacctctggggcccagcaagacgcttcagtgtgtggctttcatttaaattttgtttctcaccaactctataaactcatgttcacctctgctctaatatggaggtgacgttctaggcctgcctcctcacattgaaagcctgaggagcaggtcatcaggcttcccagctggcctgagaaagggagggagggagtgagacgcacaggttttccgcatcaccagatagtccccacagtcgtcctctatgggcaggaagatctcagggaccacgatcaggatgcggcgcttggggggtgggttgatggtccacgtacactcggtgttggctgggtaattgcctgggtagtttggggattcaatgtacccagtgaaatctcccagctcccctccacatcttctgtctgaaaaaggagatgccccgagttatggcacgacactgtcatctctgtcctgaccaccgctagcttgccgagccccgcagcacccctgttgccacccaggaatggggcatgaaaatgacaccatctgggaatgagtctgtccttcccagagggccccctgtgggagccaaaccattagctccccacaaggagtctacccctctgagttcctgaggcactgttttctcattagcccgaaagtgttcacggtcagggcaggtaattgtgaacaaaaggataaatttagctttcagtattttgtttaccaagtccaagtgccagaagaacccatgagacagaacttctaggtctctcaaaatagggggaacagagctcattgctctgcagagactatctgaccctttttcagagaactttgatgaagacagacatatatttttcacttttctctctggttaagaccacattttattttttattcatcttttaaaaaaattattattattttgagatgaggtctctctctgttgcccaggctggagtgcagtggtgcgatcatggctcactgcgcccttcacctcctgggctcaagcctcccaagaagctgggaccatatgcaagtgccatcaggcctggctaattttttttcctcatttttttttgtggagacaaggtctatgctgcccaggctggtctggaactcaggctcaagctatcccggccttgtcctcccaaagtgctaggactacaggcatgagccactgcacccaacccacattttatttttaaggaaggaagaaaattctaattagctatcagtaggtacagggcatgctggatacctacgtctggcaccaaagacagaggctgcacacatgtgcacatgcttgcacagacccctccttcacccacagcacccagctgcatcttcattcatcccagaagtgtcacccaaagctctgagagctcagaaatgagaaagacacagtctttgctctcaaggagctcattatttaatactgtcaggtaaatctgtgcaagagaagatgttgaagggattactttttccctctctagttacaactgggatttattattactagaaaaaaaataaataggcttttcttcttggaagaaaagaggaggaagggggagccatggggcggagaattgccttcagtcctgaagggctgccctaggaactgtgccataaggctcccatggggccaaccaagggccaggtggtggaatacaagggaacattcatcttgttctaacactgtgagctttctaaagtccaatccaccaacaagctaggatatcatgaggtagcaagcttcctgtcacagcaggtattcaagaagagactagatggaaggctacttataaagatgttgttaaaaggacttccttgcaatagagagaaaaccagatgatctttcaatcataaagttctaatgatgtactgcccccctcagtcccaagctcctccagtttagggggggcctccttgctcctctgactgctatcttaaagattagctgggatttacttttggcctttactacagagtttttgttgtaattttggttataaatagtggctttaaaaaaaaagcctagacagcaagtccttaaatgatttgcttcccccttcctataaaacacaaaccggtctcctcagcatccatccgaggctttgcctcctggtctgcctgagactcccttcggcacattctagcctgaggtccaggggtctcctcccaaaaggcctttgcttgcctcgatctgtgcttcccccagctgctctctcaaacataaggctctttctcctactctttccccaccctctccatcaaaaccttctcacaccctccagaagcctttcctcatctctcgagacagagtcaatcgctccttcctctgcagcctcactgcctgagctccttgcaggttcagcgatgccgactcattctgcctaatatcaaccaagtcccagcagaatgctgggcacgtaacaggtcctcaagcaatgcatgctgatcaaggctggactaaaattatgccccagggaggaaattaaggcaagtacagcttgtaagtgtgcctgaggaagtagccaggatcaataaagatgagtcgctctgcacagtcaggccctgctctctctccatgctggtctgcatggctgtgagctgggctcataacatctacatggttctgagtgaacctgggacctctgccccgtgccccctgctctgaggtggacccagacacctatcttcttagccagaactatgaaaagccttagagagggacctacttttacactgggttatgtttgtggagccatcaaagtcagtcgtagtatttcctgggcaagaaacacaattattttttccaaattcaggctggtatgttcccactgggcaacgaatacatcggtgagtggtggtgttgtagaaatgtccaggtgaacattgaactgtgggtcaagggagggtgaaaagaatgaaaaaaagaaagattatttttaatcaaatgcagcacaaagattttaaagtttgtgaaagaaatgtttatgtgcaaatgaagtagggctttcctaccaatctggggctaatcaacacttaattccctaaataggcagtgtggatggggctcatgaaatagagaaatatagaggaacaagatatgtgtgtatctccaaagagtttatggttcatgcagagtcaggcatcaatgatcacaactccagtcttcatgcagagcacgtctgtgagtatagggggcaggcagttgcagaactgaggttgggtttagagttgggctccctgggaaaaggcagctggagtggggttctggagaaggggtattggggggaagctctaggtcagggcactgagatggaggagggctagaggaaggaaccaggggaacctgtgtaccaactggctcatcagtgcctgatcatcccttgtcagcctgtccaaaggggctaaggtggctggaggacagcttgtccagtgagttccagtgccccctgcacatcctgctggggcgagtggagctgggacctgaacccccagccactggggcactgcatcaggctgggcttgactggagcctcacgagactcccatgatacttagaagggaaatccagtcctagaaaaaggcaagctgccaagtactcacctctggtttcacagtcctgaaaggaagtagctccctgatgtttggtggcaaggcctcctccacaggggaagcaggaagttcgaccagcttcaggctggaacgtgcccagggcacagagatggcaaggtgcaaagccatctgcagaatattcaccaggttgacacagacctggaaggaccaatagccttacgtgagcaaggcctccaggcagacccttgctccccactctccaaatgagaccaacttcagtccaacctgttacccagtgctgaccgcagttcccacctcagtcagagagcacacagtcaatgctgtggtgcttctgaccctgagtcaatggcacatgagtgcctgctgtttacacacagggctacacagcacagtgcaaagatggaaaccaagaagtcaagtgtcaactgcttccaaagtatgggaaggcctgggtagttctcaggcttaggcctacacactgcctaggcatcccctgcaatgcaggagagagagttctctgccctgggaccaatttggtaattagacccagaagtacccctttacccagctgattacagcctattgatataaagagtgatccgggctgggcttgatggctcacgcctgtaatctcaacactctgggaggctgaggcaggagaatcacttgagcctaggagctcaagaccagcctaggcaacatggcgaaatctctacaaaaaaatttaaaaattagccagacatagtggcacatgtctgtagtcccagctactctgggactgaggcaggaggatcacttgagcccaggaattccaggctgcagtgagccatatttgcaccacggcactccagcctgggtgatccagaaagaccttgtctctaaaaaaaaaaaagagtgacccaaagagtctcccctgttttaacaataatatttactaagttagatcttacacatgttatacctgggacaagaaacacagtcataaacaaacaaaaggatttctaaaagcacatgttcctcaggaattagtcattggcaagatgctatcaaaatctgctatctatctcttatattcttaatcatctctcctctattaatcatagtggtctcattttcccccataagttatagatatgatggcatttcaagaacacacaccattgggaggagcctggagcctgtcagacctgggttctgattccacatcctccacttggctgtgtgaccttaaaagagtcactgtagcctcgtggagttgtaatgattatatgaattgtgaataattcatataatatacttagcataatgcctggcataggtaaatattcaatacatggtagctataataaccattattactaatattcttattgctgtcatttttttttttttgagacagggtctctgttgcctaggctggagtgcagtggcacaatcacagcttactacagcttgacctcctgggcttaagctgtccctgcacctcagccacctaagtagctgagattaccatgtgccaccacgctcagctattttttgttttttttaatttttttctacaaacgaggtctcactatgttgcccaggctggtcttagggttagggttagccacctgagctcaagtgatcctgaacccaaagtgctagggttacaggtatgagccaccatgcctggcctaaatttttcttaataaggtcacataggccgggtgcagtggctcacgcctgtaataccaacactttgggaggccgaggcaggtggatcacctgaggtcaggagtttgagaccagcctggccaacatagcgaaaccccatctctgctaaaatacaaaatttagcagggcatggtggcacgcacctgtaatcccagcttctctggaggctgaggcatgagaatcacttgaacccaggaggtggaggttgcagtgagccgagattgcaccacagcactccagccttggtgacagagtgagactctgtctcaagaaaatataataataatgtcacatacaagggtaaattcatgccaaaatgtcacccctcatcaaccttgcagttagttttggagttttataacagaccaaagagatgataggagtcacacagtcaatatgaggatttgatttttaagccagaaacagccttgcagttcagtttggagttatttaggtgggaaataaagctgaggctgggagtcactccaaggacagccgtgggagcagcacgaggggtcttcactctgccgtggccatcagatataaatcaccattcagatcacacctgccattggagcccacagagtgtcaatacagccagcccttctcccatttaataaaaggaagacatttaataataaaataaataggaaagcccacagagcttgagattgacttcaaagttaacattttataagagataatgaaaagctcttcacagaggaggtcccagttttaacaaaataaacggatatatttgttttaaataaaaaagctaagaatttgagaccaaagctggagaaaaacccagacctcctctcttcattttaacactttcaaaacagtacctatagatagggaaatcactcaggtttcaggtgtatatatttccagtgaagaaagcacgcagtttcaacacttacgctcttctgctagtgtattctaccccatcttcatttatttgctcaaatgagtatctgcccagcatgtgtcaggcactgacctaggcactggtgagccaaagatgaatcgagccaacgtggtccctgcttgtaggaagccccgggtgagtgtgcattgtctggagtccttgagatgccttctgtctaaacaatgacatcagagatgggaggagtaggaaggaacagacagcatccttacctccacattcagacatattccaagcttctggggtcttcagggccccagaatttcctggtcttgggcatggttcacaagtcatttgtccttcctcattttggaaggttccatttggacataaaatgcagcgttctcgtgctccatcataataggtcccagccctgcaactgactagccaaaagggaaacaacctggtcagtgtggacacaaaggccaaggaaggatgatgtgagttctagagatgaaggcaaatagatggcactgaccacaccacccacggcatgcaaactccctgaatacgcagtgtgccctgccttggttctctctgcacacctctgcacagcttgatcctcattgccccgttagaggtgtttacagctctgtctctccctagaccatgagctccttgagaatagggatcacaggggttcgaattatttttgtagcacaagcacttgatggttgaagagagatttttaaaaatcctggatctccctacttcacagggctgttgacacaattatagaggttaaaatcattcattgaacataggtctagtgctggaagaacagagtgttattaattctgtctggtggcatcccgaaaggtgtcctagaggaggtcacatttgtgtcaggccttgaaggatgaataggatcttcgcagttgggaaagggggcaggttctaaaagttcatgcattaaatcaggaggagaggaaagaaaagattgggaatagactgcaaaagttcttgagtgccaggcatttggattttattgtcacaggtaaaggaatcattgaaaggacaggagtcaggcatggtggtgtgcgtctgtagtcctagctactggggaggctaagatggaatcacctgagcctaagaatttgagtctagccttggcaacatagtgaaaatgagaccccttctctaaaaaagaagaaagaaaagaagaggaagatgtccagaagctgtgttttgaaaagttcattctctggtggccggctgggatgggtggtgatctcaagacccttacaaaatagcacacttcaggttcataataaacaatacaacaggctgtgcgcagtggctcacacctatgatcccagcactttagaaggccaaggtgggcggatcacctgaggtcaggagttccagaccagcctggccaacatggagaaaccccgtctctactgaaaaaacaaacaaacaaaacagaaaaattagctgggtgtggtggtgcacacctgtaatcccagctacttgggaggcaaggcaggagaattgcttgagctctgcaaacgcggaggttgcaatgggccgagatggtgccactgcactccagcctgggccacagagtgaggctctgtctcaaagaaaaaaaaaatcaatacaacaaagtgtaaatgctggtaaataaggaaattcatcaatgttgcttctggttctatttctagtactgttaaatgtagatttgtaccttatgttaggctatgaatatgaagcaaacataccaaatttggctccctactattcaaacatcatcagagtcatcgcatttctaatgactaacatttgttgagtacttataccagacaccatgtcaaaagctctacatatagtatttcatttattcctcaacacagccctaaggatctaggtactattattagcacccttttacagaaacagagacttagagaggttaataatttggccaaagtcccacagctaatttgtgaaatactcctatggtactgtaagatcaagagctttgagtttaaaagggaaaaaagttatttaacaaacgggcagatttaagtgcagttgaagactttatcaaggattctctatggggctaggagagtttgactggaacaaacattctctatatgtaagctgccaagaaatagaaaaaaattacatgataaagttaactattacagctctccagtgtctgtaacaagggagatcggttttcatcctattctacaaatgcaatttgcatatatattcttagggttaaacatgggaacgttctctgttataagaaataaaaatgtcttttcattattcattccaaaatcttaaaaaaaaaatcaggcttttggatcatggtaagcaaaaaatatgccacattttaaatattatttctacaattcaatgtaaccaattaataaagtctatccaaatatctaaatcttaatactcatatttcttggattttcttttacaacattcatgtatcatttaaatacaattttatatatatagattttttgagatggagttttcactcttgttgcccaagctggagtgcaatggcgcgatctcagctcatcgcaacctccgcctcctgggttcaagcgattctcccaccccagcttcccaagtagctgggattacaggcaagcaccaccatgccgggctaattttttgtatttttaatagaaacagggtttcaccatgccagcctggctggtctcgaactcctgacttcaggtgatccacctgcctcagcctctcaaactgctgggattataggcatgagccaccatggccgactacaattttatatttttaaaaaattaaaagtgaaccaaactcttgttttattggcaaacaatattataatgagactgatggcaaatagagtataattccagacttcttctctaaatgcagccctactggataatggtttccatatcgctctggttccagcccatctctcatgtaaagctgggctgaattctgtattacgaactcacgttttaccctgtgtcccacttgactctttcagtgtctgtagcaggccagtatatcagagaataactccttcatggctctaaggagctcacctgtcatgaagcaggtaaaaccaaggctgtccagagcccctctgctcagccatttctatctgaagaagagctgtttttacaatactcatccacggaagggaaagtgccgatatggtgacaatgattccaacagccccattaatcataacgtagagtcacatcaccatggtctgttccatcatggttcctctggcagaaaacagatgtcctcagcaggtggacaacaccaggcctggttctcactgagccagggaccaggatgggctcctgctgctctgctgtccctgctgctgagaactctttcaacctccacagcctttgcaaggtgacctttagagagacctcacaatatcccacctctgtgccatttcttaactgctcgaagtgccaagaaacccttcaggctgccctgtggaaaagagggcaccagttctttttcctcacaatgaaaggcctgcttcacataaacaaactcatattgtcagtcacagtgtccattttccttccagagagaaagacctgcagaaataattcatgccaagcacctcccaaatatatttgattctttcacaaggtaaaaatgagctaaacactaaaaggcaactctgaaatatcatgaagggatgcctgaaaaccgctctttgcaaatgtgctgagaatctggcctgcagagacctcaatcacacgttccagtggcttctctcttctccttcagcagccagcttgttttgctgcccaggacaaaggagtcaattgcccccagaacacttcactatcacagcaaagcttttgtgtgccttcagtgaccattaaaatctcattctcaaatcccacacagctgttttttctccttctttaaaaaagatacgagaaagcttttctgatgcaaaagggacagaccagcaggatgaggattaatggcgacaaagaagcttgaagcctccgcctcttttcagcactgtggcctttgagtatttcaggctatagacaaacactatggtctctctgtggctaagatgatgaacctaataaaaggggtcaccctctagtatttgactgctttcttaagaatcacgccttgacttctgaagaagagccataagcagcccacgtggattcccagggtgccccagggctgctgctttgtcccagtccagaggtgctgatgccccaggcagagttggcctcaggatcctggtttgagctctctttaaatgactgcccccatgataacaggggacagtccttcttgggctgagagattgatttttcattgtccaggtttttgacctgtgctcaggtttgctctttaaaaacattcctgtagttgaggcagagaaatgagcccagcttgatgccttcttccttattgggttcccaaatgcacactatgttcttttcatgcctagttaactggagctgaaatttcacttcctttagagtgccttttttgccctcaatttaaatatttctccaaagatttgccctttgccctcttttctcttaatgttatctactatccttgggatttcatctgttgtccctgtgaagattcatttactcattcattcaataagtacttattgagcactcattatgtgctgagtaccgttctaggagctggagacacagcagagaagagacatgaccctgttctaatggggttctcagggcagtaaataaatgagcaataaatctcaatgagcaagcaaataagtatgtaatagaatgcaagtagtagtatgatgaagaaaaggaaaacaggggaagattacaaagagggggtagggatggagtttgtatatatgctattttagaactgtggccaagaaaggcctttctgaacagagaccagaataaaatgtgggaaacaggctgggtgctgtggctcacacctgtaatcccagcacactgggaggctgaggcaggaggactgcttgagcccagagttcaagaccagcttgggaaatatagtgagacctcgtctttccaaaatcaccttaaaaagttagctgagcgtggtagtgcatgccagtgggagaatagcttgagcccaggaggcggaggttgcaatgagccaaaatcacaccactacactccagcctgggtgacagagcaagaccctgtctaaaaaacaaacaaacaaacaaacacaaaacaacaacaaaaaaaaacaggaaatagccttgcaatgagattgcctaatagcaagaaaggcagtgtagtaggaacacagcataagggggtagggcaataagagaggaactttaaaaagcaagcaagggccagatcacatgggtgcttgaaggccatggtaaggaaattagaccttacccaaagtatgttggaggtttgaaatggggcagtgacacaatctgatttatgtttttcttttcttttcttttcttttcttttcttttttcgtttaggagacagggttgcgctctgttacccaggctggagtgatcatggctcactgcagactcaacctcctgggctcaagtgatcctcccaccttagactcctgagtagctggaactacaggcttgcaccaccatgcccagctaatgttttaactttttgtagaaatagggtctcctgggctcaagtggtcctctgtctcggcatccgaaagtgagccactgtacccagcctgatttatgtttttaagagatgtcctggctgctgtgtggagaacagatggaggccaggcaaggctgaggagaacaattcagagcctggtacaacagactgagctagagatgacggtggcttgaaacagagcagtaataataacggaggaggagaaaactggtcagataaaggaaattacctgaaggcagagctgacaggatttgcacacggactggatgaggaacgcaacagaaagggagaggtcaagatgactcaggctttccacttgagcaactgggtgaggcgaggtgccccttactgagatgctggtttgatttgatttgaagcttgagaggataagaagctttgtttggaaacactgagtttgagatgccagttggccatccaagtgcggacactaggaaggcacgggttctactgttggtctctgaggcggaatactacacctcgggggttgacaagatgatccaccgggtgggagcacgtttctacacccatgcctacgaattttcacctaaaataagaaacaaacgaagctcctctggtttagaatatggtgtaagagcagcctcccagccagtctccatctctgtgaggcacaagacacatgtgaggagccagggtcgccaagaaaagagaagcactggcacccacaactcgggcgcagggcactgactgactctcgcctctcaatacatagagaatagttacagcttagctatgcctgggtaatgagatgtcctgacctatatgatcgtgtttttaactaaactaaccatcacaaaatagaaagcagctttgatggattcccggaaagaacacccgactgaagggcgtaaacgtgacgcgagcccatgcgcaccacaggagtgtccgtgggcgcatcttctgctcctagcacagcagccacgcgcgtccgcaccacaggagagggcccgtgggtgcatcttctgctcctagcacagcagccacccgtgtccacagtggagcggaggtttcccatccaagacccccagtgggtgcctggaacctcggagagtaccacaccctatatacactaggggttttcctatgcgtgcttattcatgataaagtttcatttataaattaggcacagcaagagattaacaataataataaaataaaacaattatcacaacatattataataaaaagttatgtgaatgtggtctctctctcaaagtatcttatagtaccgtactcacccttcttgtgatctgtcaatctgataactgagatgactactatgtgactaacatgggggagggtatacaccgtgggtacacaggagaaagggaggattcatatcccaggcaggatggggagggtacacagcgtgggtacgcaggagaaagggaggattcatatcccaggcaggatggggagggtacacagcatgggtacgtaggagaaagggaggattcatatcccaggcaggatggggagggtatacaccgtgggtacgcaggagaaagggaggattcatatcccaggcaggatggggagggtacacagtgtgggtacgcaggagaaagggaggattcatattccaggcaggatggggagggtatacaccgtgggtacgcagcataaagggaggattcatatcccaggcaggatggagcaggacaacacgagatttcatcacaccactctgaagagtgggcaatttaaaacttacaaattgtttatttctggaattttccatttgatattcttggaccatggttgacccaggtaactgaaaccacagaaagcaaaactgcctataaggaggcactagtgtattacctctttgtcaaactacatcatgagacagaaacagttacgatttaatctggtctgtcaagagttcacctaaagcactagcaatagtcaaaaagactataggacaaatggatttgcaaccaccactatcaataatgaacttcgcccaattgtaaagattctaccttaagatgctagccagttatttttaaatttgtttaatctttatcttgttctgtcttttgtgatgaacatagtgtactagccaatagtgtaagtatatagtttataaataagtaaacattcatatatattttacttagagggagagagaatgtgtgtgtgtgcattcttaaatgttcagcatctctgggacaaaggagctggagagggcagtttcagaatcgccagcatgtggtggtatttaaagctatggcactgggtaaggtcaccaaggagagtgtgaagacagaggaagggacgaaggattcaaccctaggataatcagaaagtaggggaggaaccggaaccagcattgaaaatgaaaagggagcagccagtgaggtatggagaagcagaagtgtgttgtgtctgaaacccacaggaagaaagtgtttccaggagagggagtgatcagcagagaggatgcctcatgaggagtgaggaaaggcaactggattcggcatcacagaggtggttaggaatcttggaaaatgtttctgtggagaggttaggcatgaaaatcagactgaagagaaatgggaggtaaggaggcaaagacagtatgactacggctccttcaaagagcttcgttctacacagaatgggggacacagaaatgaggcagtagctatagagatgcatgaagtcaatggagggtttgtttggtttttaagacaggagatgggtttgtgtgatgttggaaatgatctagcagaggagaagaattctgagatgggaggggttgatggggacagcatgggcaacattcttaagaagctgagagagaacaggctccagcttgagtgcaagatagaggggggccttagaggcatgggctgcccatccattttaacaggaggcaggtctgagcctgtgtggacagactcgggattaggcaagttaggctggacatgaagagaagaagttgtttcgctagactcccagacacccatggacacctctgcctagaaatcttgttgcccaaggagcacttctctccctggcctctggctttactcctcttacagaagcatctctattttcccaggcaccaaggctccaaatcacagctctccctggcttctctcctcactgccctgtcactcagcggcagcatcctacagctgtgtcccttctctctatcccctattcttcgtccccatggcatgaatgtcccttagatcctcaccgtctcttatttggattgccgcagtaaccttccaagattcccctggctttctgtccctccctgcctccactctttccattctaccatcagatgcacctttctaaactctttttctgattgcttcactccctggctcaaaaacctccttgccttgccttcctgcactcctctcagtttctctgactcaatattcaggctttagcctccttttatgtatctttttcatcctttctcatgctctctcaagagcctatttttttcctgcttctcctataaatctcttctgattatttcttccccagtgatcacattcatttcatcattcaaccaaccccctggcgttttctcagtgcctcctgcatatgaaacagggcatggtgagatgagggatgtatgggaagcaagtgccaggatcacaggccacatcagaatcctctgagctcagcccacctctttccccttctcagtccccaatccatgtcatccccaaatgctgctcattttccctcttaaatatttctctaacccattgctgtttctctatctaggacctgcatgttctcagtatctcataggcaacacattcaaaagcccccagattggtctttctgcctctaattctgctccctccagtaaagtcagagagatctttctagaatacacatatgacctggacacttcccgagtaaatcctccaatggcagcatgtcacctagagataaagttgaggctccttagcaacatatccaaggttgctgcagaggaacagcagtaagctgttacaaaaggaattaaatgttcctagtctctcaagaacccaggcactaaaatacttcccagtttgccagttgtctggattgtttcttctaaaaatctcagcaagttttcaaaacaaccaaatacagtatatataatacatacatacatacatacatatatacacacacatgcatacacacacatatatattatccagtgtatttcttaaataatttatcttttagctggtattatgaaagtacaatagctagacatccatgtcatatagttaattttctttagacatgaagaactttatgaagtactacagagcttaagaaatttgttccttggaccctataatcattttttttttttgccatcttgttaaaattgatcacagatggtacaaaggtcacttggagagcaggctgtccccaaagtccccaaatgccaaattaatgaaactttactatataaaataatgataagaaagaaaatatacaattggtcagaagtgattattttctctggtgtaaattgggactttaaaatttattttttaatgctatacaaaggacaaacagttcaatgcaaaaataggcaaagaatatagatgttttcagaagaaggaatccaaatgaccacaggcataagacagcatgcttagtcttactaataaagaaaaccaagttaaaatgactatttttttttttttttgcttaccagatttgcaaaaatgaaaaggatcaatgataaataatccatgttagcaaagatgtaggatgcttccaacgttggaagcgacatgcataggcatgatcttttgggaaagtaatttggcagtatctattaaagttttaaatatgcaagttctttgagtcggccattgtacttttgcaagtctatccttcagaaatattggccatgtgtacaaagaatgatattcattgagcactatttgccatataaaaattagcaataacttctatgttcaccagtaggggtagggctaatcaatactggtgtcttcaaacaaatacagcctgggaagctgtaaaagaaatgaggttgctccgctatcatgttagagagatgttcttgatctaactacagttaaaaacaacacatagcactattcaaattgtattgatatttgttttttattttgttaagataggctcttggtctgccacccaggctgcagtgcagtgacacaatcatagctcactgcagcctcgaactcctggactcagatgatcctcccgccttagactcccgagtagctgggactacaggtgctaccaaccaacatagtgagacagagtgtcactatgttgcccaaactagtattgaactcctggcctgaagtgatcctcccacctcggcctcccaaagtgctgggattacagatgtgagccactgcacccagcctatttttttaaaaagatatatctattcatacgtaaacctacagtctactttcaacacagtagccaaagttatcttttgaaaacatgtcagttactcctatgctcaaagccctccactggcttcctttctcatcagattcgggatcagggtcctccctggtttcgagttccctctgctactgctctgcccttgctctccctccctgcctctctcagctctcatccttctggccttccttccagtaccttggggttttcctatttgttgttctctttgcctgaaactctcttcccccagatatctccatagcttgcttcttgctgtcctttgcgtctctgcccaaatgacactttgtaatgaggccttccctgaccacagtctgcactttgggggagtacgctcctcatccctcacccctcaccttggcctggcactttccattccacttccctgcagccctgctctccatatccctgtcgccctctgctacatgatagtagtatctttcctcgtttattggttggttgtctaccttcttcctctaaaattgtaaactctgtgagggctgagatgtttgcgtgtttctttattgctggattcctgatatctagaatggtacctggcacacaattggtgctcaataaatatttattgaatgactatataaaatttcctttttatatgtgcataaaaacagttgtggaaaaatcacacagcaaactataacagtgattactgctggggagttggattagggagctgtggagagaactttcatctttactgtatacatttctgtgccatttgaaacaggcactactttcataattgaaaactaaatttaaaatatttaaaaagataaacataatggttccatctctccccccaggagagatggaagtgactccatttttctttttttgagctcttttctgcaaataccgaaaatcatttctaaaaggaactatcctaagcttgtctccactgtaccatccagagctcagaaaacatcagcaagcctggtctttatgaagtcctaacaccatcaaatagaccaggactagaagacagacagacagacacacacacacacacacacacacacacacacacacacacacacagccttgtctatgccacatgctgccttctggataaaaagcctttctaattaacacacctgacacttctttacacccacttcctccctcagcagcaagagggaatgtcactggtaactgcttgagccgttttctctgcatggtaaaatcttcaacattgctgtcagacctggacctgatttgatgctgtgagggctacagaattcatccagtgtttgggagctcctgagacaagacacattggctcccctagaaacaaatcaaacctaatttagcatgacaagcatctcagggacacattcacacaccaccacagctacacaaaccctctactgagtgtctttctttctttttttttttttttttttttttgagacggagtcttgctctgtcgcccaggctggagtgcagtggcacgatctcggctcactgcagcctccaactccctggttcaagggattctcctgcctcagcctcccgaatagctgggagtataggcacgcgccaccacgcccagctaattttttgtatttttttagtagaggcggggtttcaccatgctggccaggatggtctcgatctcctgacctcgtgatctgcccgccttggcctcccaaagtgctgggattataggtgtgagccatcatgcctggccccgagtgtctttcgtaggctgttgtggtcatgaagcccctgttaagtaactcctgctccttatccttgggcctttactccccaggaacatacccatggtagtattagtgataccctcactgggagccagtccatggggcccttgacattaggttttcttgactttttaactggccacaaagactccctggcccgtccgtgaggcctaaccccaacaggatagcagacgggggaggggtgcagtgtaaccctgagaggccaggagggccctgacagtttctgcaactcatcctggaaagtagggcagccacagccaactctccccactattttagtacggaaactggaactcttagaattttaaatgagaacagatcaaccagctgggctgtttttacttttttccactttgtttctttttaagagaatcagctggaatgaaaatcaagactatctggaaaccagcctcttgtagacagttacacttgattttgcacttgattttcactaagttttggcaaagcaacaaatttgagctgtgggcctaaggctgacaattctctggaacaagtgcccctggattcagctttgcttacttagaaatacaaatgggattcttactccttagctaagcttgggcctcatgattctactgatacttaggaaaaggacatcagtttatcctggagaaatctaattactgaaattcaccctgcttgggaccagagcacaggctttggaatcagaacatcagccacttctttcctgttcctcaagtcaaccaacattttagtgcccaccacaagccagatactatgccaggtgctgaggacagggagatgaatgaggtcagtctcactccggggagctctgggcctagcagggacgacagacacaaacgcaacagttactgaaacagaagcactgcccggagtgttctctaaagtgagccctgagaagggaggatgggccagacttgccttcggttaccctgagtgtttatggagcccaaggctgttctgttagcaagaatgtcccaggccactcaccacattggttttctgcatgaccctggcccactccacaggactctgcctggcgttcagatgttctgggaggctttttagccacgtcgaggttcatgcctgagagctggaggtgaaactgctccctgtggacggcctttctgagcgtgcggatggctttacggagccgcttctcggttcgctttacgatgcagctcaggtcacaagaagctacagaaacaagagggacagcagtgcgggaggagatcaggctgcagcgtgtgacaatggccagatcaactgcaggccctaccaacaccccgagctccctgtggaccgaatggggagaaacctggagggggcacctagcaggctgggcagcatttgattcaaacagaaatttgtggatcagaatggtagctttgggtttttatgaagcagagaaaaccatcaggttccaaaccaattcagtttagtttcggggtgaaaaaaaacaggagatacttcagtgtttgcattacttttcccccaagaataataaaaagtgaaaggcaaagaaataaggagcaagccgtgagaagcctggcaatgcagactgttttcaaaccaacctgtcacctccttttggttagtttcaagctcaaactcaacagtgataaacatttccttaggggtgcttggtcggccaggggctcctgggacttgcttgccagagctgcatgtaaggtttacgtagcggaagctctcttttactgagctgtgcttctctgtatgaagaaacaaaattatcggaagccaaatcctggcaaagcactcagctgaacatttgctagagctcagtaaacatttcattaaaacaactctcaagggactaagtgattatctccagatgccaagacactgcaagcccttaacttggagcacaacgacattttaatgttgaagagctagcattgcctcctatataactttacaatttagctcttgaaaattcttttcatgaataaatgggagatgtttccgactgactagccacatatgtggaagacaagaaccagggattgtcttgcattccttactgacggtttgctaacgtgtgcttacactctcacagttggtttgcataaagctggatgtgccgagcaggggctgaggcttcaaataaggaatgagcacaagagtggaaaggaaaccaactactgctttcaggcaaactgaccttggagtcattctaacctgaaaggaaagctggaacacccgtcagcagtgatgtctcatttttaaataaccaggagcaataaatggtacaaagcatcaacagaacctaacaatatcatgaaggcatctaggatgagagtggaagtgttgcatgacagggctttgcacatccttcttcctgacttggctgtctcccctctcaccatggtttccagtgaatctgttaaccctcaccaaagagcaggtccacatatcatccactccatgaatttgtctctatttcaaaatctttattgaaatgaagtattgcctgtatcagattcttctttaacattacaaggacattcaagccataggtcaacaggggccacaggaaggaggcagatttatttcttctctacatttttcccctaaagatttatcttactttttcaaaagggtaacttcagatcttaaactgaacagattctcattttaaatctttttccctttcgatgtttccatatatatttttttaacttttcattttgaaataagtagatttatagaaaagttgctaagatagtatagagttcccacataaccttcactcagtctcccctaacgttaacatcatacatttatcaaaactaagacattaacactagtacaatcccattaagtaaactataggccaagtctatttttatcattgtatttatttcatttttttgagacagggtctcgctctgtcgcccaggctggagtgcagtggtgtcaacacagctcactgcagcctcaacctcctgggctcaagtgatccgcccgccttggcctcctgagtagctgggactacaggcacaaaccactaggcccggctaatttttttatagtttttgtagagatggggttttgtcatgttacccaggccgctcctgaactcctgaactcaagcaatctgcctgccttggcctcccaaagtgctgagattacaggtatgaggcaccacaactggttcaaatctatttttaagcaatggcccctcccttcacccctgaggtttaaaagtataaatgctcactatggttaatttggcaaatgcagaaaaaaaattaaaattacccatgcctcccacccagatgtaaccactactaatgatagggtgagttttctttttgtttcttctaccacagtttttcttacacaatttggattgtattagatatacaaaatgtttctctcctgctttacatctcagcattataacaagaccattttcctgtgtcattaaacattctttgaaaacatagaattaatagctgcataatattccatcaaatggaggtaccaagtttcttaaaaatacttacctaaaataggcagtcaaaagtgactagagtgagctttaggtttatttgtctgtgtgatttgagagtagattgggaaaagaagcctccctaatacatgaatcctgatcctttttatttttaatttccaaaagaattctataaaataatactggaaatgtgtgctgggaaagaaaaaggaatgttagattctgctcttctcaataaggccagttctacttggatggtatttgctttgctgaagccaatggggtcaccgcttccaaaaactagacccagcaggaaggctggatattagatctttgttcatcaaagttatcctttctgagccaaaccttttttcatttctttggcttatatttcaagcaaaatctgagatctagaaaatttaacccaatatgatcacaaattgctaattcatctgaagcccttattgacttctgtgaactcgtgggtttccccagagcctcaccaactataccatgcaaaggaagccccgaagtgtgaccccagaactatacaagcatgctaggttatgctcttcttcctcttgggatgagtccctggaagttggggatggttcagttccatctgcagtgtgcttggatcggctggacagcccctggcccccatggacctccagctcggctggctgcaggccccttcccacatgcaggcaagctccctacaccaaccacctgattccatacctggtagtgctggtcgcagaccctcgggaaacagctcagcatttttcaaactacacttgccttcatttagcttaaaggttacacttgtcctgatggtggtgacatcttcagaaagaaacaagtgagagatgttaccttcagaggcaaaggaatggagacaccagatgggaagcagcaagctgtccattggtggcttccaccacacacagcacaccctgagaccctctcctaccctgaggctaagagtggcttggatcatggagtgcccattgccctggactggggccaccaggagcctcctaaaattgcagttaccccctcatgtgagaggcaaatccagtgttcaaataaaacagaggccagcctggcgaacatggtgaaaccccatctctactaaaaatacaaaaattagccgggcatggtggcacatgcctgtaatcccagctactcgggaggctgaggcaggagaattgcttgaacccaggaggcagaggttgcagtgagctgagattgcaccactgcactctagcctaggcaacagagtgaatgagactccatttcaaaaaaaacaaaaaattatctatctatctatctatctatctatctatctatctatctatctacctacctacctatctatctatctatctatctacctatctatctatctaaaactgagggtcaaaaatagcctccacggtgaaatagaacatgaagtcatttttgtgccttcctgagaaaaaaaggccagaatcccccagttcaaatctggataagcccgtttggcgaaacggtgaagggcagattctcctaaacaagcccgtcgtgggaggacagggctgagggagctgttgttccagacacagatggcactcactaaacatggctaggctctgaggtctgagagggagtgagggtcccactgtgagagcctgatgtgcaaaattctgttctcctcccagggtcagtcagtcttaaccatccggtaggatctggagtcaatgccctacagctcttttaagttgtggtgagaacttgagcaagttacttaatctccctaagcttcagtgtcctcatctgtaaaacaggcataattatagtacctatattaccaggctgttgtaaggataaaatgagataatgcatttaaaaaaaggaaaatgtttagctccttgcctggtacgtagtaataactgcatagccattagctatttgcttgccccaccttggggtggcccaaatcaccaaggaactgtcactgagggatttggcgaaacagaccatgatgtatgccctggctgagtccaaacgtgcattgaaaggggcagtgaaggatagtgcttgagactctggacccagactgcctgggttcaaatcccagctcccctatttcttatctaaaccactttgagtaagttatttcacctctctgagcctcagtttcttcatctggttaatgagaataatagtaaaatttcctcagagggttgtagtatggcttaagtcagttaattcgtgtactatggtagctggcatatttgaattgctcagtcaacacatacaagctgtactgtcttgctttgagtctctagctttgctcatatatgtaatatgaacatcaggatgtaatatgaacctcattcaggtgttccaatgacataatgacaaaggcgtctatatccgggaggacacagcctcctaaaaaccttggatttcattcttcatcttttgacaaacaggaaagggtttgggcccctttctcggcacagaatccctgctgcccctgctttgcctatttctatccacaccatgtgctccaggcacattccctgggcctttgaggtgctctggagtacagcctgctggtcctggggttctgtgggcctctgcccagggtgatgacccaccagggctgaccacagcctcctgacacacagtggccacacagtaagtatctgttacatgggagagtcacattccgggcaccaggactgcaggcaacaacaccctggaacatgctcacagcatcaaggaaattaacagaaaaaaaacaaagccaatgtccaagaacagcaccccgtgaatgaagccccttgaacacagtgagcccccagagagaacacgcagatttggtaattacccccaaaagcagagtcatttgatttttgttgtttgttcctgagaggagaggaagagccacaggtgacagagtaggccccttgcagtcctgacagacagaatgtcaattgtcaaatgcataagcaaggtcacaggctatcctggtagcagctaaactgtccccccaccccactccacatgggccactagaaaaatgcccagcatatggggtctcgaagcatggacctctcaaagcacggtggtcggggcatctggcggaggacctggaagccctttgagggaatctaacacctggaggccagagaggcctggccccagtgtgaggacctgccccgggaactgggccccactcacctgaagagaggtgaatgccagagtgacatctgaggaagcacccgtctcctccaccactcttaccgcagtgcagggacacacggggtgacacacttgtgggcaggagccccttcacttctagacaggacaaaacagacacttacagaaagagaaggacatttccaagtgtgacaaggatggttgagtcccatgcaccaaaggccccaagaaaagaaggtagagctcatgcccagcacagaacatagatgctaggccttattcccaccaagggaaaggagcccctgatatgccatttcttcatgcagaaaagcaaccaggaaaacagaagtgagttccaacctacacagaagcacagaaggaaacaccaaagatccggcaaagtatctcctgtttttgaactatttaaagaacagttgctgcagctggtggggaagtcagtggagggacggtcaggtgggatgtgggagcacgcagagctgcactgcctctgggccagtggccagcctgctgtctgagtctgtgcctcggttccccttacccacacagtcttttttattccagtggagcttgtacccagggtggcactggcattcatagctgcccactgtgttcacacagacctgctgacagcctccgttgttgatgctgcactcattggtgtctgtggaacaaaatactctcctgtcatagcagcctgtcactgaatgggctgacatggtccctcccttgaggaaggagcagcaggggagtcacaaggttgaaactcactaaccaaaggaagacactgaatgcctttagcatgagcgctcggcaccagctgactgcacaccccactccccacccagcaaatttcctggcaggaggctcaatagggccttctcaagctccactctttttttttttttttttttttttgagatggaattttgctcttgtcactcaggctggagtgcagtggcaccatctcagctcactgcaacctccgtctcccagcttcaagcaattctcctgcctcagcctcccaagtagctgggattacgggcatgtgccaacacgcctggctaatttttgcatttttagtagagatggggtttcaccatgttggccaggctggtctggaactcctggcctcaggtgatccacctgccttggcctcccaaagtgctgggattacaggtgtgagccaccacacccagactcaagctccattcttgaccaatccattcctccattagcaacactcagaaggatccgcactctactttcagatgtccaaactcagacactgcacagacttctattttaaaactctaccatccttctgagctgcctagcaagggaggcagacagaactgggactccctgcttaaccatttacacagttgaggcacagagaaagggaagtgactacactaattcccatcaacctgagactgagtccagatcaaaaggtagctccacctaaacccagacatacatccatactcagggtacatttcctcgaggtttcctgatggactgggaagagtagtatgtctttggccatgccaaggatgtgttgaaagggagaagggagataactgtcagtagcaaagcactagtgtatatatatatatatatatatatatttttttttttttttttttttttttttcaggtggagtttcgctcttattgcccaggctggagtgcaatggcacaacctcggctcactgcaacctccacctcccgggttcaagcaattttcctgcctcagctcccaagtagctgggattacaggcatgcgccaccacgcccggctaatcttgtatttttagtagagacagggtttctccatgttggttaggctggtctcgaactcccgacctcaggtgatccgcccgccttggcctcccaaagttctgggattagagccgtaagccaccacgcccagcatatccaatcttctaaagcacaagactcaggactggtcaggaagtatttaagccagtggttcccaaatcctatagatcctcaggaagatgaccttggaagtcctagacattctgaattggaatctgaacctgtattctcaaagattgctgggtgaatctgatggctgggggagtggagtgggagttagttggtaacaaatccagtttatggcatagcctgcttgaccatgaggttatgagacatgagaacattttgcaaaatgggcacagagtggagagagaaacttcatagttctgcttccagctcaaagacctagttgtgggactcaaaccaaggctttgcagccagttcctatgcatagcagggctgtggaattggtgggtgccccccaagcctctctgaggactgtgactttactatctgctgagatgttccaatagataggttatcagctcctgagatacccttccactctctgaatacagccgcaagtcaatcaagtcgatagagaattcacagctggaagagctcagttcttctctctgctccatttcacactcggtgtgttaaagggatacatgtggggagatttcctttagcagatcctgctctcaagttgatggactcaccgctattgctcagggactgcaatgtacctttcataccccaatgtaggaaagcaaacctcaggggtaggccctgctcccctccaggcccagcctcattcccctcccaacttgacaggggcagtctgctcacctccacagtgggtgaagccatacagggtgtaccctcggttgcaagcacaagcaaatgtgccagggtggttgatgcagctgtggtcacaggtcctatccaaagagcactcatccacatctgtaatggtcaaagggagaggggagctgaaacccactctgagggatgagtgaagaataggtttatgataaataccagttgctgaccaacaccaaaaacaatacacacagagtaaaaaacattatctatccattttcctcactcacttgtgttaaagaaagtgtggagcagcccacaagaagtatactgactgccacggccctcatttccacattctgttgcaaactgcacttccctcaaaactcagttggtctctttcacccatgcgtacttgcagggctaatttaaaatgtttaaatgaagccaaatgagataacatacctaaaaagggttttgtaagctacaggtgctagctatgcatttttattgtcatataactattagtaaaacagcaatattaatttattaactacggcaaattgaaaggagaaaacacttggtttggaggtaaatctagttcccatccctttcttattttctcagaattagtcttctggccccaagaggccagttaatcctaggttttaatgccctctgcactgaaagaatgcatcaatactaatatcctcactaattttctctttgcaggccctgaaatgtggtagttcagctccacattggatgcttttggccgatgccttggttttgctcctcccctatgtgccagtcctatgagtctgctagcctcctggttcagtgtggaagcctccttggctgcagcgggggtcatgcacagcagcctcaggaggctgcatttgtccatctcagcatctctttccctgggtctggccctcaacctctttcttgtaggctggaatttgagtgcttcactccctgaactctggaggattttaacatagttacgacttgtgtctccaaatggataaaccaggaccagtgccgcactcagtcgaagccaactagaccactgctagaccacttttttcaacaccgagtgtgccatgagaaactatgttaataaaaggcaaaaatgtggaaggaacaggaagaatgaaaaagcaaaataaaaaagggcaaattcttgcaaaacctcttcatccctagcttttcccagaaatcctggcatttcttcagtaaatttgttctgtgcaagtatttgttctaccaagaccgatcagtgaaaaatgagaaaaacctagtttcttccctaggaattgatgccattttatgaaatctgttattaatatcagccagttgtcgagaaagtgcacttgttcagtagctgactttggctgctcagtatgggcttttgctttgccaaaaataatgagatcacttttctaattcctttttaatgtgtttacacagcttcaacagtattgcctgctctatacactaggaaacattatgtggaacagcaaatttgctttccaagtcaaactgaagaaaaccacacaataattatctagaattaacttactgaatttaaagaggaatatacttgaactgcctgacaaattatgcattaagaacaaaccaagagaaaaacaaaacaaacatcacaccataatatttttgtaaaaaggtaatgctacatctttgttatctaagatgaaatctgatactctgatttttatttaattctgatttttttttttttttttttgagatggagtctcgctctatcccccaggctggagtgcgtgggcatgatctcgacttactgcaacctctgcttcctgggttcaagcgattctggtgtctcagcctcctgagtagctgggattacaggtgcccgccaccgcgccctccaccatgcccccacctaatttttgtatttttagtagagacggggttttgccgtgttggccagactagtctcaaactcctggccacaagtgatcgacctgcctcagcctcccaaagtgctgagattacagtgtgagccaccacacccagcctaattctgagatttctaacaaaataaattagtccttattcccaaaaatggagcaagaatacattacagcacatctttcctgagaacttcttctgcatatcaaagggaaggtgctcatctaaaaatagaaaacagctttcccccacccaaaacagctgctaatactaacaacaactgctacctagagaagtctccttgctgcagcccttatatgggaaggatgtgtttgagaaggggtctgaaatcctctctaaggatcaacaagcatctcctccccacaagccctccccctccctctctgccttccctctcttcaaagatcaaaggctgatggtttaaagcaagtgctgggccaggtgcggtggcccacgcctgtaatcccagcactttgggaggcctaggagggcggatcacctgaggttaggaattcgagaccagcctggccaacacagtgaaaccctgactctactaaaaattcagaaattggccaggcgcagtggctcacacctgtaatctcagcactttgggaggccgaggcaggcagatcatgaggtcaggagttcaagaccagcctgaccaacatagggaaaccccgtctctactaaaaatgcaaaaattagccgggtgtgatggtgcgcacctgtagtcccagatactcaggaggttgaggcaggagaatcgcttgaacctgggaggcggaggttgcagtgagccaagatagctccactgcactccagcctgggtgacagagcgagactctgtctcaaaaaaaaaaaaaaaaaaaaaaaaaaaaaaaaaaattcagaaattagctgagcatggtggcagatgcctgtaatcccagctactcgggaggctgaggcaggagaattgctagaacccaggaaggcggaggttgcagtgaaccaagatgatgccactgcactccagcctgggcaacagagtgagactctgtctgtaaataaataaataattaaaaaattaaaaaaacaagtgctataagaaagagaccaattggtacataatcttgatcatgggttaactccaagtttttgctagggaggtatgttaactaaatctacagactttgccaccaacttttgtgataaattcaataacattaaaggaaattttagaaaaggaaaattattcataatctcaacaccccactggaaccccatttgcattctgttttccattccatttctagcagtgagctctgctgtcatcacatcgatgggttctttaaggtgttctctaaccattaacagcttaatttccaaatacacctgtgagctacatcagtgtttttattttacctaatagatgaaatgagtgaagcctaggaaggagattggattagtggccctgtcaagaagcctgataagccagtctctgccaggagggtgctacgttctctctgctccaacctgtgggccattgcgcagcacagctatgttttcagcacataccttggcaagacttctcatctgttaataatttaaatcctttcttgcagccgcagtcaaaactgcccacgatgtttttgcagaaatgatcacaacctccattgcgggtctggcactcatcaatatctgcaacaggaaagcattgggcatatcagagagcaatacttgcctcatttcccacaactccctgaagggccattgtgtgtgttcattagtctctgaaattaagaaaaagactcacaaaagcatttaagaatgtttgctgatgtttttaaccttatacatgttttcttatctggcttaaccagttttgaaagacaagtgtttcatcgtcttgagaacgctgacttatgatgcccttgattggcattaaggaaacaaactctgggaaagaatgatgacgtcctgttatattctcatctttgtattgctctctcaaggtaagatgggtctctttagtacactatgtattcaagtttaatgattaaagctataaaggactagagcatttgttttggcaaattacacaatgatcaaatagcctcaatgttttaaaatgattcctgatactcaatcttatcttttcccagtttcgtctggcaattggttatctactttttatcatgctaaagggctaatcctttgtactcttgcccatgaaatatgagcaagtcattggggtcgctcttcatcagtaaaagttaatggtacagttattcattaagtcctctggataatcatcttgactgttatttatataataatctctaggctattatgtatgatatgttgatattatctcctgcaaatgaatgcttcctttaactgcctttttctaataaggccactgtctgaaatgaattatttgatgcttgtagaggctgacctcctcaacaattagtgtaattaagtgttggttctaattaagcttactcagttataaccttccactagcccagggggaaaaagctcccattgatatgaatcataagcaaatctcgagtcacgtggggtatggagggtatgttgcctttatccccatatgttagcggcatgggccctccctccataacagggcacccagtctccctggggaggtgaaggctacctttacatgtcttcccatccaactggagagtgaatccaacaggacaactgcagtggacacctgtcgaagtatccttacaggtgcggtcacagcctccattgttgacagcacacgtttctggcaaggaggtaagaaaagacaattagcttcccaaagaagtgctgatacagctgacgaaggtcacagaagccaagaagcatggtggggtactcatggtcataccccaagtctctgctacctgcagatgggctagagggagagcaggtgcagctcctcccacccccctaaatgagttctagtttctgaggaagactgtcagggtgaccagagggataaagatgtctcccaatctgcagagccactccccctactggcaaatttaaagccactgaaagttcctgctgatctgcagccagcaacctaagtaggaccacatctggcaggctagaggtgagtgcagaacagggcaaaggggatggtcctttcttaatcttgaaccttctcctttcgatatgagtaatgggcaaagcaagagtgggtaagcatcgccgccccaaccactgccttgttgtagactactgacttcatccttgcaactgccaatttactcaaatttgaagtttcactttccctgaaaggagaaagccctgtcataaccacgtgaaaaataagccacaattgttaaattgcaacaatggagatgaggaacaataagcaaacagccttctagttctgtatctcatacagttagtccaagtaatagacaagtgctattcaacattcattgaattgttagcatctaggcacccagaaacatgatttttctaccatagctacctcactttaaaggctgggggtggggggtggtggcgagggtggtggcttacccctgtaatcccaacactttgggaggctgaggcaggaggatcacctgagcccaggggttcaagaccagcctgggccacgtggtgagacccccatctctacacaaattttaaaaaattagcgaggcctggtgacgcacacctgtggtcccagctactcgggaggctgaagcaggaagatcacttgagcccaggaggtcaagggtgcagtgagccatgtttgtgccactgcactccagcctgagcaatacagcgagaccctgtctcaagaaaagaaaagaaaaaaaaaaaaaaagaaggaaccctaaagggaacaagcttaatcctaattaaatatgcagatagtacatgtatgtttatctctgttcctttcaaaacctcacgaatatgagaatcaattgattttttaaagtataaatccttaaggacaaagaaaataggagaaaagacaatagataaaagatgtcaaacattctggaagtgacatgttagcaggagagcagtatctggcgtagaagaaagctagatcctagcagtctgcagagggggtgccaacagctggtaaactcctgtgagccccagagtcccagaaagactcaggaattggaggtatcaagttattctagaggcagaaatgaggacggagttaagaacaggaagattatggagagtctacatatgaaagagataaaccccagagctcctccttaactccacatagtcatgtgactacccttctcctattctggctatagcagagaagtctggaccagagaggtaccaggctcaagggcaccaggaatagcagaggaggagagggtgtcaccatcaggtgaaagtctataccctgaaaaagagatctctaaccctcatccctcttcccccaactccttcagctccctactggcagatttaaagccattgaaaattccaaaagctatgttaaaataacagccattgaaagttccaaaaagctatgttgaaacaacactgcaacccaggatgctagcagccaagcctacaggcaggtggttgaaggactcctctccggctaaattgacctgcccaagcaaaaagacctaacgatattagcattcgaggatctccagatgaaatggctatgtcactgcctcgtcacccaaacatgaagcccacaaatcaatagaatatccaattggctttttagtattttactgttaaatatgaaaagtcggtcaagaatcactagacatttctggaaagcctctaatacggaatgaatataccagatcaaaccaacggggaaaaagaaacctggaggaaacaaagataatctagagaacagaagaggagttaaaatctcgtaattaatttcctcagggggacaagaaaagcatccatgaaataagagcaggttcctaaaaccaaaggccaaagtaaaatgcctgaaaaattaaaacatgaaaacgaaaactttatcctgtgcaaagattagaagaaaaaaatgaaaactctcctagaaagtagaacaaaaatacaaaggagagaaaagaaaaagaataaaaatacaagggagagaaaagaaaaaaaaaaaaattagggggtcaatccaggagttaccacagccagctaacaggagttccggagggaaagaacagagaaaatggagtgaagaaatttatcaaagaagacgggtgcggtggctcatgcctgtaatcccagcactttgagaggacgagacaggtgggtcacataggccaggaggttgagaccagcctggccaacatagcaaaatcccttttctactaaaaatacaaaaaaaaaaattagccaggcatggtggcatgtgcctgtagtctcagctactggggaggctgaggcaggaaagtcacttgaacctgggaggtggaggttgtagtgaaccaagattgcaccactggactccagcctgggcgacagaacaagactctgtctcaaaaaaaagaaagaaaaagaaatttatcaaagaaaagaatgtaagaaaatttctcagaacaaagggacttgaatgttcatattgaaaagtactaaaaataggtgggcaaaatcccacaataaggaacattattgtaaaacttcagatcactgggaaggaggagaagatcctggaagctttcagagagaagctttcacaggtttcacacaaaggatcaagaataaaaatgattttagacttctcaaaacaactctgcattcttgaaaacaatggagcactaacttcaaaacagtgatggaaaattctttccaactctgaattctacactgagccaaattctcaataaagggtgcaggtagaatataaaggcattttcaggcatgcaaatttttaaatacctctatctcattcgccggataaactaatgagagacaagacataggatccacccaacaggagagcggcaaagggaattgtaggctgatggtgaatgcccagatgagagacatgcactcagccaagacagccaggccctgctagggcaggctggaagcctccgaggaaactttttcaccaagaaaattgatttgattagttacctacactatatttgaacacattgaaaagtattttacagctttgtctgaaatttgcaaaagaattggtaagaggtacttagaaaactaagcaaacaaagaaaatataatcatagcacgttacatgactcaggtgaatcgtatttagatattcaaagtcagaataatgtaagcacataatattgatttaaattgtgagacaacaatattaagggtatagggagaggtcaggtgtgtgtgtgtgtgtattgcggggggaagcagtgagagctaaatcctagtctttcataataggaagttaaaagctaccatctaaaacagacacatcaagaagtaactgtagggccaggcatgaaggctcacacgtgtaatccaaacactttgggaggccaaggtaggcagatcgctagagcccaggagttcgagaccagcctgggcaacagggcaaaaccctgtctctacaaaaaatacaaatattagccaggcgcagtggcacatgcctgtagtccagctactcaggaagctgaggtgagagaatcgcttgagcctgggaggcggaggttgcagtgagatatgatcacaccacagcaccccagcctgggggcaacagagtgagactctgtcttaaaaaaaaaaaaaaaagaaaagaaaagaagaaaaaaataactgtatacccttcatttttttcagaaatatgggggaggaggagccagaagaagaaacagctcgaagaattgactattgttgcctctggcaaatgggatgaggaaatgggaagttatgagacaaggaaatgatgagtttcattacaagcctagaagtaattaagcgtttatgttactcatttgtactattttcacttaagacaatgaaaatttataatttctaaagagcagaaaagagctcggaaaggttacctgcttggtaaccaatggctgtatgatatgttgcctgactgttaaatccagaaactgtcaaaagatgggttttgtttaggttgagccagactttctccagaaggagtaacgcaccaaaggatctgtctgactcccacccccatgaccacctctatttctgctcatctccagcttgaccgctggaccttcaggcaggtcttcccttgtcccacagccaagtgttgcccctctccattcatctcttctactattatcatcagctgagtcagaaatagaagactcagtggacacaaaaaaagactagctgccattctgagctagaggctgcttcagaggaagacagctgacttcactgaccacccactcagtcccaggcactggactctgggcacctttccatattattatcttaattgagcatcccaactgatatggccaggctttatgtccccactcaaatctcatcctgaattataatccccataatcccctcgtgtcaagggagagaccaggtggaggtgattggattatgggggcggttcccatgctgttctcatgatagagtgagatcatgagatctcatggttttacaagtgtttggtagttcctcctgcatttattctccttcctgccaccttgtgaagaaggtaccttgcttcccctttgccttccaccatgattataagtttcctgaggcctccccagccatgtggaactgtgagtcaattaagcctctttctttatcaattacccagtctcaggcagttctttacagcagtatgaaaatgggcgaataccctggccctaagaggtagactttattacatccatttcaaagaaagaccaagagacagagcctcagggcagtttgccaagtcttacagctaggtgggggctgcattgggacgttaacctgattattctgatggacacgagaccaagggtcttgcttggttggtgattaagcaacagcactggtgaagaacagacacacaccctggttcacaggagctgctcaccccagtccagctggtctgagggcatgtggctcccaagttcaggtctgatgcaataagttggggagggaaaaggacaattgcagtggccaaggaaagggagtgaaggtgcctacccatgagcagccgccgtttcacccgtttatccccatccaccactgatgtggtgttgctctctgtcacctccaggacagtgtcctctcgctctacaagagaagcaaaagagcacggttctcagactgaatgagttagattgctcatccccatacaactgtgtttgctgaaatcccagacataagaggaatgaaagatatgtgactctgttcacgcaataaaaatgtgttgtaatgaggctctgtgggagacacagcccgttaaagggccacagatccttagcaaacattaaacatggaaaagattttggaggtatattgcactgaccaaagagacactagggaatgcaagcttcagtcccctgagtcgaggagaaaaagagccttgggcctggaaacctctaaaatggagctagtgaaggacacaccgtgaagggcaaggcaggcatcccgccagaaatatacggccctggctcctgctggccagaagtgccgcatcattataaacagctctaacttcgtgctgccctggcctcctgggaggtgttgtgccagtctctggaataccagcgttaggagcagcctagtccaggagaggaggaagggcttcccaaggtcacacagggagagaggggccttccccacaggcctagaccactcccactgtagcatgcgaagcagcacagggcctgctgggggggcaaatgcacaggaaacagcctgcatctgtgctaaacaccattaaggggtaggggtagggacaggcaggctggtgcagaccctcactcagtgttggggttgccactcaccaaggcagctcctcccatctgtgtgcatcttgtactgtggatggcagctgcactctgggccatcggctgtatcgtcacaggagtgctggcacccaccgttcccatggttacaggtcactgacagcaaaatgaatcaatacataaagcactgagatttccacaaacacagggctgtgtttgctccagagaaattctgattttcattctgcaagtatttgagcacctagtgcatgccaggcatggtgcacgaaagacataactccaagtcagaccctgtggtgtctgtgtatgcagatagttacaatacaaattgtagaaatgctgaaacatgggtttaaacaaagtcatacaggaagagggagatgggagagttgggggagagacttttattatataagggagattataccaagagattctagactactgctttgttctatctagagaagtttacctattaatacagctgtactggggctttgggaaatgctatagcactttatgctggaataaaacagacaatatttaatttgtacatatatgtcagaatttctctcatcagattcaatctagattagttagaaggaaggataatcacaggatgattctgcacacaattaacgtgacagtaactggtaattatcaagactatatatgaatgtattgatgataggccaaaaagaaaaaaagccaactacaaaactatctattcatcaaactgctaaccgtggttacctctggcaagggaaacgggaggcgggaaactgcatgttttctttatatgctttggagtgtttgcattttacataggccctttgtaatttttctaattcaaaagaactaattacatatttgtgttgtcctgtgattatagctgtgtaaaaattgtgtatgcatatgaacaacaactaaataggaatatggaaaaattgaaacagctggttatgtggtgagattctaggtcttagtttttttctttgttaattcctcaaacgttaaatatgttaatgttaaaaatgttataatgttaaaaatgttaataatgttaatgttaaaatatgttaatgttaaaattaaaaaaagttaataacagaacaatattatttgagcagtgatatcttaaagacatttaaaatctttaaaaacaagcttacaggtgcccacccccccgcccccttcagcaactgttccctgaaagactatgaaatgttgagggtctcgccccgcaggtgagtcttggagggtctgggtcttccttccgaagatctggaggtgggaaaatggtctccactctgctagctcactggaagccctcagggacagcctgacttcgaggggccctaagagcatgtcagaacctgttgcttgagtgtgatggtggcaccagccttggcttggacagctttggggtggcagtctgctttgtgagggagacaatggagagaagtccctcaccagtgaaactgtcccctcatctcctactcaccataaaccaccatccccaccaaatggcaggggtcttctgtccatggctttgggaaggttcctaaagggaactcctcagtgcttcccctggcataaatcgtggtttaggaacaccatgaattgccagtggtttcctgttcccaggtggagttttgttactacaatcgtggtgcaggagctgcggcccgatggtgtaggccacccatttacccactcattaaacacaagtgtactgagcatatcccatagcaggtaccaggggaggactgagaggaaaaatgaggcaaggtccctgacttggagggggctcatacctggggagacagacacatcaacacacaagtcaacccagagctatacagctgaggaaagtgctgtgggagccaaagtacaagatggctgccctgtctgaagcacccaggaggcttctgatagcagaggatggtagcatgggattaagagcacagctttagagctcaacagaccagggtttgaacactcatttgccactcactccctgtgtgaccttgttgcttcaccttctgcacaacttcgacaactgaaaatgagtgtaataatactgagctcacagtgcagtgcttgtaagaattaaatgggatatggcacatcttgagacaagcctttgcacaaaataaattccccaccaaaaggtagctattatgcttatccttattagaagttaaacagaatattgaaggttgagtgagagtccaccacgccaggaaggcaggagggcttgggaaaggcctggaggcatcaaaggatttgggctgttctccaaaggcaaggggagtagtgtctgcggaaaggaggcagatgaggtttataggggaagcaggacctggtggcaaagagctgtgattgccagatgaggacatttggttttattctgtgggaacagggagaactgccccccaacattcacactccttactcctgaatttcatttcctcctgatgagttcctttttaaaatatcatttcccttccctaagggagaccacccttctgcagtgaacaagtacttggtagaggtcggtatcccgtgctaactgccttccctgctgctgcagccgtgccatgaggtggtgcttctgagctgggccacagaaggcagcctgtggaatacgacggttcccatggcaggtgtgcactggcccatacttacagatgcagtctctctggttcttggccagctcaaaaccaggcctgcactcacaggcgacgctgccccttggggcctccttgcagatgtgactacagccgtgatccttattcatgcagctcaggccctctgaaaaacagcagtgtgcgacaggtgactaggctgtggtcagaatcctgagccctgggagagcggcaaagggctaaggggtggcccacagatctgtctgcttaggtctccatcagccccacatttgaaaagtatatgtcattaaagtcaacctaggccaattaatagacatgaaaaatttattctgtcacccaagagatatgatgtctcaactctcctaacgagttgggagccttcccaatacactggagctctctattgcatgcaggatcagagcctgctgaccccaggaactggtactcacgctcttatctctgccatgtctttacccaagagctgatcaagaatgtaaagagaaaaggagaatcctcctaagaaaatgttcagatagaatgatcaagattctcaattttttcacatactcttgaagataattttcaaaacatttcaacgcccctctctgcccccaccaatcccacccttctgaggtgagtgtgactgtggcattttggcatcctcgtacgggccacatgccccgggatctgtcttctgtgaccaccctcagccactcccttgatccctccctcagggcataagcctctgacagcatcacacagcaacagcaacaagaacagagggagggagagaagagacagagagagagagaagagagagagagagaaggagggagtgtgctcgtgtgtggtagctgctgtacaattcttttgaggtatacagtaaattctgattaggcttaaccttgtagtatgatggtgggaaggggaacagctgcttctgttcttgcagggctcggcacacatctaaatgagggggcacagcaaggtaactgcccgtgtggtttaccagcattctgcctcatctcaaaactaattctttgagatcctgctgcctaccagcatcctgaaggaattcttttcataccctagaatactttcaagacatctgctcagtttatactttattattaattacctgttcctatgttgcttctttgcattcgtgcaatgtaactctaaaacatctctgagagtagggacttggttgtcattggctctctatcaatgagacactctaatactagtagggcactgttttcaacacgagtacaaaaaggttgctttcacttctctagaatccaacacccttctatattgtgcccctaaaaccttagccaacaggttctagtgaagtcaaagttctctctccagctcccactccagagctgtcaaactgtgcttaaacggaacaattgttttaatacaaacagatgtcattcctattccagaagacagtgcaagggttaatatatcccatactttctggagtctctcttaaaaccctcttgctcttttgcctgacagttatgagctgcctgcactccagcactcagtctgctggttgctgggattcattcatccatgccaagggtggctgtcaattaacacagaaagagacttgcactggattggtggaaagctttctcttgctctggctggtaattccgaagatgtgatttgcaccccagtactgagatggcgcgggaggtgacagctgcctctagaagcagtgtcctgtctgagaaggcccagaaagcgttgtgtttgtccttgggtcagccgagcatgggaagtaactagtgctcgggggtaaatataatactgcccaagaaatgggggcaggaacacctggaaagtacactcccaaacaggccagctgctgctgctttttcactctgtttacaagactgttaagacatttgcaaagtgacctttactgcctcagagtaattcacctacacaagaaatatttcgtaagaatgcctgtatgccagatgccattgtgatacacagagaacctaccacctaatgtcctaccacatcaagctacacctgaagttaccaagacataatagagacttaaatggctctggaaacgctgacagcttttcaagaagtgacctcaaagcctttgtagcactctgacttaatgcaagaccactgctggggtgagcagattaatctgttccaaactaggcagcccagcaaatggccctagctctttccaaaattggtctggttgtcacgtccaggatggttcgttcaccagaagggaaacagctcagaaacattggaaatcccccattctggtgcaccccaagatcagggctccactgaagattatttctggaaaccaaacaaaaatatgccttgtgaattgggaggaaaacatgacataaaacgggtaacaggtcctgctgaaagcacagcctccactttgccaccctgacaccttccctgttgccctgaaaaggcatcagtacaccatctaaatattctcagaacacacaaaacaaaagaggagtgctcattctgagagcctgagcacccatgaataggaacaaaggcgggccgggggtgatgtgcttctctccagcctaccctcattatatgggtgaaaacacacagtctctttatcacagctttggagtctctaaggataaaaaaaaataaaataaaaaatcagtatcttgagctttccctcagagtcaatgattatgatgccctatattaaagaacatttggtaaataattattaaaaacaacagcaatagaaaatactagcttcctgtgttaccttcttttaatcactttgaaggtatccactgtgggttttgttttgttttggtttgttttgtttgttttgttttattgaggtggagtctcactctgtcgcccaggctggagtgcagtggcacgatgtcagctcactgcaagctccacctcccaggttcacgccattctcctgcctcagcctcctgagtagctgggactagaggcgcccaccaccacgcccggctaattttttgtatttttagtagagatggggtttcaccgcgttagccaggatggtctcgatctcctgacctcgtgatctgcctgcctcggcctcccaaagtgctgggattacaggtgtgagccaccacgtctggcaccactgtgggtttttaagcctacagtttcatagagtttaatgtgcatatcagagaggaaatcctagaagaaaactttttacaggctgttctatttgaagaatcaaaaccctaggatgcaaaggttctccgttaccaattgctataatctgttggctgacactcccatgaatttgccaagcaatcaggttgaaacacaacagaaaatcacagagagcacttccagaccacaacgcaaattcttagattttggttttagttccagacaaaaatgttcacttcaaatactctttaggggatccaagaatgtctgaattgtagaaaatttagaaaacacagtttgcagaaaggaactgcatttgtatttgcttctggtatgaggagcctgtgtctctaatcagtccgggggcttgcaggaggggagagtggggctgagccagggctctggaagtacagggataagaggtgatcttaatcgctaccagctgctttgtaactgggtgggacccagaccgtgagggctcaagcgatggctttaacctgcagttcccacatccctccccagccacctgcagaggaagccaaagtgacttcccaggaagcagctttgagcaatcaaaaggagagatgccctgagattcggatcactctgtgccactggcctcctaattcattcccatctcgaatttggcctacattggacaagagtgcagggcacaccaatgaccccagagaacctggcaggaaaatgaaacccaactgctactttatcaagggccacacctggcacaagataggaaatctgcctgatcaaagccagtatgtgtgacttccccgccccaaacgctgagaatgagcaggctctgggtgatgatagccatcaaacccattggcccctgggggttcctctgacaatttttcttggtacccaaacaggtattctagttaagtataaggtgtgagctgccatccttggaaaatgagacaaaaatcatcttccatgaagaaacccttgaaaagttaccaagaccaggattaaaacaatctataaatttgtgattaaatagtagaagaaattaaaatgacctcattcttaagtaatgggaaagaataagcagcacatggccaaaggggttaataggctagtatttagggcacttcccctaaaaataggcagatgcaactccaagaggaacacagccaccaaaatgtgactctttagcttaagaaagagcagggaagagttaaaaggatgacattcagttaaaaataactgattggccacatgtacttaatgccccttcctctcaagaatctactaagtaacagaggaatgaaaaaaggtataaactcaaagcaaagagaatgaagagaaggacatcagaagagaagagtttccggcaaatttacagaggaatgataaatggtgacgtaggcgaaggaaaccacagcacggaaagtccagggagggagcccttctgcccctcggagctcaaaaatgcaaaacatggaagggccggatctagcttggggctgaaaacagggcacttcattgaaagtctgcatgggaaggatccagcctcctccctacccacccagagcagggagcaggctcatactggtgctgtggttttcagcacctttttgaaaaacttggcagatcatccactatattgctcctgagacatctagtcatgtttgaaatgtattctatgtaaagattagaatcagaaaatgtgagagtttgaaaggacctcagagctcacccagtccagtgcaactattttgccaggtgaggaagttgaagttcaaataacttgcccacggttacccggcagtggagtctggactcgtcctcaggcctccagactttctataccctgtgcttcccctctagagtcagtgtgtgtgtgcgcgtgcaagggagagggtctcagatgtggctctgcccccatccacagctgggcagaggtaccttccgagcggtgaatgcaggtgtgctgattgtcactcaggaaaaacccctccttgcagcagcactcatagctccccatgacgttgacacaggtatgctggcagccgccattgttctccaggcactcgtccacatctggaaggagagagggattagcctttgctttggtgactgtttcaatgccccacctcacccagcagctcaggggccctgctaagcaaagatgaggttcctcttcacgtccctgcaccacagaagctttcagaatcaaagccggtaaggtccacagacaactacccagtccttacgggtctggggctcacttggccaggaccgccacatggacacaaggtcatcagctcagtaaatatttgttgaacatcttctctttccacagcatggtgctagaggagacagcaaaatatagataaggaagataaaattccttcccttggccaggtgtggcggctcaagcctgtaatcccagcactttgggaggctgaggcaggcggatcacctgaggtcaggaattcaagaccagcctggccaacatggtgaaaccccgtctctattaaaaacacaaaaatcagctaggcatggtggcacatgcctgtaatcccagctactgaggcaggaaaatcacttggatttgggaggtggaggttgcagcgagccgagatcatgccactgcactccagcctgggcctcagagcgagacgccatctaaaaaaaaaaaaaaaaaaaaaatccttctctctaggagcatgcccttcagcaagagacaaatatacaaatgattctgatataaggtataaaaggtggtaccaaggaaagaaatcacatctggtcatggggtatcgggatgaattaaggataagctaataaaagatgggcccttaggattgtccaattataaatcaggaaagaagggattataggtggaagagagcgtaagcagtagcacaaaggctgggaggcatgaagaacattcagataccagtgggtcagcccatgtggttggagcatagggcacatgagggaggttacaggagatacagctgggaggacagactggggtcacactgtgggatcctgaataccaggcaatgaagtgcctacttaatttgggaagcagctgggaaccactagagtaggggagagagtctggcccttcactttgagaaatacaaggcagcagctgagggcaggacagagggaggggaagaatgggcagtctgggagtccagcttcacacatgcatctgcaacagccacagctagcgctagtggcgacagcactgcggctgccagggatgctgggaaccaagccagagaagaagactgggcggacaaggtgcctgcagggctgggagccttgtgggctatggggtgggcatcattagaggatggaaagttgacaccaaggccttctggaagggacacatggaaggccagtgctgggtacagaaatgggaatggagatatggttgcccctgacccccaaggcaggcaggtgatctgtctgaaatgctgaaatgtagggctaggtccagtaggcagtggcaaacctcagtggggagcttggaagagaatctggtggtgtaagcacagctttggaaatcatttatttgtagttgcctgataaagtggtggagcttgatgagagagccaaaggcgggagtgtgggaagggagcagaaaggagacagccagaggtagaatcccggaccctgccaggggcagggaggaggcagaggagatggcaggagtcccaagagcctccagggaaggagccagcagagaggtagggagggaggaagccttctgccacacactgtcagggcggccttaggggaccttcctcccactctgcctgtgataccctgtgcacagctgtattgctacacttactgacttgcagcctcaaaatcctttactcatctacctctactagattgcaaactccttgaggacagagatttttgttttaattagcacagccctggaatacagcaggcgctcattaactattcaatgcatgaacaaacaagcaggagaggatagcatcacccgagccagagaagagaaacttccagagaagtttcagacaacaaaggctcaaagagaaggctgatataaaaaatcaatttattttctccagtctaatttctcatgtgctaatcactagctcctgggcatatccataataatcataataataaaacctcacatttaaatatctgttatctggtttcaagcttcagatcttatagtcctctgtcctcccacactactgagcagatgtctgactaaactgatgggactcaagccatcccctgaagcctaacaaacttgcccttgtctatgccaaagggtgaaggaagcacattccagaggatgagccgtgctggaacacacctggcctaggtgttccacagcaagactcaaggtgagcaggagaggtctgtctccctgaacaccaactcctggattggctgcgagtaaagatgtgctcccctctgagctaccacacccccaccccacgtttaacccccaatttcttttccccaaggcaatcagaaatgtgtcattcagctagctgatgctctgtggttggataaatacaaaagtgtgtgtccacgtacgcaaatatctatcactaagctggtgagcttctccagaccataaaacagtggttctcaaccctggctatgtgtcagaaccctgaggcctggatgccacctccagagatactgacagagccagtcttggatgaagtctaggtgatggttttttttaagcttctcaggtgattccagtgtgcggccagagttaagaacaactgctacaaagccaaacagctatgatgagctcccagacactccaaaaatagaaactgaaggcagatggggtgagctgtatagaagagctgcctttcgtttttcagacttgcaggcattcaggatcttgaagtgctctgtgtttagtgccaaagcttagtggtgtttgtaccttgtgtcttctagctaatatatttgtggctaatgtgtggttaggaggctgaggagattgaaggggtcatcccagagaactcaggagaagttagggctctgagcttcttttttgccacaaactgggtcagccctttcaaatctgaatgttggggaagtgtctatgtgtgccggtcctactcttccaaatgtacttcattttcttgtgccttccttttaaagagtccttaccccattcagaaatactcagtagatgctcaaggtctctctgcaaggcagatccttgctactgagtccacaaagagatcccacagaggggaaatggagatactctgtgctgataatatctgtgttatcggcaaaggcaagaaaagactctgccttcagggtttccaagcaggccaatactcagagccgcccaccagccctggcccaggttcctagcccctggatggttcttgctcttaggaaccttatactaccccccgccaccccgggctgtggattacagcacaacagtaatgatgaagtctgccatcagatatgcatcctccaaatgccctcattggcaagtcaaagggaaatttccccctgaaaatggaaaaaaaaaagagcaacccatgtggtatgcctcccaacaaatcacacactgaaagtgattccatttgtctgagtttttaattaatactgattcctgctctcaggattgtctctcaaatatgcctttttgtggtactgactgcctagaagattactggttccctcacctgcaatcaagtcttactgacagctgcaggcttggaaagccacgtgatgtgtcacccaaagcctgatctctcacacagggcaccaacaggaaataacagagtccatcaggatggagctccaggagacactgaagtgggataaaggtcatatgagggttaagtcccaaatggaaataacctctcctccactccagagccccaacacacaacacacaagttctgtctggactttttctagttccttttatgcagatctcaaagcatttaatcaaagggccattcctaccacaccataagggggcgtctgaatggctgtccccacagagccagggcctggctccgctgctccttagttggccaagtagacctcagcaggttatccatatgaagggtcgtgagtgtcaaaggacgctgatgccatattttcccatgatgttctcctgtacaactaataccagccttaaaaagcaaaccacaaatacctatctgccaggagtgctgcatcctctaagactatccaacactcaaccccatgcagctgctagctgcttctaagttctgttttattcctggcataaggaatgaatgtaaacaacactctttgtagtctctaactcaggggctaaaactccaacagatgtttctgttttgtggaatactaggaagatgttcatggaagatttctgttttagtttctctctttttcaagaaaaaaaggggggtctagctggctgtaaccccagcacacatttggagtcttcaggacaaggagtttttccaaattctaaaacagaaacacttacagcattgaaaaaaaaaatggttataagtcaggactctcaacacaagaccaaagatcttaaaaggtgacaagccaatgctagaaagtcaataaatagtaatgacgatgtcacccatctccttggactaacagaagatttatgttatgaatgatcacataaaactgaaacattttacctcattttctatcacggagtctgacttccaagggagcagaaaacacaaggctctgagcccgtttttgtcttcatgaggaggtcttcaccaagggaaagaaaggggtgggagagtgaaggagaattgccatttccaaatgccttccttaccaagacaattatgaccgtcatgagccaacatgaagccatcaaaacaagtgcaacgataattgcctggaatattcaaacagtcatggacacagcctccattgagctcatttccacattcatcgatgtctgaggaataaaacagaagtaaaccagacaggtgctatttctttgatgtgaaaacatatgcacttacctccagccattccacttctaggaatctacctgaaaatacatccctaacaataggaaaacaaatacgcacaaggttattcactgcagtgttgtttctaatgacaaaatactgtaaacaacctaagtttccatagatagaaaaatagtttaataaattatggtacctctactccatggactactatgcagctattttaaaaaaaagagagaatgaggaagatctctgtgaactgatttggagtaatttctaggatatactattaaatgaaaaaatcaaaattaaaagagtatctgtaatacgttatcttcatgtaagaaataagaagatataaaaacacacacaaaatttcaggatacgtttttgtagaacttgacaagcttattgtaaaatttatatggaaatgcaaaagactcagaagagcaaaaacaattttgaaaaaggagaacaaatttgggggactttaactcactataaacctacagttatcaagacagcatggtacaggcataaagacagaggtatagatcaatggaacagaactgagagtccagaaataaatctttctacttagggccacttgattttaaacaaaagtgctaaggtaatccattgggagaaatgcttgtcttttcaacaaatggcactggtttaattggatatccatattcaaaaagatgactttagatccttatctcatcccatacacaaaaatcaactcaaaatggatcagggatccaaatgtaagcattaacaatataaagcttttcagaaaaaatatgtgataaacatctttaagatattgggatggctaggcatgatctttgggtgcactttgggagcctgagccaggaggatcaattgagcccaggagttgctgacctgggcaacatagtgagacccccatctctacaaaaaataaacaaaattagccagatgtggtggtgcacgcctatagtcccagctgcttgggaggctgaggcaggaggattgcctgagcccaacattgagaccgcagtgagccaagatgacaccactgcattccagcctgggtgacagagcaagaccctatctcaaaaaaaaaaaaaggagaaaaagagaaaaatctttaagacattggatgaggttaaaatttctttgatataataccaaatacacaatcacaatttttaaaattaataaactggagtttatcaaaattaagaacttttgctcttcaaacggtatcattaagaaaatgaagacaagccacagattggtagaaaatatttgcaaatcacacaccttataaagaactgaaaaaaaactcttacaactcaataagaagataaacagcctaattttaaaatgggcgaaatattcgaatagacatttcagctacaatgatatgcaaatgaccaacaagcacatgaaaaaatgctcaacgccattagttattagggatatgcaaattaaaaccacaatgagatgccatttcacattcactagaatggtaataattaaaaagatagacaataacaaatgttgacaaggatgtggataaatgggaacacatacattgttgacaggatgttgatgggtatgtaaaacggcatagccactttggacaagagtttggcagtatcttttcttttctttctgtaaatgtacagttggatataattaaaacaatcataatgttgtgaaaccatcaccactattcatctccctaactctttttatcttgtaaaactgaaactctgtgcccatttaacaataactcctcatttcctcttccctctcttccctcaggccctgttaaccaccattctactttctgactctatgattttgactactctaagtatctcatatatttagaatcaaacagtatttgtctttttgtgactggcttgtttcacttagcataatgttctcaagattccaccatgttgtagcatgtgacaggatttccttttttaaggctaatattctattatatcatgcctgtaatctcagccacttgggaggctgaggtgagaggatcgcttgagaccaggagtttgagactagcctgagcaagatagcaagatcccacctcaaaaaaacaaacaaacaaacaaaaaaaaaaaaccaaaaatattattttgtacataacacatgttgcttatccactcatctgtcgatggacacttgggttgcttccaccttttggctactgtgaataatgctacgagcatgggcatacgaatatctcctccagaccctgctttccactcttttgggtatacacccagaagtggaattgctgggtcctatggtaattttttttaaaattttttgaggaacttccacactgttttccatagtggctataccattttaaattcccaccaacaggtgcacaaagcttccaatttttccacatcctcacagacatttattattttctatttttttgatagtagccatcctaatggatatgaatagtagctcccatttgtagttttgatttgcgtttccctaatcatcagagatgtcgaacatcttttcatgggcttattgtccatttgcatatcatcttagctgaaatgtctattcagatattttgcccactttttaattgcgttatttgatttttaatgttgaacattaacagttctctacctattctggatattaatcccttataagatacatgatttgcaaacattttcatctattctgtgagtcgcctttatattctgttgatattgtcttttgatgttcaaaatttttaaattttcaggaagtccaatttgtctattttttcttttgttgtatgtggctttggtgtgatatccaagaaattatctcctcggcagtttcttaaaaatttaaacacaaatacaacatatgacccagcaatcccactcctaggtatatacccagaagaaatgaaaatttatgtctatacaaagactttcatgcaagtgttcacagcaatattatttataatagccccaaagtagaaacaatcaaaatgcctattaactgataaatgggcaaaaaaaatggtatattcatacaatggactactattaaacgataaaaatgaatgaaatgctgatataagctaccacatggacaaacctcaaaagcattttgctaagtgaaagaatccaacacaaaagaccgcatattgtatgattccacttacgtgaaatgtccagaaaaggcaaatatacagatacagaaagtagattactggttgcttgaggctgggactgggaatgaggattagctgtacaagaacacggggaatcttactgagatgaggaaaatgtttgtattgtgatggttgcacaattcagctgatttactaaaaatcactgacttgcacaattaaaattggtgaatattatagtatgttaattacacctcagtaaagttgttaaaaagttgcaacttttctgaaatctaaaattatacatttatctgcttattagtgcaaaataaatatagaaaggtaaaaccagaaactacagagattggtgacccacagggcacggggaaagggtggaaagaatgaatacaattaattgtatacatacaattaatacatgtttaaggaataagggaaatgcatggaaggaggggatggaagtgaataaaagtggaatacgaaaagaaacaaatgaacctaatgtattataaactaatagtataaccatactgaagaggatggggaaggaaaatattgacctaaataacactatgaaaaacaacaccttgcttggatgctttaaggctaaaaacaaaatagctgtatgctatactctagtaaatattgtactttagttagtaaatctgctttactcacagggttatggacttataattctgtaaatatctctcccgtgtattaggactgaacaaagaggtaaacacattacagataatgagcgccagatttctcactgttggagaaagttacgaataagcaaagagagaatagaatgaatttttttttttttttttgagatggagtctcactctgtcacccaggctggagtgcagtggcacgatcttggctcactgcaacctccgccccccaggttcaagcgattctcctgcctcagcctcccgagtagctgggattacaggcgtgctgtaatttttgtacttttagtagagacggggtttcactatcttggccaggctggtcttgaactcctgaccttgtgacccacccgcctcggcctcccaaagtgctgggattacagacgtgagccactgcatccggcctagaatgaatcttgtggtaatggtttggaatccaaagtatcagtgttaactaattgtttttaatatatatacagatgaataaataaaaggaataaatatagatacgtgtgcatgcgtggatgagtatgcgtacatgtatttcccaggtaggaatgatgacaccctagtagcaatgacaacaccaaacatccagatcttggtttctatagaccacttccattaaaaggaatcagagctccttggagaagcagttcattccaggcctagggaggagaagctataagatgattctagagcatgttgtggtaccagaaagttaggaagtcctcaaaaatgtgacgtcaaaatgacacaggagacaatgtgtggggagcttccaatggctaaagcaaacaatttgagccaaaaataaatatagatgtaataaagtaaatatgcatcagtacatagtggtataaattaataaataagtggggacgagggagagatcttccttacagaagaatttcaattaacacatgtttaaggaattaaagaaatgcaaaattaccaggagacacacatcacagtaataactattgcaggcaagatccacagttggatgctaacatcagtggatgaagatttgaggagaaacaggatattggcctcaaagtatctcccctaagaaatgtatctattgcaaaggggaaaaaaaaatatatagtaattttgtagcagagaaaacccagtaaaccccatcttgctcaggcaatcaaggttaacatcatcaagaatgggacatgttaacatcatgtgcccatgatgtgctacactgaaaaggatacaacagcacctctgtagcagcctggccaaaaactcataacctcaattttatcatgaaaaaaacaaagacattctcttatatcaattattgttttttgagacagcgtctcattttgtcacccaggctggagtgcagtggtgccatcatagctcactgcaaactcctgggctcaagtgatcctcctgcctcagcctcctgagtagcagggactacaggcacacatcaccacaccagcaattttttgttttgttttgttttgttttagagacaggcatctcactatgttgcccaggcttatctcacactcctggcctcatgtaagcctccctccttggcatctcaaagtgttaggattacaagcatgagccactgcacctggcctcatatcaattcttataatgacattaagacaaatgaagtgagcagtactcatcaaaagtgtcaatgtcaggaaagactgaggaactgtcacagactggaggagacaagagacacaactgctaaatctaatgtgggactttacttggattctggaacaaaaaaagaatggtagggaaaaatggtgaaatttgaataaagtttgtagtttacttaatagcattgtgccagtgttgatttcctggttttgataattgtactatagttatgtaagttgttaacattagggtaaaatgaatgaagggcatatatatacacagatgaactctgcactatttttgcaacttttctgaaatttaaaattatgtccaaataaaaagttttttaaaaagaaaaatataggctgggtgcggtggctcatgcatgtaatcccagcactttgggaggccaaggcaggcggatcatgaggtcaggagatagagaccatcctggctaacacggtgaaaccccgtctttgctaaaaatacaaaaaattagccaggcgtggtggtgggcgcctgtagtcccagctactggggaggctgaggaaggagaataacttgaacctgggaggcggaggttgcaataagccaacatcacgccactgcactccagcctgggtgacaaagcgagactgtgtctcaaaaataaaaaaattaaaaaagaaaagaaaagaaaaatatagcatcttgtacaaaggccaactttagattcatccctgttaaactttattcaatctctttagtttttttttttttttttttttaagacagagtgtcttgctctgttgcccaggctggagtgcagtggcgcaatcacagctcactgcaacctccacctcctgggctcaagtgatcctcccacctcagcctctggagtagctagtactataggcacgcaccactacacccagctaattattttgacctttagtagagagaaggtctcactatgttgcccaggctggtctcaaacccttgagctcaaggtatcctcctgcctcagccgcccaaagtgctaggattacaggcgtgagccaattcaattcctcaaactgagaagtaagaaccatacaataaataagcaaataagcaaagatcatttagaataaaagattacctaaagcaacgtctgaatcacattatttttaaacccacttattcagggctcacacatttctccaacattttggcagaagaaaactttatggaagataaaattctagttactctgagtaaacctgatcctcatccctgaacttaaatatgagtagtgaagctggcaataatcacaacccaaatgataccataggttggtcccaagaggctcaaaaattaataggccaagaaatggataaaggagttacatctttgtatatctacatctttgaatccttgcaatcctcatttcctctccttttccttcttgggagaaaatttccatttctgtactcctataccaagaaatccaaactaagagggacatcctggccgggcgcagtggctcacgcctataatcccagcactttgggaggccaaggtgggtggatcatctgaggtcaggagttcgagaccagcctggccaacatggtgaaaccccatctctactaaaaatacaaaaattagccgggtgtggtggtgcacgcctgtaattccagctactagggaggttgaagcaggagaattgcttgaacctgggaggcggaggttgcagtgagccaagactgcaccactgcattccagcctgggtgacagagcaagactctatctcaaaaaaaaaaaaaaaaaaaaagagggacatccttacttactagtattgtaaatactacaaatattcaaaagatcaaattcttctagggtttgagttccaaacgacagtacaaaggatgtatgctcactgttaaccatgactatctgtggataaatggatgggaggctctttaattttttattttacacattttgtattatttgactttttataacaatcacatatcattttaaaataaatttatatatatatatggcacaatgccagtcaatcattagttattttaaactaaataatagacttttaacaattcaactataaactgttagcaattcaatttcatttgaaatatatcaaactcaaaagccaagagtaaggaaactcttgccaattgtcatttaacatcatttactaaaagtgtactttatctaaataaagtcagtggaatggttttgtgccaccagagagcacacagcaactggaggacgtgagttatccacatagtaaagaagtgaacatttgtttccaaagcagggtaccaacatgtgtgaattccagtacagcaaatagaatatttaataccgaaagtgtgtggtatggaggaatcagcagataaatgttctggggagagatagccttttggcctcccatgacatggcagggggaggggggaagagagagagaaagagagagagagcgtgagctacttcatggatggatcaccaaccccacttgctatgcacctgaccaggaccacaccttctccaatgggagcggtgggagcctcactcctcatgcacaaaggggagctccctgaatgatatcccaaggggtgtcaccagatccaaacttgcccgtcataatcccatctgttattcatatttgctgtctatattttcttttggtcttcccttcctttgtaacaaagttcattgtaaagatcccatttcttgtctcagctatgctaagacaaggagatgggtggatagggaggatcaggtcattgctacaacactgcaaaagcatctgacagtcacttacctacttggtcatctgtatattctgtatctagatatttcatttgtgggtttgtctgtttgttggaaaagactttgtgtcaaggtgctagtagactgagcccatcttacacaatcacttattcaaaaataaggatgtctattcagtgtctaccatgtaccaggcactgctgagcattatatactgttccaatatttagaatctttattactcagaggccacagtatgaaacagattggtttgaaacatcagggtctggacactaggccattaaatggcaccagaatagacactcattaaaagttttcctcctctgggtgggcatagtggctcatgcctgtaatcccaacacttcgggaggccgaggccagtggatcacctgaggtcaggagtttgagaccagcctggccaacatggtgaaaccccgtctgtcctaaaaatacaaaaattagctggacatggtggcaggcgcctgtaatcccagctacttgggaggctgaggcaggagaattgcttggtctcacactcctggccggggatgaggaggcttcagtgagctgagatcgcgccattgcactccagcctgggtaacaagagcaaagctctgtctcaaaaaagttttcctcctcatctaaagaagttaatatgtttttcgaagtggaaagagacttggaaggactttcttactcattgtgtagctttagatcctgcaagtattcagaagatcaattcccatgggagttaagcccaagttctaaagagtttaaaacctctcgaagaggaaggggccaccaacatacttgtcaaggttgggtccaggagcaaggagggatactcagagatgagttcagtgctcctcatctaatttcttcctgcaagggatgactatagacagtgggatttctcactcatccaaagaaggacagcagcaggctgagtaaatatgagaaacgtggggttggggacagagctaggggtggagacctgactttctttcacttgcaggcaacttgtgtgatcatggccacaactcctctggccctcagtgtccccatctgtgaaatgagtaatagcattggcccagagctacctgaatagcccagtcagctccaatgtgtcatgatttccatctccaggaacagcctcgagtgtccagtctctggccagctatgaacttcacagttcatgactctagtccagattataaaatggcagagtccaaaccacaggttctcagacctgcagctctatgggctaaaatgcccctctgcacacatctctccagagtgaacctgtaactccaaacgaggaaggtccttggtgtactctgaagcttggcacgtcacaatgccaaacattgtggccaaagccataaacaggatggagcctcctgagctggtaggggagggcaggactctctagcactcagacttcagggcaaaggtacaaaccgccccagggaggtgcaggatcagccctgctctggcaggcatggctctcctgatcagcatggatgtttactttctgccccaaaactgagtgggacccaaagatactaacacatctcttttcttttccagaagctagacaaaaggacatttcagagccagataaaactgtgtgagcagctctggggaagacctaatgtttccagtccaagatctgaaatatatttcagagagcaggtgatgtgattcaggggctgggggaaagggagaggaggggcagtacttttaccaacataagtggccactgcaagagctaaggaggtaggagcttccctacagtccccccacatggtccccaaggcacttaccctcacactgcctgccttccccttggtagccaggcttgcaggagcacttgtaggaggtgggtgtgttctgacacagggcgtcggcatggcagtcatctagcccttgggcacactcatctacatctgcaaaagagcacagctgacacctggtacaggctcccaggccatgtgtgatctggcctcggccctgtctggcatcatcctcaccagcccaccccgcttcactcctcacaagctacagctgcttgggatccctgggataaaccaaactgtttctgggtccctgtttccaggaacagcccggacactctacgtgaaattacccccaccatcacctactggccttcaggacttagctcaaatccacctcctccaggaagcctgccatgacccccattgtagctgccctcaccaagtgctcgcatatgtatggctttgcatgcacacatcaggcagggttgtcactgttttccttcctctctctccactagacaatgtcttgacaacagactgcgtctgtgtcccttatgccaagccagcgcagtacctggcatgtgagtaggcaatagtacctacatgcccgctaaaggaggaaaggaccaaacggacagacaagctctgaacaccaagcagctgtctgtcagctttctcggagctcagagcaagcttgtccaacacagcccgtgggctacgtgcagcccaggacagttttgaatgcggcccaatgcaaattcataaactttcttaaaacattatgagattttttttttatttatttatttattttttttttttgctcatcagctgtcgtttgtgttggtatattttatgtgtggcccaattcttcttcttccactgtggcccaggtaagccaaaagattgcaccccgctggtttagagtatttatgggaagtctgccccgggatcggagcagatgtcatccagggctctcagatgctgcgaagcggggatggtgtccccatggccggccccctgcactcccacccctgcccatcctctcaacctggaaacccgccttggcagaagtatttcctgggttgacactactccaggatattaattaaaaacaaaagcattttgaaagtattgcaagtccagtaagcacagcacgtccagagtcctctctggaaaccaaagttctctgctgaaaacctaggcttgttgctgcttcagggtaattcccagatcggaacaggcgctgttccgctgacagaaaagtctctggagcccaccccgaagccatcagcagaacttgccggcccccaaagaaagaaacggcaaagctgccaccgcctcgcggatgtgcccggcccggccctcagtttccccgcctacgctgaggcgcgggaccccaaggccagggtccgcaccctcctgcctgctcgccggcgacggtctgactagcaggcgctctggaggcatccggaccggggcgggaaccgtcagcagctccgggtccgaggccgggccgaaggactcagggccccagcggtcgtggcgccttggcccggccggcgggtgaggtcccggggggagcagaggcccccgcggagctgcagccgccagccccgagccccgcgcgcccggctctggactccgccggggacctaaacactcttcctggccctgcctgctgtgccaggtgcgcccccgcggccggacactcaccctcctgcggccccgcggcacggccccgacccggcgggacggcccccgccagcagcagcagtggcggcagcagcagcagcagcagcagcaccgcccaggccgccccgggacggttgcggcccgcgacccccatggatggctcagcggttgcgggcagaggcggcggagtgcgggcggtggcggcggcggcgcggggaggtgtgcgcggacgccctgcccgctgccgctgccacccccggcccggccccgcccgccccccgagccccggcctcattttcacacggtccctcccgggccggggcgggaagcgcaggcgggagcagtgccgccccgcccggcctcctcccgtcccctccccggcctcgggtggagggggcgcggccgcggtggcccgagcgcggctgtcagcctggcggggcggcagcaccgtgcctcgcgccccgcgcagccctggcacccagcccgctgccccccgcatccccgctccgctccaacgctcggagccctcggtgccgcgcctgttccagtgtgttacaactcgacccaggccctcatgtgaggacaaacagcccttctagattgaaatattcggggtcagggcgcccagaaagtgttccgtatagtccccaaaccccaaagccatcttggggctttccacgtgggaggtgggaggtgggagtggaaggaattgggggtgacttccaattcgggaaaacagctgtttgaatggagaaggtgaccctggcttctctgcccaccccagcacaccctctgcacccttctccacactgcccaccccaggccctctgggatcctccatcccacagccctgagggcactggtccacttgtcccactgtggggcacactgggcctagaatccctgcaagctacttatgtatatctcagggcagcctaaggggaagggggctagaggtcaaaggtgagccaccagagacaacagacagcagccccgactttgccggagtacaggtggcatttacgatcacctgaactcataaacatcaggtctggctagcttcaaacacaggcagggcctagcacctagccttccatgaaagacagtccttgcaagggaacaggtacacagggtcttcccatatcacacttgacacggatggctggagcccaatacacccaccatcactccaggaacaaatatagtaacaatttccggacgcaaccaaacatcacacttagggatagtaatgttcttcactgagcttctccgtatttattcaattttctcctgcgattatatacatacacatatgtatatatgcaggcacacgcacgcgcgcacacacacacacaccattcctttggagatcagaaaaaaaatagatgtcaccaaaaaatccccacctagctcatgcacaaaaactcttatgtcttcttggggcctatccacagcccagagctcccagcctctgcaccctcagtacccactgtctgccaccccagcccccgaacatgcccacgggggcctgcctctttgggctgtggctagtgcagctgcttgatggagctatctgagaaaataacttttctgtagttgtttttcttttgaccctttcagtgaaggcaggcaggttgcgtccctctttctgtctgcgcctccctcccactcccttttgtttggtgctgagagagacactcagctatttctggtcataagggtggtttttacacatttgtaaatcttcagttagtgaaacgttctctccacctttgtctttgtgtccttaatggtagccataaattactgccttcttttctctccactgcatcaggcttcattgcttttgaaatgatcaaagttatttcttttaaaatccaactagaaactgcccattgtgtggcacagacctctttagctccagttaaagcatataaatacataaagctgcccattaaactctagggggagcctcctgcagcgcccttgtgcctggcaaagaaatcacacatgtgctattcttcccctttacctttccctaacttgatctttcagtaaggacataaattaataatgacaagaatcagcgcctttttgcctaagactgtcagcttttgtcatgtttcccagaaaagtccaccactggcacagatctcaaaaaatgttctgtatcctattttgtttgcgctgacatccttacaaacgtgctttcagctgttggctcccagactcctgggcaacctttttgacacttgagattaaagtcaatatggcttacaaccgggaatttccacagggggaagctccaggggaaaactgtgtccaaatgtcagtgtttttggtgtcaggaggaacttggttggctctactctggctgcaggctgccctctattctgcagctgaggtccccacaaacttctcagaaaggcctcagacaccgtccctggactgaggctaaagctccctcttcctctccctgtctcctctccacaggctgagaggccatgaaccaggcctcaggggtgcgaagaggcagtccagccagcccagtcacactggtgtgggcctttgaggaggctgaagaaagcctggtagtggccggccatgcgtgcccctgaactacacataagcaggtgccactctgcactcatgggacaccattcagtgcccacctttcttgactccccccccgcccccagcagcctctgacatgtggactacttctccctggtggaaactctccttacccttggttgtcatcgtggcaaactcctggttttcctcctacctctcaggaaatgccttctccaccatcttctaggagtcctctttctataccctctctctggatggttcactcattcccttgattccataatgtcaatctccagcctggattcatccccttggttcaatcccatgtatccagttgcctactagataccaccttgatcttccctagatcccaccttgatcttccctagatccctctgattgaacatgttcaaaacgaagctcatgacctagaagaagcttctctgctttctcgaatctctgcctggttcagcccacccacccctccactactgcctccaccatgtccatcagggtgacccagaagtcctacagggtgtccacctctggcccctaggccttaagcagccgctcctacacaagcgggcctggtgcccatatcagctcctggagcttctctcaagtgggcggcagcagcagcttccggggtggcctgggcacccgcatggctctgggtggaggctatggtggggccagtggtatggggggcatcacagccatcatggtcagccagaacctgctgagcccccttaagctggaggtgaaccccaacatccaggctgtgtgcgcccaggagaaggagcagatcaagaccctctacaacaagtttgcctccttcatcgagaaggtgcggtccctggagcagcagaacaagatgctggagaccaagtggagcctcctgcagcagcagaagacagctcagagcgacatggacagcatattcgagagccacatcaacaaacttcggcggtagctggacactctgggccaggagaagctgaagcttggcaacatgcagaggctggtggaggactccaagaacaagtatgaggatgagatcaataagcgtacagagatggagaatgaatttgtcctcatcaagaaggtaacgtggctgaagctaacatgaacaaggtagagctggagtctcttctggaagggctgactgacgagatcaacttcctcaggcagctatatgaagaggaaatctgggagctgcagtcccagatctcggacacatctgtggtgctgtccatggacagcagccgctccctggacatggacagcatcatccctgaggtcaaggcgcagtacaaggagatcgccaatggcagctgggctgaggctgagggcatgcatcagatcaagtatgaggagctgcagacactgcctgggaagcataggaatgacctgcgttatgcaaagatggagatctctgagattaataggaacatcagccggctccaggctcagactgagggcctcaaaggccagagggtttccctggaggctgccatcgcagatgctgagcagtatggggagctggctgttaaggatgccaacacgaagctgtcgagctggaggccgccctgcagcgggccgagcaagacatggtgcagcagctgtgccatggagcaccaggagctgatgaacgtcaagctggccctggacatcaagatcgccacctacaggaagctgctggagggcgaggagagctagctggggtctgggatacagaacatgagtgtccatctgaagaccaccagtggctactcaggtgggctgagctcgacccacgggcacctcacaagccctctacaacaggccttagctacagcctgggctccagctttggcactggtggaggctccagctccttcagccgcgccagcttctccaggtccatggttgtgaagaaggtggaaacgcgagatggcaagctagtgtccaagtcctctgatgtcctgcccaagtgaatggccatggcagcccctaccagcctgcccctcctgcggctgccccagggcccgtggaggaagccgctgtgcagtggagcacaggaacaggagactcacctgaggctcagccctagccctcagcccacctgctgggggagtttactgcctggggcacccccattggccatgcttccagctacaaaacaattcaattgttgcttttttttttttttttttcaaaataaaatctcagctagctctgccaactgtccaaaacaaacaaacaaatggagctcatcttcctcaaacctgctccttctcaagtgctctctcctttagacaagggcaccaccattctgttaacaccaagtcagaggtttggcggtcatctgggactccattatctccctccccaccacatccgaacaatcaagaaaattctaccttcttattgtctcttaaaaccattctcttcctctgtgcccattgcctgagctcaggggttcgccatccctcatcacccctgggggctgtgtatctatccctttcctccttcctaacagatactcactcctcctgcagacagcccgtgtccctaggaaggaagctgccccatctctaacttcaggctctggagttgacttaagacaattgatatcattcattccattccccctgcaacagtcattggttcagggatgagcacgtgacggatttccaatcggagcaaatctcaggccctttgcttgaaaggctggaatggaaaggctctctttttctctttgggatgtggctgtggtaaatgagaaactgtggcagccatcttaatacctccttcccttgcccaaaagagggtaagtccagagaaaccctgagaagccaaccaggagacactctggttgcacctagtctgcgatttcttacaggtctctctgtctagaatctcatcccaattcagtacattcaacacagtggctgccagagttaaaagtaagtttcatcatatcactcccagtcttcctcaggctaacatccaagctcccttggtacaatcactctggagaactgccgggcagtatacactaatatggatcatgcatgcccacttctcagaatatacccaagagaaatgagtgtacatgttcaccaaattcatatacgagaacattcataacggctgtatttacactagccccaaactggaaatcacccacatgtccatcaactagataatgaacatattgtgggatatttgttcaatggaatactacaccaagcaacaaaacgaacaaactctgatacaggcagccacacagaggcaccttatgaacattaggcctagttaaagaagccaggttaaaaagggtgcaagtagtatcattctgagagacaggactagctggatttcctaggccgactaagaattcctaagcctacctggggaaggtgaccacacccacgtttaaacacagggctggtaactcagctcgcacccaaccaatcaggaagtaaagagtgctcactaaaatacaaattaggccaaaagcaggaggtaaataaatagtcaaatcatatatcgcctgagagcacagggggagggacaatgatcgggatataaacccaggcatcccggcagggagcggcaaccccctttgggtcccttcccattatatgggagctctgttttcactccattaaatcttgcaactgcacactcttctggtccgtgtttgttatggctcgagctgagctttcgctcgcagtccaccactgctgtttgccaccgtcgcagacccgccgctgacttccacccctccagatccggcagggtgttcactgcactcctgatccagcgaggcgcccactgccactccctatcaggctaaaggcacgccattgttcctgcatgactaagggcccaggatttgtcctaatcgagctgaacactagttgctggttccacggttctcttccatgacccacggcttctaacagagctataacactcacctcatggcccaaggttccattccttggaatccgtgaggccaagaaccccaggtcagagaacaaaaggcttgctaccattttgggagcggcccgccccatcttgggagctctaagaacaaagacccgcccgtaacaattctattcacttctatgatgttctgctgggtgtggtggctcacacctgtaatcccagtactttgggaggccagggtgggtggatcacttgagctcaggaattcaagacaagcctgagcaacacagcgagacctcatctctaccaaaaagtttttaaaaatcagccaggggccgggcagtgtggctcaaacctgtaatcccagcactttgggagactgaggtgggctgatcacctgaggtaaggagttcgagaccagtctggtctacatggtgaaaccccgtctctactaaaaatacacaaaaaattagccaggcatggtggcatgagcatgtagtcccagctacttgggaggctgaggcagaaggatagcttgaacccaggaagcagaggttgcagtaggctgagattgcaccactgcactcctgtcatggcaacagaacgagacctcgtctccaaaaataaaaaataaaaaatcagccaggtttgctgatgcatgcctgtaatcttagctactccagaggctgaggtgggaggatcacttgagcccaggaggcagaggttgcagtgagctgagattgcatcactgcactccagcctggacaacagagcaagaccctgtctcaaagaaagaaaaaaaaccagaacaggcagaactaattaatagtgacagaagccagaattactactactgttccctccagggatgtatattgacattttgtttatctgggaaggaatgtgaaggaacattctggagtgctggaaatgttctagatcttgatctgcatggtgattttatgggtttatacatatgtacaaatctgcgggaatgttggcttaagcttaatgcacttcatgctcttgactgtatgtatgttttacatcagtaagttgaagcaagtactgcctagctcaagacctttatgatctgatcccattctatctttccagccttctctcctaccactcctttacccgcagactacgctccactgacatcaaacttcacatactagtagtttgtcatttttctccttatacatatcttcttttgctgacactgttccctctgcctgaaagacatgaggaagtgggtctcaacaaatatttgaaaaaacaaaatgcaacaacatctagattaataaatatcactatactccaaggaaaaacacatttgctgagatgttctcccaaaaagcaatgaggcatgcatgaaaaaatttgagttggctgggcacaatggctcacgcctgtaatcccggcactttgggaggccgaggcaggtgaatcacaatgtcaggagttcaagaccagcctggccaacatggtgaaaccctgtctctactaaaaatacaaaaaaataataataataataataataattagcgggctaagtggcgggtgcttgtagtcccagctacttgggaggctggggcaggagaattgcttgaactcgggaggcggaggttgcagtgagccaagatcgctccactgcactccagcccaggcaacagagtgagactccatctcaaacaaacaaacaaaaaaacaaacaaacaaaaaaattgagtcttcagattagcaggcactgagaactaataaataaaggaaaactatctgctcttgcacacacattaatttctccccatgaatggcttccttatcttctggaaaaaccttttcaatatgtctgagctggctatgaggtagtaaatctttctggttgcttacccgtccccatctgttctttccctccttcctaacagacactcacccctctcgcaggcagcctgtgtccctaggagggaagctgtcccatctctaactgcaggctctggagttggcttaagacaataatgcctattattccaacagtcattggttcaaggataagtacgtgacggctttccaatcagagtgaatctcaggccctttgcttcaaaggctggaatagagagacttttcctttttggcatgtggttgtggtgaatgagaaactgtggcagccgtcttgacacctccttcccctccccaaaagaggttaagtccagagaaaccctgagaagccaaccaggaaacactccctacctcaggacctccagttatatgtgccaatacgcttccttattgtttgtattggtgggtttattttgatttttaaaattgtggtaaaacatacataaaatttactgttttaaccatttttaactgcacagcttattagcattaaatacattcacattgctttgtaaccatcacggccatccatttccagaacttttttttttttttttttttgagactgagtctcgctctgtcacccaggctggagtgcagtggcgagatctcggctcactggaagctccgcctcctaggttcaagccatgttcctacctcagcctccgagtagctgggattacaggcgcctgccaccatgcccagctaatttttttttttctttttttggtattttcagtagagacagggttttgctattttggccaggctggtttcgaactcagatgatcctctcaccttggcctcccaaagtgctgggattacagacgtgagccaccgcgcccagccatccccagaacttccttcatcctgcaaaactgaatctctacctattaaacaataactccccatcccactccacctgacaaccaccattctactttctgttcctatgaatttgactactttaagtatttcatatgagtggaataacaaagtattcatgattggcttacttaacttggcataatggcttcaaggttctcctgtgttgagcatgtgtcagaatatcattcctttctaaggctaaataagatttgattgcatgtatgtatcacattttgttcatccattcatctgtccacagacacttgggttgcttctccctttgggctattgtaaataatgctgctatgaatatgggtgtgcaaatatctgtccatgtctctgctttcaatttttttttcagtatatactgaattgctggatcagatggtaattctttttaattttggggagaactaccataacgtttaccttaccaactacaccatttcatattcccaccagcagggcataaggattccaatttctccgcatccttaccaacacttgtaatttcccaattttccaataatagccatcctaacagacatgaagtggtatttcattgtgagttttttgaattgagtttcctattgttttagccaaaaaagtattcctatttagttctatatacgcctccattaggcaatcctctccataaggtgggagaaaggtaattgtgtagggttgaatcctctcaggggctgaaataataaattattattttagtcacaaaagttgatgcaatcttggcatgcatgccaggaccctctatttcttcaatgtttctaaaactgcacccacattcttttttgcttacagaagtttaaaaatccttccaataaatatttacttaaaatgataatagttaacatttgaatgaatactaaatatcagatactattctaaatacttcacatgtatttatctagtcttcctaaaaactctgcgaaatagaaccatcacactctgtattttacagatatggacagtgaagggaagagaggttaggtaatttgttagtaagtggcagaccaggactcaatgccaagaagcctggcttctgatccccctgcctaaccaatgcgctctacagcccatcgtgtgccaggcattgtgctaagccctatgggagacacaaagattagaggcaaactctgccctctcagagcttacagtccagcaaaaaaggtgagacataatgggtgttcatcttccacacctcttccaaaatatgaatatgacagtgtcggtttaaaactccttaaagccccttcacctacattacctgtaccgtagaccaacctaaggggcaggagcagctgcataatttgcagggccccgtgcaaaattaaaatgcaaggtgccttaaccaaaatgcagggggaagatgctattaagagcactaaaaatagttttttcttttaaaaacattacttgtaaaacataataggggtaacacgagtaaaaacataaatttacaaactgcaaaaaggtagtattttggtgtcataatgttatgcaatacaacaaataaaaatgctccattaggccaagaggagtggcacacacctgtaatcccagcactttgggaggccaaggcaggaggatagttgagccctggagtttgagaccagcctgggcaatacagtgagaccttgtctctccaaaagataaaaaaattaactgggtgtggtggtacccacctgtagtcctagctacttggaaggctgaggcaggaggatcgcttgagccagggaaatcgaggtaacagtgagctatgattgcaccactgcattccagcctgggggacagagcaagagcttgtctcgaaaaaaaaaattgctccattcatgtggtatcttgattcatcataagatttttctggctcatttttccacaaaatcatttccacaaatcattttctgcaaaaatcaaagaggtcgtcaaaatgtatacttttaggatcttcatttttagtcagtataattgaaggtatatcaattgttcttggcaaattaaaggtgacaattttttataattttcaattttcagaaggatcttgctagggatgtaatttctagtggatctcttattggatctacctgttactggatctgttttagtacatctagaactgataattcttgtggaattatttttctaaaaagatttaacttttcatacaagtcatttttgtgtaaatctgaatttaattttaatgtacacttacacaatgtcattttaatgttttctttgacacttcttgtaacatgtggaggttaaataagaagctgaaagtggtttcatgatttgtatgtaattcagaagtcctgtttatgtataatatttctgtatcttcaattacaaggaaaaatttattttaaaattgtcttccttgttaataattgcttaatctgaaacttcctacgaaaatagggctcttttcaatctaatgcaatgatttttatattcggtttctgtccctaagcctgcagatatttgctttgttatgttgcagcagttttaaaaatcagaggctgggcatggtagctcgcgcctgtaatcccaacactttgggaagccaaggcaagagaatcacttgagcccaagagtttgagactaacttgggtaacatagcaagacctctgtctctacagaataaaaacattagctgggtacggtagtgcatgcctgcagtctcagctacttgggagaccaaggcgggaggatagcttgagccactgcactccagccttggtgacagagggagaccttgtctctaaaaaaaataaaataaataaaaaccagagattctaaactcttcaaaaaattctgaaacatgctgctatgctttattgcaatatccttgtgtttgcttttattttgtaataatttactgactaagtttactgcgtgagtactagcaattcctgttccagtgctcaggccagagagttaatatttgtgtagctatcaaaggaacacagtctgggagtgaacaggcaagcagcttcccatgcactgtccccatgcagagacccgctttcttctgtggtcactgtggctgttgccacagtcttagctgatgtgatgggccctaggcccagctcagctggctcggagccctacagtgccgtggacttctcctgaaacatacacacatgcagccagcagccaggcctgtccctatgtgtgctagtgctgtcacctggtgtgtctccactactcatgtgcatgtaccattgtcccaccagactttagttacaaaacacaagttgaaagatgaaatttagaaatttcaagatggtaacagcaaggcctaacaccaaacatggggcccttctgagaacagggccctatctgtctggctgtacaggttgcacactctgaaagccagccacactcatggatatggcattcgagaaccctcccccctccttttttttttttttgagacggagtttcccttttgttgcccaggctggagcacaatggcgctatcttggctcactgcagcctctgcctcccaggttcaagcaattctcctgcctcagccttctgagtagctgggactacaccacgcctggctaatttttatatttttagtggagacggggtttcaccatgttggccaggctggtctcgaactcccgacctcaagtgatctgcccgccttggcctcccaaagtatcaggattacaggcatgagccactgtgcctggccatcaagagcccttataatctgcctcttgtctttcatccaagccttgtgaggccccatctctcaaacaagtgcacccaatttccagccctcccaaactgctccacaactccaagcctttgtccagcccctctacctcgaacattcttcctggccacagctcatcctttgagacttgctgtagtatcaccttcccagagtctttcctaacaaaccccctcctggcctggggtggacacttctcttgtgtgtccccacagtctgctgcacaaattctaatcatagcatccaacatacagtcatagccgtcaaagtccatgactgccttcacaggttatggacttcgagcctcataagggcatgtggtctctatgattcacctctgcattttccaggctcagctaggtctggaacacagcagacactcagaaaaggtttgttgaaagagtagatacaggttctcaagaataaagtattaggatctgagctcgttttattattctcgtaaccaggaagtcatagacactacctaaagaaacggccagtaggccgggcacggtggctcacgcctataatcccagcactttgggaggcagaggcaggcagatcatgaggtcagaagatcaagatcatcctggctaacatggtgaaaccccgtctctactaaaaatacaaaaaaaattagccagacgtggtggcacacacctgtagtcccagctactcaggaggctgaggcaggagaatcacctgaacccaggaggcagaggttgtagtgagccaagattgtgccactgcactccagcctgggcgacagagcaagactccatctcaaaaaaaaaaaaaaaaaaaaaaaagaaaaagaaatggagagcaaaggacatcatagaaggttataattataaaggcaactacaagaagaaaaatccaagattcctaaatagcagaagagccatgtacacaaaactgacctcaagacaaagaaatgatggaggccaatttatatggaagagatagagaagactgtcaaagagttaccctacccctgaaaaaaacagcaggcccaggcaatttcacaagggaaatttgaacaaacttttaaaatgtaaatattccaatgttttttaattgttccaaagcattgaaaaaaactttcaaattctttatgaagcaagtataccattgataccaaaacttaatactgtacacaaaaaagcaagctatagatcaatatcacttatgaccataagttaagaaccctcaataagaactatcaatcagatttcaacatcataaccaagtgggatatatttcagggtgcaagtatggtttaatattatgaaatctacttacataattaatcacaataaatttgaatattatagatttgagagggaaatcatatgatcacctccatagacactaaaggcatttgaaacaatattcttgatcaaaacattcaataaggtagagaaagataccatcttaacatgaaaaaaaaaattatctcgacccaataccaacatcagacttaatggggaaacactagaagcgtctccattaaattctgaaacaacaaaacaaagatggtcatgtcaacactatttaatactttactgggtgtgttgggtgaatcaactagattaaaataaactagtggtataaaaattagaagagaggaactattgcaggaaatataattgtatatcttgaaaacaccaggaaatatgctaaaaatctactacagcaaaaagaaaatacaacaaaattagtcaggaacaaaattaatttacaaacatcaagttttatcaatataagtaacatggtgcaagaaaagaccttatttctattagaaacaaaaaaaattcaatacctggcaacaaacttagcaagaaatagtcaaggcccatgtgaggaaaatgtataacatgctactaaacataacccccctcaaaaaatttaaacaaatggaaatataacacgctcttggatagaaatcctcaacaccataaagctgtaaattctccatcgcttaatttaaaaattttaatgtaatccaacaaacatacgaataggcttttttggctaaaaaatttgagtctaaaagttcatatagaaaaagaaagaagcaaaagtagcaataaaaaatgtaaagaagagcaaggagcaagggggaggtgggtcagtactcctagatgtaaaaggatgttatgaagcctcagtcatcacaacaatgtagtgctggcctgtaagttggagacagatagaggctaatggagtagaatatcacattcagaaatagtctcaaaatcatatatggatacactatcataaaactgacatctcaagtcattggagaaattacggaccactaaataagcagtactgggacaaataagcagccacttagacaaaaataaagttgaatccactcttcatggctctctaggttaacttcaaatgcgtaaaaaatttaacttttttaaaaaaacctcacaaatgctaaaagaaaaatggaaaaatacctttcatcttgtagtaaggaaagccttctatcacccaaaatccagaagctatataagatcaagaagttcaactgtaccaaaacgaaaaactactctgcatgtttaaaaaacactgaaagtaaagttgaagaataaatattaaaccagggaaaagttttcatatcaaatcacaaagaagtaatctccctaatatataacaggagtcactagcggtcaataagacttctaagtaacccaacagaaaataggcaaagaacatggatagacaagaaatataaataaattttaaacacatgaaaatattcttagcctcatgcataatgaataaaatacaaaataaaacactaagatagaaatgtttacttactgagtacactgacaaaaatccaaagtttgataacactctcacagtgagactgggaaaacaggcatttcaaacattggtggtgagagtgtatattgacataagttctataaagataaatctcaaattatctatttaaattttaaaagtatttatcttttcggccgggcacggtggctcacgcctgtaatcccagcactttgggaggctgagacgggtggatcacatgaggtcaggagttcgagaccagcctaaccaatatggtgaaaccctgtctctactaaaaatacaaaaattagccgggtgtggtggcaggcacctgtagtccagctactcgggaggctgagacagaagaattgcttgaacctgggagacggaggttgcagtgagccaagactgtgccactgcactccagcctgggcaacagagtgagactccatctcaaaaaaaaaaaaagtatttatcttttcacccaacaattttacttttggcaatttattctactgatagactcttatgtgcaaaatgacgtatgtacaatgctattcaccacagcattgtttgtagcagcaaaatattagaaacaattcaaatggccatcaagttgactagggaactagaaatataaattacatgacattcataaaatagaacattaagtagctataaaaatgaatgaaggtgctctatatgttctaatatggaaagatctccaagatacggttttaaatgggaaaaaagtacagaacagtgcatatattttgctactttttgtgtaaagaaggaagagaatatgtacttgtatttgcttgtatatacataaagaatctctagaaagatacataagaaaaagaagatggttaccaaaggcacggatgggaatggatagatgggagtcaaggatgggagggggactttctctttatactttgagttgttgacattgtgactatattatcatgagaggaggagaagcaggaggaggaggaggagaactggagtagaggtgatttttattgtcataactaccaaagtacttaaaactgaatgaagtccagatcacagtcacttttgagaatctcattgcttatcaggtgggatttttcaatgtgagatttgctcatagttcattttcagccacagagtacagcactgactttcaactgctgccttagaattgttgacatgattatggtgaattatacccctgaccaatctgggctaaaaaggcaacagataacatcttttaaatttttgtggcaacattggtaactattgcctacaggctgtgagaaaagaataggcaatcaaaactcacacacacacacacacacacacacacacacacacacactttggccagtgtgattctatatatggttaaaatcatcatataagattgctgatattggctgggtgtggtgtctcaggcctgtaatcccagcactttgggagactgaggtgggtggatcatgaggtcaggagttcgagaccagcctgaccaacatggtgaaatcctgtctctactaaaaatacaaaaattagccaggcacgggtgcgggtgcctgtagtcccagctacttgcgaggctgaggcaggagaatggcttgaacccgggaggcgaaggttgcagtgagcccagattgtgccactgcactccagcctaggcgacagagcaagactcggtctcaaaaaaaaaaagattactgatattaggaatgccgtaatccttttaaattagctcgcagagcctattaatgagataatgagttaagatgtgacctgtgagtccttataattatctacaattcagttattgcaggtaattgtctaccctttcacttattaataggtcaacaaaaagtcagcttgttaattagctatttctgaaatattgttcataccagtaatcaagggaaaagaaaaggaagagaaaaagaaaaagaaagaaaatagagtttgatatggtttggctgtgttccccctcaatctcatcttgaattgtaatccccataatcccttcatgggaggcacccagtgggaggtaattgaatcatgggggcagtttcccccatgttgttctcgtgatagtgagtgagttctcacaaaatctgatggttttataagcgtctggcattttccctgctggtactcattctctctcctgccgccctgtgaagagctacctttcaccatgattgtaagtttcctgaggtctccctagccatgtggaactgtgagtcaatttaacctcttttctttataagttacccagtctcgggtatttttttcatagtagcatgagaatggagtaatacagagttcatatatcttgtatcaaaaactaggcatcatatgtgacaaaagcagcagggactttatataaatatatttgtagaaaaaatagcccctgtttttatcttgctaccatgactccaaaggggtgaagccaaagtttctacaatgaacatgcattacctttataattaataaaagaggccaggcgtggtggctcatgccaggcgtggcatcccaaagatttgggaagccaaggcgggaggattgctttagcccaggagtttgagactagcctgggcaacataatgagaccctgtctcaactaagtaactaactaactaaataaataaataaatgaagctaggcacagtggtgtgcgcctatctatagtcctagctactcatgaggctaaggcaggaggattgcttgagcccaggagttcaagaaacagtaagctatgatcataccactgcactccagactgggtgacagagcaagacaggaaaaaaaagaaagaaaagaaaaggaattttaaaatgtaaacaagtacaggctgagcatgcagacaggcctgatgttaactctgattctgtcatttattatctacagaatcttgggcaggttgctttaacctctctgagtctcagttttcccacatgtaaactgaagataatcatacctgctttccagggctgaagtgagctgtggatggacgatgtgtgtgaagcactgagtgcaggctgtggcacagagtaggcacacagtaaaaaggattcccaccccccacccacccagtggaggcaagacccatggaagtcaagcccaacctggaccacagttcctgagtttctccattcaggctattctgtggctgtgtaaaagaacaggtacttgtccctgcttgttggaagaaacctggttattaatccatacccatcccatgactgtaattaggacacctggaatttttggaaataaagtagctctgtccagatcccagaagggtgttttccttattatgctagtgaaaaggtttcagtgcaggaaatggaaatggctgtagatattgtaagcagaaaggtctacaatagagagaactaagagcttacaaaatgattagaagagctggaggggtgagctctagactgaacttcaggaaggatttttaggagacaacagaactgacccagctgggaggccactacttctcagcaaccatgggacaaacttcaagaactcactaagtagttcagacacctgagcttgaactctgtcgcttgttatccatgtaaccttgaacacattgcttgaattctcaagaatcaagacaaggaagttggcatcatagccactgcttctctgtacctataatctggttaatagattcatcaccacaatcttttttaatcaaaaacaaacaaagctaaaaccaattgggaaacagcctctgcctcatctaaacttttcaaatctcacataagtacatttcactagtagaaagtcatgtccagaaccctagctgcgagggagcttagaaatgccattttttagcttgtcaggctctcagtgcagaaaggcatacgagaaacaaatttatcacagaaagtcattctcttggaaattggggcaacctcagccaacacctatttgtctgcataggctccaagagtagtcatgagtttatgctcattacgctcactggaagatgtagtaggcatttggctgccttgtaagtatacatcactccttctctctaacaatgcccagcttttaatttattaatttcattcggatatctaccgctcctctaagcaacacatgccttcggaaaactgaccccaattccagctccaggggtggaacctaattaaattagcacatcccatctttctggtcacagacattggtctaaaggcaggcatgttaacaaagccagaagaatcatgatgagaagcaagaattcaagaattttgcttgaattgctgacacaaaagcactctcatgtctgcttgatgtaatcaagaaaacaagtagtccttgcttctgtcttgctaccatggatgaagccaacctgaggaaaaagctcatacacagaagagggaagagcctggaatctcagagaaatagaactgggccctgctcaaaccttacctgaactctatattagagttatgtagaaagagattgattaatgggtttagcagcagctaaagtgaattggaaaacagattggaagaaaatatccacaatgaataaccagattcatggagaggcaaagggattgaaaatacagatatgaacataaaagacatacagaatacagtgctaaggtctaacgtatgtgtaaacagaatcctggaaggacaggggagaaaatttgaaaaagcagtatctaaagagatagtggatgaagaatttctaaaactgacaaaagacaaagccccagattcaggacacattgtgaaacccacgctgaataaataccacattcaggcaaataatagtaaattatttttaaaaaatgacaaagaaacaatatcaaaaacagtaaagaatcgagagattaccttgactggaacaacaacaatgaggctgccaggtaacttatcagtggaaactgtagaagccagagacaatggaatatcttcaaagttctgaaagaaaataagcgctaatccagaatttcatacccagctaacatgtccttctaaaggatgagatgatttaactccagcaaacccctgttaatggaaaatactgaagggtgttcttgaagcagaagaatataggcattctagacacaggcattaatgaagaacatcaaaaaagggggaaggctagataactattgtatttttaaaataataacaataatgtaataacatctaatgggtttaaatatatacatttaatattcaatatatttttattacatatatttattgttgtacataatatatatatgtgtatatatatatagagagagagagagagagagaattaaaatatataacaacagtaacatataagtccagacaagaaatgaagttattctaaaggtccttacattgtctggaaagagaaagagtaataatttagattagacattgataagccagtgcatattataatttcatgggtcactactaaaggaagagtaaaggaatagaattaccaagctaacagaaggggaaaataaaataattgaagaattcaaagaattgaaattatacagattgtgtaagtgtgtcttggacacagcttaagctaaaactaataagaaaaagaacagcaaattaaacccaaggaaacaacccaagtaattaatcacactgctttattaaaagagaaaaaaagtacataattatctcaataggggcacaaaaatcttctgataaaagtcaacatccggccgggtgcggcagctcgggcctataatcccagcactctgggaggccgaggcaggcggatcacgaggtcaggagatcaagaccagcctgaccaacatggtgaaaccccgtctctactaaaaatacaacaaattagctgggtgtggtggcagccacctgtagtcccagctactcgggaggctgaggcaggagaatggcatgaacccgggaagcggagcttgcagtgagctgagattacgccagcctgggtgacagagcgagactccttctcagaaaaaaaaaagtcaacatccatttatgataataatgcttagcaatctaagagtagaagggaattctcttaatctgataaagaatatctaccccaaacctagagcaaactcacatttaatggtgaaaacttaaaagcttctctgcaacagggaacacagtagaatacctgctatcatcacttcaccattgtactaggaatcctaggtaagtcaataagacaagaaaaagaaattaagtctaagggttggaaagggataaaaatgaattattcacaaacagtatcagtgtggatttagaaactttttaaaagtacaggcatacctcagagatattatgggttcaattccagaccaccacaataaagcaaatattacaataaagtgagtcacacaaatttttttgtttcccattgcatataaaagttatgattgggcaggaatggtggctcacatctgtaatcccagcactttgggaggccaaggtaggtggattgcttgagctcaggagttcaaggctagcttgggcaacatggcaaacccgtctctacaaaaattacaaaaattagctgggcatggtggcacaagcctgtggtcctagctacttaggaggctgacaggtggaaggattactggagcccaataggtcaaggctgcagtaagcttagatcatgccactgtacgccagcctaggcaacagaatgagaccctgtctcaaaaaaaaaaaaaaaagttatgtttacactacactatagtctattgtacaatagcataatgtctaaaaatgtacattctttaatttaaaaatactttattgctgaaaatgctaacagtcatctgagtcttcagcgagttgtaatccttttgctggtggagggtcttgcctcaatattgatggctgctgactgctcagggtggtggttggttgctgaaggctagggtaactgtgacaatttctgaaaataagacaacaatgaagtttgccacataattgactctttctttcacaaaagatttctctatagcatgcaacgctgtttgatgggatttttacccacagtaaaacttctttcaaaattggagccaatcctctcaaaccctgccgctgcttaatcagctaagtttacataattttctacctcttctgttgtcatttcaacagtgttcacagcatcttcaccaggagtagattccatttcaagaaaccactttctttgtttatccataagaagcaacttcaagtttaatcataagattacagcaattcagtcacatcttgaggctccacttttaatcctagttctcttgctgtttctgccacatcagtaattactccctccactgaaatcttgaacctgtcagagtcatgcatgagggctggaatcaacttctcccaaattcccattaatgttgatattttgacctccttccattaatcataaatgttcttaatagcatctagaatggtgaatcctttatagaatattttcgttttgcccaggtccatcagaggaatcactatgtatggcagctatagccttatgaaatgtatttcttcaataagacatggaagtcacacctactccttgatctatgggctgcagaatgaatgctgtgttagcaagcatgaaaacaacatgaatctcccgtacatctccatcagagagctcttgagtgactaggtgcattgtcaattagcagtagtattttgaaaggagtctttttttttttttttttttgagcagtaggtctcaacagtgggcttaagagattcagtaaatcatgctataaacagatgtgctgtcatcccagctttgttgttccatttatagagcacaggctgagtaaatgagcactggcttcaacttaaagtcactagctgtattcgtgcctaacaagagagtcggcctgtcctttgaaacttcaaagccaggcactgacttcccctctctagccatgaaagtcctagatggcatctccttccaagagaaggctgtttcatctaccttgaaagtctgctgtttagagtagccaccttcatcagtgatcttagctagatctggataacttgctgtagcttctctatcagcacttgctgcttcaccttgcccttttacactatgaagatggcttctttccttaaacctcatgaaccaacctctcctagcttctgacatttcttctgcagcttcctcacctatctcagccttcgcagagctgaagagagttagggccttgctctggattagtctttggtttaaggggatgttgtggctggtttgatcttctatccagaccactaaaactttctccatatcagcaataaggctatttgactttcttatcattcatatgttcactaaagtagcacttttaatttccttcaagaacttttcctttgctttcccaacctggctaactgtttggggcaacaggcctagtcttcagcctatctcagcttttgacatgccttcctcactaagcttaatcatttctagctttgaatttaaagtgagagacttgcaactcttcctttcacttgaacacacagaggctactgtaggattataatttcaatattgttttgtttcagggaatagggaggcctgaggagagggggagagatgggagacgggccagtcagtggagtagtgagaatatacacaacatttattaaatttgcgagcttacataggcatggtttgtggtaccccaaaacaatgacaatagtaacatcaaagataactgattacagatcaccctaacagatataataattaacaggtgtgaaatactgcaagaattaccaaaatgtgacacacagacatgaagtgaacacatgctgttggaaaaatggcgccaacagacttgctcaatgcaagattgccacaaaccttcaatttgtaaaaaaaaaaaaaatgcagtatctgtgaaggacagcaaggcaaagtacagtaaaacaagctatgcttgtccagataaagtcattacaattaatatggctaactgtactattgttcacaaatattctacgtgcctccctgccttgttaaacttaaacatacctatgtgatttactttggctaagtggtgtgtgtatcttctgggaagaagctttaggagccagctcagggttaaccatgttctctgttttctgtacgtatgagaatcttgaagcatgtgctgagacagatcctctatcagtctgggtccatgagcgacttcaaagggcagggcttccatgcagatctgtagtggatttatagtgtaagtgaaaggcaaatgctgtttaaagaagtgaaagtttttgttttttactgtagcataacctagcttatcctgatggacacacttgaggtttctggatgtgagaaacatcaaatgtatttctataaagtaacagcaacaaataggaagtttaaaaaaaaattttttttttgagggacaggatcttgcttttttacccaggctggaatgcagtggcatgatcaccatttactgcagtctcaaactcctgggctcaagtgatcctcttgcctcagcctctcgagcagctgggattacagatgcatgccaccatactcagctaattaaaaaaaaaaaatttgtagagacaggttcttgctatgttgcctaggctggtcttgaactcctgggctcaagtgatcctcccaccttggcctccaaagtgctgtaactacaggcatgtgccactgcacccagctgaaagtaaaaatttaaaggtactgtttgtaatagcataaaaaatagtgagtacctttgggacaaatataataaaatatgtgaaagacctctacccaggaaacaataagacattagagaattaaagaagatctaaattaatgaatataacatattcatggattcaaagactcaatattatgaagatgccaacatttctcacattgatctacagattaaatgcaatctcaataaaaaatattagcagtgttgttcatggaaattgacaagctgattctataatatatggaaatgcaaagaataaaaaatagtcaagacattcttaaaaagaagaacaagatggaaatactattaagtatcaagacttattataaagctacagcaattaactttgatattggcacataggtaaacaaatagaccaatcccctttctgcgggtccagaaagggacccacatatgtagaaccttcttttttgtttcttgtttttgagatgaagtcttactctgttgcccagtctggagtgcagtagcacgatctcggctcactgcaaactccatctcccaggatcaagcgattctcctgcctcagcctcctgagtagctgggactacaggcacataccaccacactcagctagtttttgtatttttagtagagatggggtttcaccatgttggccaggctggtcttgaactcctgaccccaggtcatctgcctgcctcagcctcccaaaatgttgggattacaggcatgagccaccgcgtccagcctggacccttcatttttgaaaaaggtagtgcttcagagtagtggagaaagggcaatcctttcaataaacagaattgggtccttttttctttaagtttttcttctctttacctactgtctatttcttccatgttttagccattggatatccatattttttaaaaaaacttaaaaataaaacaacaaaacaccgtatacatttaaaaaaaatcaatccaggtggatcatggatcaaaatgtgaagggtagaacaattaatcctctaaagataatataggaaaatatctttataaccttttctatggtaaggaaagatttcttaaataggattcaaaaaacactaaacatagaagaaaagattggattacgtcaaaatttaaaacttctattcatcaaaattcaccattaacagagtataggcaaagcacagagtgaaagataccgtgatatgtattaccaactagtagttatatccagaatatataaaaaactattataagccaagaagaaaagagctgaaaaactaatagaaaaatgggcaagaaacttgaacgggcacttcatcagaaaggatatccaagtagtcaatacacatatgaaaaaacattcgacatcattagtcatcatggaaatgcaaattaaaaccacaacaagataccactggattcccaccagaatggctaaaaataagaagattgatgatatcaagtgttgtccaggatgcagcacaagaagaacactcatctcatgctgatgggagtgaaaattgatataaccactctggaaaagagtttgacacatgctacctgccagcaattcttctcctatgtatacatgcccagcagaaatgtatgtacactcacacaaaaaactctcaaaggatgttcttagcaccattattcataataaccaaagactggtaataacccaaatacccatcaacagcagaaaaaaaaaaaaaaaaaaaaaaagcttcatattacatggtatattcatactattcagcaattaaaattaatggacttcagccgggcatggtggcacatgcctgtaatcccagcaatttgggaggctgaggcaggaggattgcctgagctcaggaatttgagactagcctagacaacatggtgaaaccccatctctacaaatacaaaagttagccaagcacagtggtgcatgcctgtagtcccagctacttgggaaactgaggtgggaggatcacttgagaggctgcggtgagccaagatcatgccactgcactccagcctgggcaacagagtgagaccctgtctcaaaaattttaaaaaataaaattaatgaatgtcagctacattttaataaatggacgaattttacaaagttaatgttgagcaaaataatacacaccatatgatttcatttgtaataagttcaagaataggccattagctctcaaagtgttgtcccgggccagcagcatcagcatcacctggtaacttgttagaaatgaacattcttaggccaggtatggtggctcacatctgtaatcccagcactttgggaggctgaggcgggcggatcatgaggtcaggagtctgagaccagcctggccaacagtgaaactccgtctctactaaaaatacaaaaaattagccagccatggtggcgggcgcctataatcctagctacttgggaggctaaggcaggagaatcacttgaacttgggaggcagaggttgcagtgagccgagatcacaccactgcacaccagcccaggtgacagtgtgagactccatctcaaaaaaaaaaaaacaaaaaaaagaaatgaacattcttgggttctaccctagacctattgaaccagaaactttaagagtgtgtcccagaaatatgttttaacaaatcttccaggtgattctgttatacacttaaatttgaaaatcactggaaacaacaaaattaatttatggtgttagaagttgggatagtgatggtttggggtttaggaaaatggggaagtggagctcgggggcatgagagggttgtagggtcccagtgctgttctgttccttggcctggttgggaagtatttccagcctgtgatgatagttcaccgacctacaagtatacttgggatttgtgcacttcgttgtttacgtcttatgtttcattttaaaaaactaaaacgcttactagaaagtgctagataataaaactgaggaaatcttccaaaaacaaagcaaaaacaaaaaacagagatggaaaaaatgagtgaacaaagagatgcagaacatataatttctcaataatagatgttccagaaagagaaacagagaaaaagaagggaaggaaacatccaagggataacttgagaaaaattcttagaactaaagctcatgaatttccaaataaattgaaagggcctgtttctccatgttggtcaggctcgtctcgaactcctgacctcaggtgattcacctgcctcggcctcccaaagtgcttggattataggcgtgagccactgcacctggcccaggattgctattttttgtagcaaattttatagaactgactctttatgagcattccaactttcataacaacacagctaaaagcaaaacatgatactttgattgtgtgatcagatgggtcgattaaggtatctccacctccccagaaatgatgccaaagataagcatttattaagaatgacgggatgctcacaatatcatgttaaatggaaaaagcagactacaaaatgatgtgcatattaattctgctttaaaaattagatgtagaagtgtgtgtgtacatagaagaaagtctgaaggatacacaccaaaatgtttggagttactctttcttcttgatgggtggagagggggtattttcttccatttgtttatgtttgtagcccatatttctgccatctcagtatcctcaaatcttccagattaacgggatcatgctttcttttaacattgaaataaaaatggctgaaatattcgtcctatgtcttgtgcaaagtccatggccctcccccaacaccgctgcaaatttcctggtgctagtagctgtcatgttcactccagtttcctcttcctgctgctctcgatttccctggcatcctgctttctgcagctgttcccttctgtctgcccctagttaacccaaatatggaacactgccccttttctttgacttcccccaaggagtatcttacatgaggcactgctgaggggctacagccctacatggtactatagacaacttaaaatctacatgaacatctctgttctgacgtgtcctggctgaccctgcttctgggagattttcactggacgctcaccaggggagagggatggcctcacttctgccccctccaggctccactctgtgccttcaggatactcacctgccaccaagaggacacaacaaaatcctcaggttctttgttttcatatgcagagtatgaggccctccctcacaaaatccacttcttccagcaataagatcttgtcttttatgttggaaatttcatcaagaaaccttttgagagtcatctcctccaacttgaaaaagcagcaggagtcggttctggttgtcttcccactccgtgcataatgattgcgcattttctatcatgactgtgcattgtttttgtaattcaactattttcagcaagagaagtatcaaaagaaatcaggagtggttgttgaagcagcatccacctgtgagcaggtgtaaacatcaagtcccaagggtccagcaactacccaaaacctcctgctttgtgccaggctgagggaatgttcactaaggcagtgtggcaggtggaggccagggcaggcccagagttccctggggctgctgagcccagtgtgggcaggttggcaacaggactccaaagagacatgtagccagtacaaaccatgccccagctaagcgtgatgccttcccctttcttccatattgatatcacctgctccaggcctggcacaggtgcagcaccttccccagaagccttccctgacggcctccttcttcaccagctctagtatttatcagctgtgtggcaagttagttcacctcccccatgccttggtttccccacctataaaatgaggataagaatgtttgtaagaatcaaatgagtaatatttgtaaagtacttgtaacggtgcttggcttagagttagtactctatcatgttactcatcatcaccatcaccattatgatttccaccatgcccatggaatctgcccttgatcaagacatccacttggtcttgtgtgggaggctgcctaggggaagcagggcctgatattatttatttctgttcacatcccagccagcaaaggtgccagcactgaatttatgctcagtacctacctggctgattaaactttggaaagaagcagcaggccagttaagaaaccacatgcaagcataactgtcctgaaaccctacttagttctgtgacgtcccttcttagaaattctgagttttctttccctagacatggtcactatttctacctagattctttcataacccactcatcagagaaatgtaagaaccaaagtaagacctttatcaggaaaactataaaacactgatgaaagaaatagaagaggatacaaacaaatggaaagctatcctatgctcatggattggaagaattaatattgttaaaatgaccatactgcacaaagcaatctacagattcaatgcaatccctatcaaaatatcaatgtcatttttcaaagaaatagaaaaaaaaatccaaaaattcatatggatccaaaaaagagccagaatagccaaaatgatcctaagcaaaaagaatgaagttggcaagccaggcacggtgactcacgcctgtagccctggcactttggaaggccaaggtgggcggattgcttgagctcaggagttcgagaccagcctaggcaacatggcaaaaccccgtctctaccaaaaatacaacaattagccggacatggtggtgcatacctgtagtcccagctactcaggaggctgaagcaggaggatcagtcgaacctgggacgcagagcagaggttgcagtgagctgtgatcacaccaccacactccagcgtgggcagcaaagccagatcctgtctcaaaaaaaagaaaaagaataatgttggaagcatcatactacctgacttcaaaatatattacaaggctataagtaaccgaaacagcatagtattagtataaacatagacatggaccaatggaacagaatagagagcccagaaataaagctacatatttatagccaactgattctcaacaaaggcaccaagaacatacactggggaaaggacaccctctttaataagtggtgctggaaaaattggatatttatatgcaaaagaatgaaactgggcccctatttctcaccatatacaaaatccatcctgagttcaagatggattaaatacttaaaagacctgaagctataaattactagaacaaaacagggaaaacacttcagaacattgttctaggcaaagattttatggctaagacctcaaaagcatagagaactaaaacgaaaatagacaaataggactatattaaactaaaaagcttctacgaagcaaaggaaacaatcaacagagtgaaggggcagccagctgaacaggagaaagtatttgcaaactatttatctggatattagtcccagataatatccagaatatgcgaggaactcaactcaacggaaaaataaacacattaaaaatgggcaatggacacaaacacaattctcaagaaaagacaaacaaaaaaaagaaaaaaacgaaaacaaatcaagaaaagacaaacaaatggccaagtctgttaaaaaaaatactcaacatcatgtaacaaacctgcatgttctgcatatgtaccccagaacttaaagtataataaaaaaaaaaactcaacatcactagtcatcagggaaatgcaaataaaaccacagtgaggtatcctcttaacatccgttaaaatggttattattaaaaagacaaaatatacaaatgcaagtgagaatgtggagaaaagggaactcttacacactcttggtggggaatgtaaattagtacaaccactatggaaaacagtatgaagatttctcaaaaaactaaaaatagaactaccatgtgatccagcaaccccactactggttatctctacaaagcagaccctcaccagataccaaatttgctggtgccttgatcttggacttcctagcctccagaactgtgaaaataaatgtttgtagtttatggtattttgttatagcagcctaaggtgactaagacatctatttctaaacatttaaatcctcctttgtaggacaaagttttgccagcacaaggagtgtattaggtaatcagtctggaagtgaagacccaaccagagatacaaaagggctttgagcaacggcagaattattggaataagtgtgtgctcccaagccaactctcttgagaggaatattgcatttgctacaaaaccaacctagttgtttccagtcagtcctctgcagaaaagctacacaaccatgaagattgaggagcagcagctgagcagtgggtggcttaactttgtctaaaaacaaaaacaaaagtgaacacaaagtctgagttacctagtaagtagggatttgaatgaggtgaagtgttaagttccaaatgtgtcctatgtcaaagcagccttggaatcgcatatttatctttatcaccagggctcagagtttgtgttggaaatagaagaaaacacccagatacatgttttccacctaagtgctgtaactgagggaatatagtgtggctccagtggggtcatagctcagaggcacccaggtccttcccaggagagtcagtggcttcttgctgttctagttgccctggccttgagtacagccctctgatcacagccctggggattccctccatctggtcaccctgatccaaagctggaggaggttggtgaatggcagttctcaggtcacatctcctgatgcctggcaagaaacacatcaggtgaggccagaggacagagatgactggcccatgccaggtagtggccacgtggctctctgtaccagttagggtctaagcagggtagcagaagcacagtgagtgattcacaaaagggggtttgtctagccaggcatggtggtgggcgcctgtaatcccagctactctggtggctgaggcaggagaattgcttgaacccaggaggaggaggttgcagtgagctgagattgtgccactgcactccagcctgagtgacagagcaaggcgccgtctcaaaaaaaaaaaaattctgtagttttgtacaagatgagacttaaccttgggtacttcttgctgaagctttaatgctttgtaaataaaatcggatgtttattagaaaaggtggtttatcataaggattatgggagctggtgaagaattctaggggagactgttgccttttacatagtggtggccctggagtctctgctgatcagcagggctggaggttgggaagaaagctgcgtagaagcagggaaaagggaggacaaactggaacctgtaaggacaaaccagagcctgttcctgtttctgccttaccagaaatagtcacatggccctgcccaactataaaagcactgggaatattgtggggaaatatatgtatattcagtaagcagaaatgcctctcaatcaaatattagttatgtgataatgtaactgaggaggaaatggaatccatgcttgaatgattctctgaaaggtatcctttccaggttttttttttaatcatatgatatgttttattgcctgaagatttagagagaatgtttctttccagcactctggacttccccaagaacagggttgagaacaggaaattcccttcaacttccttctttaaggtcaagcacaccttatggcccatccctaagaaatgtctcctggaggtagggtgtccaactcaccctgatttgctcaggacttcccaggttttagcactgaatgtcctgcgtcctggagaatgcattagtctcagctggataccctactgaaagagtatgaaatagatctaaggactttggaataactgcaataatttgaatctattaattgctgacatttttataacagctttattgagatataattcacataccatcagctggggacggtggcttacgcctgtcatctcagcactttgggaggctgaggtgggcggatcacttgaggtcagaaattccagactagcctggccaacatggtgaaaccctgtctctactaaaaatatgaaaattagctgggcatggtggcgcatgcctgtaatcccagctactggggaggctgaggcatgagaatcgcttgaacttgggaggtggaggttgcagtgagctgagatcgtgccacttcactccagcctgggtgatagggtgagactctgtctcaaaataataataatgataataataattcacataccatagaattaaccaatttaaagtatacaattcaatggtttttattatatttacagagttgtgcaaaccatcaccatagctgtctttggaacatttttatcagcccaaaaagaaatcccatatttactgtagttactcttcatttgttccccagcccaacacaaccctattctctttctgcctctacagatttgcctcttctgaatattttgcataagtggaatcatacaatatatggtcttttcaagggtaatccacgttgcagaatgtattggtactttaattctttatctggccgaataacatctcattttgttaatccattcatcagttgatagacatttgtgttgttcctaccttttgactattatgaataatgctgctatgaactttcatgtacaagcatttgtgtaaacatgtgttttcatttcctgtgggctgattcctagaactgctgagttataaactaacttttatgttcaaccttttgaggaactgccagactattttccaaagtggctgcactcgtttacatttccactagcaatgtatgagaattcctgtttctccacattcttaccaacacttatatctgtttttctgcttatagccattctagtgggtataaagtggtatctcatcgtggctttgatttacatttccctggtggctaacaatgttaagcatcttttcacatgcttattggtcatttgtacattttctttgaagaaatgtctcttcagattctttgcccattcttaaattgcgttgtcctcttattactgcgttctttatgttttttggatactggtcccttgtcagatatatgagttacacatattttgtctcattctataggttgtattttcactttcttgaacagtgttccttgaaacataaagttttaaaatttatggaagtctagttttgtttgttgctcatgcttttttttgtgtgtgtagagccaactgatcttagacaaagcaaacaaaaacaaaaagcgggggacacccttttcaactaatggtgctgggataattggctagccacatatagaagtatgaaactggatcctcatctctcaccttatataaaaataaactcaagatggattaaggacttaaatctaagacatgaaactataaaaattctagaagataacattggaaaaacccttctagacattggctgaggcaaggatttcatgaccaagaacccaaaagcaaatacaataaaaacaaagataaatagctcagacttaaactaaagagcttttgcatggcaaaaggaacagtcaacagagtaaacaacccacagagtaggagaaaatcttcacaatctattcatctgacaaagcactaatatccacaaactacaatgaactcaaacaaatcaccaagaaaaaaataaacaatcccatcaaaaagtgggctaaggacatgaatagacaattcttaaaagaagatatacaaatagccaacaaatatatgaaaaaaacactcaacatcactaattatcagggaaatgcaaatccaaaccacaatgtgataccaccttacttctccaagaatggccataatcaaaaacagtagatgttggcgtgaatgcagtgatcaaggaacacttctacacagctgctgggaatgtaaactagtacaaccactatggaaaacagtgtggagattccttaaaaaacttactactaggtttctacccagaagaaaagaagtcattgtacgaaaaagatacttgcacatgcacgtttatggcagtacaattcacaatggcaaaattgtggaaccaagtcaaatgcccatcaatcaatgagtggataaagaaactgtggtatgtatacatgatggaacactactcagccatataaaggaatgaattaatggcatttgcagtgacctggatgagactgaagactattattctaagtgaagtaactcaggaatggaaaaccaaacatcatatgttctcactgatatgttgggattaagctatgaggatgcaaaggcgtcggaatgatacaatggactttggagacttgtggggaaggagggggcaccaaaatctcacaaatcaccactaaagaacttactcatgtaaccaaacaccacctgtacaccaataacctatggaaaaataaaacataaataaaaataaaataaacataaatttatagaagtccaattttgtttgttgctttttttttttttttttttttttcgtagagacagggtttcactatgttggcaaggctggtctcaaactcctggcctcaagtgatccacccacctcagcctcccaaaatgctgggattacaggtgtgagccactgggcctggcctaatttgttatttttttgtagagattggggtctcaccatatttaccaggctggtcttgaactcctgacctcaagcaatcctcctgctttggcctcccaaagtactgggattacaggtatgagccactgtgcccagcttgttgcttgtgctttgaatgtaatagctaagaaaccattgcctaatctaaggtcataaagatgtatgcctatatatagctttagctcttacatttagatcatcaatccattttgagttaatttttgtatgtaatgtgaagtaaggtccaaccttattcttttgcatgtggatatccagttgtcctggcatcatttgttgaaaagactattatttctctcattgaattgtcttggcacccttgccaaaagttatttgaccataaatgtgaggatttatttatgtgctcaattctattccattgatctatatgtctatccttatgccaatactgtaccatcttgattactgtagtaagctttgaaataggtaaatacaaatcttccaactttgttctttttcaagcttgctgtggctattctgggtcccttgaatttccatatgaattttaggatcagcttgtcaatttctgcaaataagtcagatgggattttgatagggattacactgaatctattgatcagtctgaagagcattaccagcttaccaatgatccatgaacaatgatgtctttctatttatttaggtcttctttcatttccttcaattatgttttgtaattttcagagcatacattccgcactttttttgttaaacattcctaagtattctattcattttgatgctatgataaatggagttttcttaattttcagtttattgctactgcagtaagttttatttttgtatattgatacaaaaatacaacttatttttgtgtattgatcatgtatcctgaaatcttctaagttgttgttgtttttttgtttgtttgtttgtttgagatgaggtctcactatgttgcccaggctggttgcaaactcttggattcatataatcttcccatctcagccccccaactagctaggattacaaggatgtgccactgcacccagctcttctgagcttttttattaattctaatagttttttagtagattccttaggattttctatatacgagatcatgtcatctgcaaatatagtttcacttcttcctttccaatctggatgactcttatttaattttcttgcctaattattactgacttatttttaagaatcatttatttgctaggtctttttgtctgtagcacacaccaataacttggtgcttactttatttataagaaaactgaggaacagaaaggcacactacctggatgtatgggtcctacaacattctaagactaaaacctagctgtctcagtgtcccagactaatgacctctttgaagttggacagcattattctaaataaagaactcccccaagagaatcaactacaattgtaaattcagtaaattgaaatttgttgcaaataaaaccaagcaccaattttaattcaaccttcagattgatttttgctacaaagttgtacaaatctacataatctcaattatgctagagactgagcttagtaaattacacaaccaagtgagcctcagtggtaggctgaggtcacacatttccagctctcaccagaggtacctccaaaccccaaaactgcataaagaggcacaagtccaagtccagaaagaatagcttttacaaagatttgcacacacttttggctaaaggtttatttatcggaaggcctgtccctaatgtgttctgtttttggttctcagttttaacatcagtgagagcaccaacattttggggaagtggagcttaagcattcaaagagctgtcaggcctgtgacagcctgtaggggtagggaagctaatacttgtccttaaggccagagcttaccaaggacaagaagatcaggaaccaagatggcaagtaatgtacagtttggtccagtgatgcccttggcccagctctggagcagcctagagctctggctgagaaactcaagcaattgaaaccagactctaggcaattaatcctgcagttctgaggttgctataactatcccacctgtttagctggagttaaaggtcagaccctataataaacctcctttcggaagttgagatcaccacgaccccagccaaagggccaagtcagaagtgttcaggtcctacccctccctggagccaatagcaggctttatgttcagggtcagagaaaggcaggaaggaacctcgagttccagggcttcttttaagtgtgccagccagccccagctccctcagaattagtatgagaaaaggaagttcaaaatagctcgagactgtaaacacaggtgactgtaagcctgtgagcatggacgtacacaccacctcccaaatcttagtttgactaacatcacaagtctgtgttgtgaactaaagtgtagaccaagtatccctaaggcctatacaacatccttaatacctcttcttccttaccccagaagcaatccatcaccagatcctcccagtctttcctctgaagcaatctagaatccattcccttccctccagctctaccaccactcctaagccaagctgtgctcatctcccctgtggctattcactaggatgctcacatctcttcctcaaaatgcaaatctgaacatatcacccatctccagaaaatccttccatgacttctcaggtctctaatggtaaagataaaactccccaggttgtctccatggcccagcacagttggtctccagccacagagcaggtccctgagttttcacagggtttatcatctgccttctggagcacactagccacctcttgcttatcctgcccagtcgctatgatgcagttgatttaatgcatctgtgtgctattctgtgggatgtccagattgtccctctctctctgcataatgactgaaggcaagagagttaatataactatgggggaaaactgcagatgaatatctttgtctgttccacatgaatgccaactgttctgatcctcttgttccattggaatagaaaagaacacgtgtgaagtttttaggtatccagtggtcatggtgtgccaggacatccccttcaaagtaaaacgcaagttgatgcccatttcatccttcctaccacaaagaaggatgcacagcacgtggcagggctctttgcattctggaggccacacattccacacctagaaattcttctctggtggtaccgaaagttgccagctttacacggagcctggaacagaaaagggctctacaggaggtccaggcagctaggcaaatagcttatcttttcgatcatatgatccagcagaccctatggcattggaagtgtcagtgataggtaagatgcaatacagacctctttgaaagccccagtgaaataatcacaaagcaggcccctgggtttctggagcatgacatctgcatataccttttgagaaacagttcctggcatgtgactaggctccaatttagacgcaatgcttgactatcaagtgacaatacatctagaactggccatgacggactggcttctgttaagtcagccaagtcctagttaggtagggcctgtagtacttcattgcaagatagaaacggtaaccaagcttggtttactggtgggtcaactcagcgtgtgggtggaagccaaaaatggacagtgcctgcttgacagccacagtcaggggttttcttgaaagacagaggcaagggaaaatctccccaatgagcagaactgcaagtgcggcagctgcttgtggaaggagaactctacacaggagacatgttcctgggcagcaaccaaggatctagctgcctagtcagaggctggaagaaaaagtctggaagattgaggacaaggaagcatgtgggtggacatttagaaataggcacaaaatgtgaagattttgtatcacacattaacacccaccagaaagcatccaccacaaaagacaactaacaactgagtagattaaatgactcagccacttcatcactggccatcctggaactggcacaacagtctcatgaatggaattggtcacagtggcagagatgaaggctactatgtatgcgcctaaaagcatggactcccacatgccaaagctgatctagctattgctgcctctgccagcaacagagatccatgctgagtcccagatataatactattcctcaaggagaccagccagccacctggtggcaagtcaattgcatgaggccccttccattctggaaaggccagcggtttatcctcacagggatagagacgtatcctgggaatcagcttgccttttctgcctacagaaccttagccggcaccagtatcctcagaagtttacagagtaactgatccacaggtatggaattccatccagcatagaatccaaccagggacccacttcacaatggaggtgagcaagtgagcctatgacaataggatctactggtcatatatatatactgcaccatccagaagctgccagcctgaaagagcaccagaatggcttactgaaggcacagctagggcactcgcctggaggcaataatctgcaaggactggatgccatccttcaggacccagcacatgcattaaatcagagagctataatcacatctaaattacagcttcctgctatgtcccctacaggaaaaatgcatgggtccaggaacctaggggcagaagcaagagtggctacacttaccatcacttccaaggacccactggggaatgttgtgcttcctgtccctgaactctaggttccgtagggttggaaacactaatccccaaagggggcatattcttgccagggacacaactacacccgttaagtcccactgaactacagaactctggctgccaccagggtactttggactccttgtatctaagaatgagtagacaagaaaagagtcaccatcatggcagagatgactgagcttgaatagcaggacgtggtcgcgctgtttttatacatcagtaggggctaaaataatgtgaagcccaaatgatccatttgggtatctcttggtactcccttgtccagttgtaactctaagtggacatttgcagcaaccctggtcaagaagagtatgatgaccaagggcttggacctctcaggaatgaaggttggggttataccactaagcaagccaagccccactgaagtgatagctgaaggtgatgggaacttaggatagcgcagaagggagaaggtaagtaccaaccatggccccaagactaacttcatcaatggtgattgtaatttgttccccaaagctccctcttctaggtttcccgtcgggaaaccatggaaagaaacatgggtgcattgtggaaaagaggatctgtgcagtataaggggcagactgtgcaggttgtggagctgcatcactcaagtctccttcaagaaaacctgacaaagtgcccagaggagtcataattaatggcagcccccagctgcttcccctgtgaatgcagaagccacacttcctctaggctctgcttctagacaacaactgagcacaacaggattactggtgtgcccagtcttgcccaaagtggactcctctcatgagcagctttttgccagggactccccatcaacttcactgagattcttctcagagctggtctatggtctaagacttccttcccagtccttcctccctctgtcctctcccaggggtcagcctggcccctggatctaaagcctctccctgcctactcttgctcccttgctctttagccctcacaggtgtttcctttgtcttggcatctgcttctcaaaaaaacccaagttgacagaaataatatatgatctctcaaagatagagtacctctactaaaacataggggctagccgggcaaggtggctcacgcctgtaatctcaacactttgggaggccaaggcgggtggatcacgaggtcaggagattgagactatcctggtaacatggtgaaaccctgtctctactaaaaatacaaaaaattagccgggagtagtggcacgcacctgtagtcccagctactcaagaggctgaggcaggagaattgtttgaacctgggaggtggaggttgcagcgagccacagataaatacataaaaataaaacataagggcttggccgggtgcagtggctaacgcctgtagtcccaacactttgggagactgaggtgggcagattgcttgagcccaagagttcaagaccagcctgggcaacatggcaaaaccccgtctctacaaaaaatacaaaaattagctgtgcatggtggtgtgcacctgtagtctcagctactcaggctgaggtgggaggattgcttgagcctgggaagttgaggctgcagtgagccaagattgtgccactgcactccagcctgggtgacagagtgagaccctgtctcaaagaaaagggtggggcagcggggtgggccaggcttgagggggaaggatgggaataacataccaaaaaaagtttaactgttttccatgatcataattggtagtagaagcattagtattgttattctgagatggctgtgtttataatgtgggataaagcaaatggttaattaggggatcttcttattctaccaatttctctgcccttcaaacctagggttctcattatggaaaaaagagatacagatgtaatatataagaagttaagccaggcatggtggctcatgcctgtaatcccaacactttgggaagccaggcaggaggactgcttgagcccaggagttcaagaccagcctgggcaatgtagtgagaccctgtctccacaaaaaatttaaaaattagttggttgtggtggtgcacacctgtagtcccagctactcaggaggctgaggcaggatcacttgagcctgggaagtcaaggctgtgtgagccatgatcgtgccactgtgcttcagcctggccaacagagtgagaccctatctccaaaaaaaaaaaaaaaaagtaaaagtatgttatagtttggtttgatccctccaaatctcatagtcagtttcgccacgctgaccaggctggtcttgaagtcctgacctcaagtgatccatccacctcgtcctcccaaagtgctgagaatacaggtgtgagccactgagcccagcctccttcgtctctctcacccctctcttgctatgtgattctgcacacccttcctcttccaccatgtgtggaagcagcttgagaccctcactagatgcaggtaccagcatcatgcttcctgtaaagcctgcagaacgatgagccaactaagcctcttttctttaagaattacccagcctcaggtattcctttgtagccgcattaaatggacaaaggcaccctataatcctgaattggaatcagaaagaacactgtaaaatcatggggtaccatagatgcatgtgtgtatacacactcatgtatacatacatatttatatatgcatttaacatatataattccaagaccttcactatctttaaaaatacatatttactatatatgtttctagatgtctatattaaatgtataaaaatgttatatttaaatataatcaaagctctgtctactgaataggcctagaaccaatgatctaccagtaacaatgagaatttctagtgtccaattatggtcttgcaataccatttcccacttaaggaaaccagggctttttggagaaatgactgattccaagtctaggacagaaaatgaataaagtgagcctagaacatcttgcaataccagaaaacaaagcagatatcaaagacaactagagttgtgtcagaacaactcaggaaccaacttaaagaggctcccaaaggccaaaggcaggacaataaagataataattgcaatgagatgaagcctatcaaatacatctaaactcatgagttcataatattgtttaaaaaatagtcaccttctgaggataacaaagaaccagttcatatcttaaaagttgggtaaataaaaggaaagaattaagcacttatctgcctttcccacacaaactctactgggaaatcaaacagtagatgagagacaatgtctccttataaaattattccatctaataaatgaagagaaaatgatagattagaatatccccatgctgcaatccccagtgaattacttgctggatgtaggcattgagcatcagtggctgctaacataacaaaagtgaaaaacagatgttacgtgcttcttgctaaatgagcacaccactacctagagtcttatcaaagggatcaacctgaggcaaattgtctagatctagctgctgatctgcaggaaatgctgaggataaaggagtatattgaactgcaccacgggcatgaaatgagcaaaaacccaggctgtgaaaatctacagatcaaatggcttaaaatcttcaacaatttgtaagaaaaggaaagggatggaggggaccctttagattaaaagagacttaaaagatgtatcaagtttttttaaaaggacagtaagactatagcatgtagggatgcacatctgggtgacaaaacaataaagaaactcaacgaaattattacttataaaagttaagatggaagaagggaggtgctgggactgtgatggggaagggggaacatggaggaccctggggggctggcaaagttctattcttgacctgagtggtgattataagggtgcttgctttatagtaattccctgagttcctttgcttgcttgtttatttaccagtccctgaaatcacagcctgggaagccctgaagtagagcaggtgcagaagctgaggcaggcagggctgcttgctgagtgaaccaaacacacctgatttacccaggaccactggagaggcctggctgggccctacacggaagaacgcagttgactcaaatgtccttgaaatcttgagctactaaacaggtctgttctcttatatcacacatcattccaaaacagatttgcagaagattacaaaacaaaacacagtagaaagtgagtaggatcagctgttacaaagagcaaggaaatagttggtcccagcacctgccttaaggtaagctcaggcctaggcccacaatataaacacatacagctgagttccatgctgcccttcttgcccagccaagaatcccacttcctgctccagaggtactgcctaccttccttcccctttcctcggccttctccgagagaactaaagctctgtccgtgggctccaggcagacggctgcagtgtggcctctcaccccctctgcaggcaggacgctgcgctgcagctctctgggccctctcctcatctcttcagaagcatttaccacctgccaggcccaggggatggagacaggcaagagatcccccttttccctctgggagctcacggtgcaagggctgagcctgacacgaaagcaggcaatgacaatccagagaggagatgccagcatctaagaaaatgaaggagcacaaggatggaatgattaactgcctagggagattggggacacttcacagcaggtgactgctaaagtaaaccctgtacaacaaacacaaagtgggtgaaggggaggcattccaggcaaagggaaaatgcatgcaaaccaggaaagcataaaagagggcactgattggtctgaggtgcctgacttgatcacgttacacttcttctggagcttcctgccaaagcagcctgaagaataaaaatgaacgaagctggacctctcataaaggtctcccacctgccatccccaggaaagcaaacctttctttcaagagcttcccccgacccccagcttcccacacctggtctcccttaccctctcaagaaagggcccatcctgtctcagtcaagtgacaacctctgcacccctggccgggtcttttccctcctgtgtctcagtctcctcctctgtggagtggggaaagaaccctgtctgcatccatgtgaatcagccacataacagctaggaaggctcctagcactgcgggcagaaggacccaggagaccccaggccctcaggggcatcctgggcaggccacaaccccgagcctgctggtaaagagaggtgatgccacaagaccatcctcacagatggacccaactgcacccgcagccacccactgctcataaacctccataaaaatcagtgatccatgcagtttttgtttcaggtgttttattaagtgggccatactgtagctggtttctaagttgcaaaacataaatttaataataataacatagccagttagattgtgacaagcttttcctttccttaaaaaaagaaaatacttaaaaacacacaatggcgggttaaataaataaaacattttaaaaaagaaaaaagaaaagaaaaacctgttaaaacatgcttatgtttacttctgtgaaactgtgccaacaggaaatgtggtatttggcacgatgacacatcccggcatgtctccttcccaaacaatactgacaaaaaagaaaatacgtgggactgactcatcggtgcttgcttagaggcactactaaaaatccctttgattggagcatggggcttcccgcgcagcacacctgtgtgtggcctatgaaagccaaatatccataataatgttaatatagaaaaacattagtttaaaaatgatgtggaagggcctcattaatgcgacggggcaaggaaacataactgtcccgcacgcagtgccacaggctcagtccagggaggcctcaggcttccagcatgtggccacggcgagggagggcaccagcttcaaaataagcggcaccagcctcgctccctctccctatcactctttcacatgaaagtgtgtaaaaagcaaatcagcaaataaactctaaaatagattatttattccaaaaatcctctagttttctttttacagtgagtgtacattttgtctcctactcctgcacaatcgcttaagtccctttgggaaaaaaggtcagagctgcagggtgagtctttctcagtcctgctgctggctggtgctgggaggtcagatgtcgatgcccttgacaagggacgtctccagcgtgatgttgaactcctgcaatgtctgcagcacacgaatcaaggaattgacaagtgtatggtctttgatcagtgccacatcctcatacatgtgtgcagtgatggggcagtcagccagcagggcaatccagtggtgtaggaggtgatctctggcagagcgggagcagtccaggcaggtcagaggggcaaaggaaaaggaagagagagcgttagtgcaaggccaagggggaaaccatgaactaagtctgaagctggagaagctgacagccccccacacccccctttcccaaacagggactggcaaagaggtctttcagctccaggacaccaaacaaacctgacccaaatcagccctgtcatgagcctccaagcctcctcctcccctgcctccctcgccctgcctagtcagccccaccactggtgtctcccagagcttctctcctcccacagctaccaccaccaggaataataataagcactaacctcacataacactcagcatgtgctggcactgacataagagatttaatcttcatgataaccctgtgatatgaggtaggtactattattatccccactttatagatgaagaaagtagggtagatggaagttaagtagcttgtccaagatcacatggctagtaaatggataacttgagatctgaacctagtgaatgcggttctggagtctgtttttaaccactatgccaattctctccctttatgcagcctgaataaactgccttaagtttatttgagcttcatgctctctcacctgacctacaggaatagcccctaataatcatgtccactctaatgcataccacccataatatcagattaatattacttcagtcccctgatgaaacaactttgtactaatatgaaaagaatctttctctgtcccagctcaggggccctaccctcctttcaactgtgtttcctattactgcccttgccacgttctgttatttccttccattaaaggctcacttaaataccaactcctccctgaagtcttctctgatctttctcctctaccttttcagcatattgtatgaatgtacacttcatttttggaccctcaaaaccttcttccatgctctgtatttaattaggacaagtaagcttctaaatgttggccaggcatggtggctcacgcctgtaatttcagcactttgggaggccaaggaaggcagatcacctgaggtcaggagttcaagaccagcctgaccaacatggagaaaccccgtctctactaacaatacaaaactagccaggcgtgatggcgcatgcctgtaatcccagctactcgggaggctgaggcaggagactcacttgaacccaggaggcggaggttgtggtgagccgagatcacaccattgcactccagcctgggcaacaagagcgaaactccatctcaaaataaataaataaataaataaataaatggtaaggggccacgttttattcagctgtcttcctaccaacttccataaggccatttaaatgtctaatgaaggaataactagatatactctgcttcaaacttccccagtggtgtgattttgatctttcctttcaaaatggggcccctctgccccgagttacatacacgttgtcatccctaccccgacagatcaccacacacataagtcacgtgttgcttaatgacagggatacagtctgagaaatgtgtcattagacagtttcgtcaccatgcgaactttatagggttctcatacaaacctagatggtagagcctactatatgtctagcctgttgctcctaagctacaaatcggtacagccctgtcaccagcccccaggcctgctcttctacacttctcctggagcttcctgccacagcagcctgaagaataaaaatgaaggaatactgtgctgaataccgtaggcaactaaaacacaatggtaagtatttgggtacctaaacatctcaacctataaaaggtacagtaaaaacagagtataatcttataggaccatcatcccataaacagtccgtcactgacaaatgttgttacgcagcacattttatgcagtgtgtgaccatacacgatacacagaggaaattcagggcttctaggaaaccttctaaggcctcatctccctaagggcacctgatgagccattcctcacccctgcactgcaccaggcctccaacaccaccaccaaggctaaccgctgtgcactctgggccctgggtctgcagtacctggctcccaagcacaccagcatctgaaacttgccatccttgccgatgttccggggagtattgttgattgcagtgacaaatcggcagaagttccgggctcttgtatgccagttttcctcagggactacttcattcttctctaatgtctcataataggtttgtgctttttctgtgaagagtagaaaagcttgccagtgaaaaggctctcaacaccaaccctgacggtcctacaggccacttgccatgggcctctccaagtccacacaggtaacttaatgagaatagcacaagtgttctgatgtcactggtcatgtttcaaaatgatccttagcttccctatccttattttttaaatttatgtatgtggcccttgatataaagatgttcttttccctagtctgaagacacaaaaaattctgaggatggtttcttgcatgaaaattctccatatgggtgcaacacagggcttggggctccaatacgctcaactggactttgggatctataaggggaaagtgtgaggactcaggactaagtccatactaaataacagatgtctagaagaatcttttctgtgcaattctcaagaggtaagcatttaccaaggacggggaggagagctcttgtcactcccttcaagaaaaaccagagcaaacaaatgagatctgagagtcacctaatttgggttctgcctctcagagtggtcagcacccatgctatgctggtgagtccccttatatctctacatgcttctcccaccctcatactccagctcaactcacccaggaaatcccaaatgaagacatttttgaagagccggggcgatttaaatccatgctggaaagcctgttccaaggccgagacaaggccacactctccacagagcaacagcgtcagactgcctcgctacgtaaggaaacaggggagggtgccaggcttgtctcagccgagctgccctcccaccattgcatccctaaacccacagcccagagttgggagggctgcaaaagacaggctaggactttgtctgtttccctaacacctggcacagtgcctggctcagagcagctcccagtgaagagctgctgaataaatggatgaaagaagagatgatggatctgggtcacacacaaggagattctccactggaggacaaagccagtgtggccactattcaaggagacccaggcaaatctagaagaggacaggaataggcactgttcactaggggcccagggactctattgggtcatcagtatggagggaaaacagggtaacctgaggcaaaggcccccagaggaaggagtctgctccatctccaactagctgaggcacacactctacaagactctagggtgtccacagcacatgggcctggaagagcataacaagataatcggaaaaacaaaattattctctcttattcaatgtaaggccctggattggagggcaggaaggctcacctctttctcaggcttatggaagtgcttcacaatgccattgactgcctccccgatggactcctggatctgcccagtgttcagctctaataaaaatcaagcagacatccctaaccaatctctgaggctaacagtgcttagctgcctgagcaggagactgaggacacggggagggcccataggagaggcagggcagctggaccctaggaagcagaggcgcttgcccacccagctttgctgatttagctcttccgcaaatcttgggggaaaaacacaaaagctaacaccttagagttctatctctaagaaatgctggtaaagtttagtttccattttaccttggaattgtgggtaaccaaaagagagccaagccttggctgtgaagcccaggaatcaggcagggggagtccagaaagtaggcccctctcctttaatggatcatgcatgaatatatacagcgcccaggtttggcagcatgagttctctcctctcctgccagccctctaaggagagtgccaaatgctctcagtgattcataagagaagggtgccatatgtgtgaggtggctttgttagcagaagtgtttcctgaggcagctgcacaggctgggacccaggttcccattatcagggctcacagagatccacccattccctagactgtatggcatgagggcccaacccctcctcccacttactgggcttgttgttgggtgagatggtaacaagcctccggatgacactgggggactgctgcagcggcggggtccggcatggcctctcatccacctcaggctgggatgtgagcagctccccaactaggatccgctccaggcttccatcatccatgcccttccctaaccaccggccacacgggaacctgaagatcagacaatggactgtcagagcagccagctcctccctgctgctcacaggaagagccatcaacaaagccaatccctggagataggctctgaaaccaggatagagactccttcaatgctctgctggttccaccatgtatcatcagagaatcaccctgagtggcataggtggcctgggatctgggcacagcaattccacacatcttcacctagaaaccctccttctggctgggcctgatggctcatgcctgtaatcccagcactttgggaggccgaggcggccggatcacctgcggtcaggagttcaagaccagcctggtcaatatggcgaaacctgtctctactaaaaacacaaaattagctgggcgtggtggtgcatgcctatcatcccagctactcggggagctgaggcaggagaatcgcctcagcccaggaggcacaggctgcagtgagccaagatcacgccactgcactccagcctaggtgacagagcaagactccgtctcaaaaaaaaaaaaaagaaagaaaaagaaacaacagaagaaaccctccttctacttactttcaagtgtatgaggcagagccaaacaggaagttgcctcaggttatcacaacctaaagggtctccttgggaactccacatacccaagcatcgaagagctcctgtagatacaccttgcccctctaccttacagcctgagggtatacttacttgtaggtatgtcctgtgatctcattcctgaccatcacatactccaccagccatttggcatacagcccagagttatcatggccaatctggacagtagtaagcttccccaagttctggcactattagagaatagagaagatgaggtaggtcaggaaaatcagagaaaagaacagtagttctcggaggcacagatctgactggctgcctgcaacctgacccctcagcatctgcaggcttagaggtcatggctctacataccgccagaactgcggtacagcactatctcatgggggtgcccaaggctgagaaagaaaacactctacctagaagaacagggtcagggagcaagagattctggaagtgggttctgaggtctctgggaacaggtgggctgagtagctgaaagaactcctggggacttctcaacacactatgcatggagagatgtgcatgtccagacaagtaagtgccttccaaacattgtttagacagggtggggtccccctcctcagggtcagtctttggatccagcctcagatcatctcaggaaggtcagctatgctgaagcattacactgtacatagcaagccctctgaaaaaccctgcagaaaactccccaaagcggctgttgcaaactcagatccccacagagctgtggccccaaataacacatacctcgaaggtcatctctagcacattcctgggaatctgcatgatctgtgtctcacccaattctcctgatatacagatccatgggttggcagtgaacatggagccccccagcttcttgcttggtacgatcagaatgtggtacgggatcactgtttaggggaagccacaaaagtattgaggagaattaggaatctttcccataccagatgggactctgacctgctccaggaaggctggcacaactgtggctcctgctatctcagctcaagcagagccctggaacaagagggccccaggacctagtccctggctaatgtagaatattagccagctaccccatggcccctcctcaatttcactcctctcaggcttaccacccaaacatcaaagatccaagcctatctgtaggctcagaactaaatgaacctgttcgttaaacaatatccccaactcctaacattgtactgaactgctttttagagcactcttcaatctatcatctcatgaaccctaataacaatcataatctttggagaggaagtattgcaatcctttttccaaggcacagagaaagaaagtttgcctcgggtcttctaaattccagtccagggctacttctattaagcccacagccctagtctctaaaagggaagatgcagcatcagacagaaacaagagtccatgctgctgagtaactggccaaagaactagccatgtggcaaactcagagactaccctccacccagtagagaatcctggcatcagggaaagaagaggctcaaagggaattagaccatattgaaccctcttccctcttctgtaaatagagagactgggactcacagcaggatagactctgctcacagacacataatgagttagccaaagctgagcccagaatgaaatctcccactggtatctggagttctttctgctacctcagaaaagagctctttttcccttcagcctggtttgaaacattctgtgatgccaagtgagcctctcaggcgaaaacaaaagggagattctttgtgggtatgcagggagggaggtaaactgcatcagctcaactgactccactccaccttcatcagcttaggctcccagagcagtgcctaggacaacaccgacaacacaatggcaaaaaagactgagctctccagttcagaacaagaatgagaaacttcagagaaaacacagcctccaaggagggcaagtgcacctctctccccacagaggcaaaagacaaatagaaagtacaagggataatcttctttctttaaaaaggggacaatgagtgagtctcaggcaggttcataaagactgccttgagaaggccagctgggagcacagggctactcacggatagttgtgaagacattggtgaagcaaaagtaatcgacggcattgaaagacaggaggtgatagaggaactgctccttctcgtcatcacagcgcaggaaggcatagcgcttatataactttctgttggagaggaggtaatacatcagtctccgaccaaaaggaagggaaagaaactagaattttcagttctggaaggagacagctaagggaagcataagatgtcaagcttcaagttccttaggttcaccctataaaggaacaaagctagctactctaactaagggacagagggacaacggtttaagctacagcaggaacaacaaaaatcaaatactgcctgtgtccaaggtatgttgatgttactataatatcaagtgtcagaagtcatgaaatctccttttctaaactgagggctggaatgaaattccatcaaggatgacacaggtcttctcaggcttctagctaggctgtcagctagtgtatggtgtgtgagtggcagtggatgaaggtctgtggtcaccattcatcaccaggcctagtttcgaaccctgagtagatctgagagccacaagtcagaacactgctctgaatgggggtataagcctaggacagattcagaggcgagaaagggcaggcttctgctcccgcctctgatccaggtcacaggcaaggaagagccatgcagatcatatccttccccttttttcaaactttctcccttcattttcactgcctattcatcagaggtcaactcctttgcctgacattccaggccctccgcagcttcaaagcaatgatatcttcccccaaatagaggagacacccagagccaaatgtacaggccttcaacacaaagaacaaaagaagacaactgtcctggttgtccaagctgcaatcaccatggccagacgggtacagaattcagaactgtgaggttctacctagccaggtttacaaggcactttcaacagataatttatcaacccaggcctgttatgtccaggtgctggagaggaaagcgcctatcctcaaatgcagtctaagtgaataaatcaggtaaaggccatggtataggactgctcacaatgaataatcaaacaaaaggctgtttctgggaatttaaagagccatacgcttcagtggtcctggaaggccttctagaacaagagggacctgaagggcagcagaaatttagacaactgttgtacagacaggtttggaaaccagtttggctggagttgagggttcagggaagtgatcagttagcaatgagactaagaagttaagctactgtaccaaaggtgtcaaatgaaaaaaaaaaaaggctattcaaatgaaggaaggtcctaaaattttaaactaaggagtttgcaatctgcccagtaagtaaggggtttctgcaatttgccctagaaaaagagacagccatgaccaacttcaggaaatttaaatttagtgcaggtgagaagtgaaagggaaatgaggattaaactaagtctgtgcagtaaaaatggtaaggagacaggtgggacagaggtgaagaacctgaaacctgtatgtgggagataaagcaaagcaaggagtcaaaactgactccaaattttcagtgtaggtacggagaagaagtgggggtaagcttttcagagagcacagtggtgacattaacaaaaaatctgagagtaaagtagttatggtgaagactctgtgaagcttgcttttgttctctctgagctaaagatagaatatcagaatggaaataaatgcaggagtggagtttaaaagacatgtcagggctagaacttcagatgtgggcatctcctgcttagaggtgagagaagtcatgagaattgggtgagatcaccaagtaagagagcaagcgagaaagcaacaaagaaactgtgtgcatgcaaagaattgaagatggtgaaagccaacactgtgcaaagagtaagcggagaaagagaacaagatggtataaggtcatggcagccacataaagtgagtttcaaggtaaagggggcactacatggtattagtcactgcagacaagttaaggagaaagagtttaggctccctatatgggagctaactcatttcttcctttggaatttagaattcagtgggtcccatgaatacacagcccccatgaatatacaaccctgcctccaccttatcccatctccaagctacaaacagtcttgggggctagctggaaatcccagagactgagggacattctatcaagatatactcttcatagactgtccacctcctgtctgtgcagctaagcataccttttatgtgggctggctgaatccctagtggatgccaagcaacatgctcagccttgggaaagggacaggtttatgccttcaatgaaagcaaacttcagtaagtagcaagcaaatagacaatgataatacaacacatcatggtgaaaaggggatgaacaaatattctaacaaatgttatgcatgcctggaagagggatgaaccacgtttctggggagtccaggaaaactctgggaaagaaaactgagccctgaagaagtttaccaggtagagtgtggacagggactagggtcatgcagaagtacagacaagaaaaggctacagacatcccgagaggggtgaggggtatgatgtgttgaacaagagagagaagaggacatctcagaagtttccttttaattctccaatcctttgctccccagaacaggaaagagacaaaggaaacgccttatgtccaagaggtatacatgtcacctgaatacaggaaggagaggaagacctcatccttcccactacctctccaagaaagctagttttgggcatgcaggttgagaagacagggagaaccaatatagcggaagtattcttctactgataaaaagggagaagaggaaatactgcaaaaccttcataagcaaagaggttagctgaatgcagcagcaatgtcacactgaatactcccccttcccacacaagtttccaatctcttccctccattcctgggagcctgcttctactcctggcggagcagccttacttggtgagctcatggtctgagaggagctgcttcaggtgtctggaaagtaactttttttccatggacagtcgcacccatgctctggcctttcccacatcagtcttgatttccccgatgttctggatgtgcctggaggaagaatgtaaaaaggaagtggagggtgggatgggagatgaactcactgccaataacttacctgtaaagccaaaggagacctgctgagacagacttatctcaccctgggagagcctatctctatattctccaaatactgggcttccatgtagctttaccagataggctcaccatattttgggaggaaaaaagacagtacagcccttaaaaagccaggctaactctgagcccttagggcctgagatactctcctatgctccctcacctccaaaaatgccaggaaacccaacggtttgtacagctttacaaatgtattatgaaacacaaggctttgtgattaggagggcttccatgttagctgagatgctgtagcagccactgagaccttgttactaaaagtggacacctaagcagcaactgaaaacaggattttagtggcttattacatgtgagcccatactgacctcatatcctgaatcagggagatcctcaggggaggcatgagtgagctggcatcagacttcctacgttctgaatcaagaagtattcctagaataaacaagttggtcatgtccaaagagatctgaatatccaaatagctgactgcccttcccttaccttaaatcacaaattgctatgggaaacaggtggttacactggtaacactttaattgattgtttcataaatatttatgaaattcctactagagaccgaattttacatttttatggatattatctcatttaattctctaacaatttataaggtagccaaaaaagatatcacaatttcccccacttaacagagaaggaaaatgacattcagagaggttagctgctttgcctatgtcaccaagcagcaaagtcagtactggaacacagacctcctggctcctagtctatcatgctctcaccatgatccacagaagcagtgcttccacttggagccactactcacatcctgttctggcttcacagcagcctacaaaagcccaagagaatatataaagaacaagaatgttctggttctgttccagaatgataggacctctaggagaagagaagatataatacctttatatcctcatgtctggcctaatgtttaaaacttagtattttcatcatcaagctgttgagaatttttggctacagtttattcctcagcaatgacttctatagcattcttaataagaacctgcttttacacatccagaaagcgggccaaaaaaattcctcataagcctacctggagaactcttgtctctagttttcagccaattatctccccaggttcagtgctagttaaggtcaactagttcaagggcaacgagttcatgcccatctttttaccccatttaactcacctttaccattaagataaaaacatccaagaaaggtaaacaaatgtctggcagagtggagaacaaaggatgatgtgaaggggagatgcacccaagaagtaaaagaagcagggagactagcctggaaaggacactgtaggatggtctaaacatcagagcaggagataagatgactggctcttgtttggcctcttccatgagctcactttgtgatcttaagtaaattcaattcctctccagactcgtttcctcctcttgtaaaataaagggcctggactagatgacctctggagttgccacaaactctgacatttttattaggttagaaacagaaaggaagtataagggatcattcacaccaggacttgactttgaggaggtccaaggaaggacactgaccaacagctctcttgactaacgggatagataatcataatgcccatgtcagagaaataaaacaaaagactctgaaaacagcctgctccaaacccaggacaccagtaccacagtaaaacccatattcattctgagactggcctcttgcccaaataaattttctatcttgccgataaaaagggtatagaaatacataatgaaagcaaatgccatggttttggtatgctctgtggttcagagagtctggtggctccatatttaaaagagaaaacattccagagcaaaagcttcttcgacctggaatagtttgcttcaaagtgatcacgccagtgggtgatggaaaagtggagagagggcagactctccattgcagagactatcttacctgaggtactgaggcttcctgatgtgagttttctctgccggttgtcctgataatgtaacaggtgggaccataaggctgatttcccctggaaccaatgcaagggagaaacacctatcagtttagatttcaggggtcaaggctttcaacatacagatagaagcttttgctaaaaaaatatatgtactgtttcttgtttcaatgtacatccaggacacagtgtatgcaaatatatcaatttactaaaatccagaagaaatataaacaatggaaggtaacagaaaaaggaaagggtcccctactgggaatagaaaggagatgggaaagagagcctggtaagggaccagtggataagaaagaaaaaagcagctgggcacggtggctcacacctgtaatcccaacacttcaggaagccgaggcgggcagatcacttgaggtcaggagttcgattccagcctggccaacatggtgaaaccctgtctctactaaaaatacacaaattagcaggatgtggtggtgcatggctataatcccagctactcaggaggcaggagaatcacttgaacccgggaggcagaggttgcagtgagcctagatcgcaccattgcactccagcctgggcgacagggtgagacgccgtctcaaaaaaaaaaaaacaaaaaagaaagaaagaaaaaagcaggccaggcacagtgtctcacacctgtaatcccaaccccaacactgggaggccaaggcgggcggatcacttgaggtcagaagttcgggaccagcctagccaacacagcaaaacccttactaaaaatacaaaaattagccgggagtggtggcacacgcctgctgtcccagctactcgggaggctgaggcaagaggatcactcgaaccgaacctgggaggtggagggagttgaacctggggggcagaggttgcagtgagccaggatcatgccgctgcactccagcctgggtgacagaatgaggctccctctcaaaaaaaaaaaaaaaaaaaaaaaaaagaagcaaatgacctatcatcctctaaatggtctgctggttttatgtcagcttgatggcttttgcacagaggagtggatatccagcctataagcttccatcttagctcctgaatttcctaaaatatttaaagttattcctttaaatattgttctagtcctgattttgctacttggtgaactaggcaaagcagtttggtgaacttctctgaatgtcagtttccttctctgttaagtgggggaaactgtggtatctttggctaccttataagttgttagtgcaggccagggagagtaagtcatcactataacaaggatttactattgaaggtatagttgaagaaatgtgcagaaaggtaggctggtacttaactgcatggctgaaataaactacagtcaatataatagaaccttggcgtttggaaaggtaagaactgcactttaaaccatttgagatatgtagcaatttgtcattttgccaaggcacaaacctgaatagtatttgcaagcctgatgtgagggagtaattcacctgggtaatgagtgagcccagctggtcacccagcaactgctttgtctctttctaatcatcgttcagtacatcataacccttgttaagtgataactttatttcagattcatggtaaatgttcccatgcagataataaaataatataaaggtggtatgtttgttttagtaagattacaataattttataaatgactttggttctataataatgatagaagctaccaggtcttgaggcttactatgaactaagcactatgtcagatgttcaaaatacaatattttaattaatgctcccaacagtctaataaggtagatatctctatccctattttctgtagagaagaagaaattgaggatcggaaaggttaagttaacttgtaagaggtcacaccgttagtaagcagagtgttgggattcaagcttaagtctatctaatgtcaaaaccattgctcttaataactatgctacacgagatgcttctgaaaagatcatttaactttttaagttatactttctgaggaaaattttgtgctatggaattaatgtgaagatttaaggtcttaagatataccccatgagaatactgagggtctattttgtttctattcacaaacttgatctactctggggaaaaaaaaaaacaaacatctgaatggtaggaaaccctcgctatagatcagcaagctgtcaaaataagcttgctgtatgtttgtacttcctacaaaattcataaacttaaaacccaacaacttcaaagacaatttttaaaatatataaaaactaaaattagaaaataccaggttttattcatccaaataacaaatatttgaaaaaaaaaatgtctaacaacattaatgagacttacaaatcctatactaactgcttctaagaaggtctattgtttcctgttgggagccaaaaagaaaaaaaaattttaatttaaaaaacttaaaaaaaaaaagaaggttgactgggcgcagtggctcacatctgtaaccccagcactttgggaggccgaggtgggtggaccacctgaagtcaggagttcgagaccaacctggccaacaggaggaaaccccatctctactaaaatacaaaaattaggcgcgcatggtgacaggcacctgtaatcccagctactcaggaggctgaggcaggagaactgcttgaacccaggaggcagagattgcagtgagtcaagatggcactactgcactccagcctgggcaacagggtgagactccatttaaaaaaaaaaaaaggtctattaatgtatctaacagataatataagagcttaaaatatttatggtctttgacttagtaattcaacttctagaaatccattcatccttccatctaccacaaccattagaaagtaggctccccagcatctaggcagactaggaaagcagcctaagataaattaatagaactgtctgaatgtggcacacattaagtacagctggtgaccagagagcctgacatgcaataacactaaagagccaaggacaagggcaaaatcaggccactataccagaagaaggaagcccctggctcacaatgtttacagaggtgaggagaaagagcaagggcaggagtggaagagcagcagctgggctgctctttggtctttctagttcaagagacatggcctactctttttcctcttttgcaaagggtctgattgggattgcaaggttcaatacagcctgactatccatttatggacatggacacacaataaactgcatcagattctacaagaatgtcataagcaagaaagataagtaacaactccttttcatgtgtcaaccctaaatggcagcagttacaaaaccagtatgaaaaaccaaacctctatctgatagaaaaacatactataggtggaagcccatctccttggaagatgtcactgaaagccaaagagagtggtgaggataacagaggttcttatgaagacttgctgcaggcagccttacatccaagcagtcaaggctagtaacaaaatttaagaggccagcagcaaaaatgctgtttgggttctctctactttctgagcagataataatgggcggttgcttaggaaggtacccccacaagggcataataaaatcaccctctgagagcaaatttagtcacaatctgggtgtatgataaaggacagcaggtaaccagggtgtgaccgctggattggaagataactgaagaatgtctcagcaggataaagccagcaaaatggaggcctagggagaacatggtgttaggaacccaacatagatcatcagggtcaatctccagctgaacacgtatccctaagagcattaacgccatgccagcaagaacagatcctcactctcctctggtgacactgtcactgcttcacttccagagctccaaaagccaggactcagaacaaaatggaacctcaactaaaaagcccccattattttgcactggtttctcaccaaacaagcagcctaactctccaaaataagagggggctcaaatgaactctaaaagaaattccagtctggccaacatggtgaaaccccacttctgctaaaaatacaaaaaaattagccggacgtggtggcctgagcctgtaatcccagctactcgtgaggctgaggcaggggaactgcttgaaccagggaggtggaggttgcagtgagccaagatcgcgccattgcactccagcctgggcaacagagcgagactccgtctcaaaaaaaaaaaaaaaagatacaaaaattagccaggcattgtggtgcggagctgtagtcccagctacttggcaggctgaggtgggagaatcacttgaactcaggatgtggaggttgcagtgagctgagatcataccactgcactccaggctgtgtgacagagcgagactctcgaaggaaagagagaaggggaggggagggaaaggggaaggagggaaggagggacagagggatggaaggatggatggaaggaaggaaggaaggaaggaaggaaggaaggaaggaagatattcttactgtgagaattcctgcagaataataaattcctcctatggtgagaattactgcagaatacagtagaacacagacttagaacatataatgatacgatactatttttcaaaatacaggaagaagcttcactaactccctagaaatttttgcagtaaatatttaaaagttttcagcatatatgttttacctcaaagctaaaagagctcaactatagtgccaggcttgctaaatgttatggaaaatgataaaaggattatatgtattctactcacttattatagagaaaaagaaacaaacccttccatacagaacccagcataataatagctgtcatatgttggatacttatcacacgccaggtatttcctttcattgcctctaatgatcacagctgaaagatatttatttaattcttttaacttttattttaggttcaggggcacacatgcaagtttgttatataggtaaactgcgtatcacaggggtctggtgtacagattacttcattattcatgtaataagcctcgtaccccacaggtagtttttcagtcctctccctcctcccactctccactctcaagcaggccttggtgcctgttgttcccttctttgtgtccatgggtattcaatgtttagctcccacttataagtgagaacaagcagtatttggttttctgttcctatatgagttcacttaggactatggtctccagctgcatccatgttgctacaaaggccatgatctagttcttttttatggctgtgtagtgttgtatggtgtgtatgtatcaccttttctttatctggtctaccgttgatggccatttaggttgatcataactttgccattgtgaatagtgctgcaatgaacatacacgtgcatatgtctttatggtagaacaattaatattctgaaagacaggtttttattaactatctatctttcatggatttggatttcagaaagtgcaagttgcttatttaaagtcatccagtggagccaggattcaaacccaagtctttctgactcacagttcatagtgttgctactacaccagtctcaaaattttaggaatgcaatacacaatttttaacatttaaaaaactataaatgcagtgttgtttacaatactgaaaaatcagaattaacctaaatgactaataataagagattgattaaagtatggcacatctatacaacagatgtagtcattaaaactgagattttacaataaccacaaacatccaaagagccagaaaccaggctctgagcttagtgctttacattaattatcgaatccacacaaggacccaatggatgtgggtacttttaaaattccatcaggcagggaacagtggcttttgcctgtgatcccagcagtttggggggctgaggcaggaggatcacttgagcccaggagtttgagaccagccaggacaacatagggagacctcatctctacaaaaaaaaaaaatagctgggcatggtgccacacacctgtagtctcagtctccaagagtctccaagctgaggtgggagactcagttgagcacaggaggtcaaggctgcagtgagcagagatcatgctagtgcactccagcctgggcaacaaagcaagatgctgtctcaaaaattaaattaaattaaattaatataaaataaaataaaattccatcatacatataaggaaacaggcttagagaagctaggtaacttgcttagtttcataaagttattaagtggaaatcatacttcaaacccagatctgtctgttttacagtcaagctcttaaacacttactatactatcatctaaaaattagttaaggacatagaaaagatatgagataaaaacaaagcaagttgcaaagcattacatacagtattaactcatttggattttttaaaaaaccacttcattgagatataattcatattaccataaaattcacacttttaaagtatgcaattttctgaacaaaaaaatctggtttttagtatagagttgtgcaatcatcaccactatctaattctagaacattttcatcacccccaaaagacactccatatgcattagtagtcacttcccattgctcccttcctctagcctctggcaacccttaatctactttctgtctgtggatttgcctattttagacattttgtataaatgagatcacacaatctgtggccttttgtgtctggcttctttcacttagtatgttttcagagttcatccatgttgtaccacatgtaggtactttattccctttattgctcaataatattccaatgtattataccaaatttaggtcacccactcatcagctgataaatatctgggtcataatagccacataagatgacactattatgactaatgctgctatgaacttttttttcttttttttttttttttgagacagagtttcactcttgttgcctaggctggagtgcaatggtgcaatcttggctcactgcaacctctgcctcctgggttcaagcgatcctcctgcctcagcctcccaagcagctgggattacaggcatgcaccaccacctggctaattttgtatttttggtagagacggggtttcaccatgttgatcaagctggtctcaaactcctgacctcaagtgatccacctgtcttggcctcccaaagtgctgggattacaggtgtgagccactgcgcctggcctgctatgaacatttgtatacaagtttttgtgtagacatatgttttcacttatcttgagtatgtatctagaagtgggcttgctaggtcatataagaactgtttaacattttgaggaactgccagactgttttccaaagtggctgcaccattttacattcccatcagcaatgtatgaaagttcccatttctccacatccttaacacttgttacttattttaactactccagtggatgtgaaatagtatctcattgtggttccactgggtttttaaatatacagctatatacgcatgggcatatgtacacagaagaatgctctgaagaacatgtgtggaagattgttgctatacccattagaatgacacaggaaggcaagagatcttggtctgttttgttcactgaggtatttctagtgcctacaacagtacctgacatagtaggcccttgagaaataccaatggatactaatatgtattttctaatttttccatgataaaacttcttttcaaaaaatttcaagttattttcaaatttaaaaatacataaaaataaaaggtatctatcttgactaccaattgaaaacagagtattttgaaataaggaaattctctgggtattaagtggaaaaatcaaacttactcaacttcctgaggccttctctcaaatgtttagttaaaccatctgcatacaaaagaaatgttaatgacagactttttttccactgtgaatatatgattagtgaagaacctttagtgtatgactggtacttcctgagctccaacttctctctttctggtctatctctagactagggccagctgccaaacaggacctatcaggttggccttcagctctacccccaggaagaaagatgcctctttttaaaagtctgacaaacacacagatttataaagcctatctttaaggaaaatagtttggatcacatttatttaattgtttatttcaaatctcactccagggcactgtgcaccattcttcaaagccagtcagctggacaaaaagagtgtgggaaagctagtaactgaaaacaggaagacaatttgctcagcaatgagaggcaagacatacattacctgtttcacttgtagtccatgactccagatcctttccaggagatcacaaaggctggcaatcagggtgttctcttccacccctgtgatgttcacctccccatgccctagctccacagcttctcggcccatcttttccaccagcatcctcttggtctacaaggaagcagtcaacaggattaaataaccacagtgagcaggattacatacaaccggagagggttctgacagcctgcacagtacatctgttgggctgggaaggacaggatgaattagccccaaggacacagaatatatttatacccatgtaggtcaggttacaagggagtgcatgctttaaaaatttagttaagaaaggccaggtgtggtagctcacacctgtaatcccagcactctgggaggcctagttgggcggatcacaaggtcaggagatcgagaccatcctggctaacacggtgaaaccccgtctctattaaaaatacaaaaaaattagccaggtgtggtggcgggcgcctgtggtcccagctactcaggaggctgaagcaggagaatggcgtcaaccaaggaagcgtagcttgcagcaagctgagatcgcgccactgcactccagcctgggcaacagagcgagactccgtctcaaaaaaaaaaaaatatgtagttaaggaaaggataagaacacagcaatctttatgactcctggccagtgatttcatcactctgtattcagtttttgcatttatgcaagaaacaaataaacccttcagtcatgcttatctctgacattgtctgattcccactgcttaaatgaccctaccaaacaaacctttgagcatacatacaacttagaaacatatctgaaataactgtcaaggggacaaaaattgaggaggtaatttattttacataaaaattttcaactgcttattgtaagatcataaccaagaaaacacatactgcataatgataatcacagtttttattaagtactatgtcaggcattgtacttagcatttcattatctcatttaagcctcctaacaatctgaggtaactattattattgttcccaatttaccaatacggaaattgagaaatacagtaatcaatatactaaatttaaacatagtataaaacaatatagtatatttatagtctaagtatagtttaattctcttaagtaacttgcccaaaatctatacgtaatatagcactctattaaattatatatatatatatattgtccaaaatgaaacagcaaagtagcaatagatctggcctttgaacccatatctgcctgaactttgagtccaagttcaaaagtaagatttaactatgctataaatttgtgatatataaaaatctaagaaaaggaaaacaaatcaccccaatcctacttttcagaagcaacaactcttaatattttggcatatttctttccactgttagtttttaaccttcttattgtgaaatatataatatatatatgctattacatcattatgaccagcgccaggccagttccttcttttttttttttttttttttttgagatggagtttcgctcttgttgcccaggctggagtgcaatggcacaatctcggctcactgcaacctccgcctccccggttcaagcaaattctccagcctcagcctcccgagtagctgggattacaggcatgcaccaccacgcctggctaattttgtatttttagtagagatggggtttctccatgttggtcaggctggtctcaaactcccgacctcaagtgatctgcccacctcagcctcccaaagtgctgggattacaggcatgagccactgcgcctggccagtattttatttataaatactgtctgtttatatctttgaagcaccctacgtgccctcttccattcaccttcccactctagaagtgaccacttacccaacgaaactacagaaaagcaagaaaattattacctatatttttaaccctaaaatatatggtttggtttgcctgtatgtatctttaagacagggtctctctctgttgcctagactggagtgcagtggctcgatcatggttcacgtagcctcagcttcccagattcaactgatcatcccacctcagcccccgcagtagctgggactataggcatgcatgtttcttttgtgattttttttttttttttttctttaagaaactgggtctcagcatgttgccctggctggaaccgaactcccaggctcaagcaatccccccacctcagcctcccaagtagctgggatcacaggtgtgtgctgatactcctggcttctgatttgctttttcactcgtttatatttgtgaaattcatccacactgatgtgtataactgttatccatttccattgttgtatagcattccaccacatgaatacaccacaatatacttattaattctcttactgattggctttctcaactgattggttgtttccagtttggggctattaaaagaatgctgctgtaaacttcttgtacatatctcttgggacatgctccaaaagtttctctagggaatatacctaggagaagaattactaaacaatactatgctgttttccaaaatcatcataccaatttatactttcaacagcctgttgcctcacgtgcaagccaatactttgtgatgttacattgattactatatttcttcaattctagatgtatattttcccacatattaacatgtctaaaattgatatgtatttcacagtcatcattggctaggaataggaagttgtcacagccaggtcatgcatctcatgacttaagaattttgacagtccaggccagttgtgcagtgcctcaaacctgtaatcccagcactttggaggccgaggcagacagatcacttgaggtcaggagttcaataccagcctggtcaatatgatgaaaccctgtctctactaaaaatacaaaaattagccaagcatggtggtgcactcctgtaatcccagccactcgggaggctaaggcacgagaattgcttgaacctgggaggcagaggttgcagtgagccgagattgtgtcactgtactccagcctgggtgacacagtgagactccatctcaaaaaaaaaaaaaaaaagaatgacagtccagcagcttagaaaaaaaaaatgcagaaatgcagcatcaccaatgttcttcatagtagaaaggcagaagagacaaaattgtatggaaaaaaaaatcacagatattaattactcagagtgaactgacagaagttttacacaaacacacacacacactggccacaatgcctggccagagttttttttaacctaaatttaaaatatcagtactgatatattaatcaggtttttttttttttttttttttttttttttttttgagagagggtctcattctgcagccttgacctccagggctcaaatgatcctcctacctcagcccaccaaagtagctgggactaaaggtgtgcaccaccacgcctaattttttttttttttttttttttttttttttttttttttagtagagatgaggttttgccatgttgcttagcctggcctcaaacttctgggctcgagtgattcacccacctcaatctcccaaagtgccaggattacaggcatgagccgctgtgccctgccaatctagctttaaacagtaataatttattctgcaagagacagcatattttattccctcctataaatgaacatcacttcaaatgggcaccacttagaactgaaagtgcaggagactatttttattccattgataaataaataggatgtagtagagactgagttagttgaaatgccctaaaattatggtatgctgccttggttgaaagattctttttattagaaaagacatttaaattcataattaaaacattaaaaattaagaatgaatgtctttgtagaacagagaaaaacacccaaacaatctaagcttaaacggaatgacacattttagcctggcacatagtaggtacccagtaaatttctgtttctagatataagatatcattgctatcagataaaaataaaggggaaaaaatatctgcaaatacataagactaatctgttgaagtaagttagagtgaagactagtctgatttaaagtactgtaaaatgtcaaaaatttaaaactatgcctgtaaccccagctactcaggaagctgaggtaggaggttcacttaagcccaggacttcaaggcgagcctgggcaatatagtgagatcctgtctttaaaaaagttttttattaaattaaaaactacatctctctgttgttcttttttttgttttgagatggagtcttgccctgtcgcccaggctggagtgcaatggcgcgatctcggctcactgcaacctccgcctcccgggttcaagagattctcctgcctcagtctcccaagtagctgggattacaggtgcatgccaccacgcccggctaaattttttgtgtctttagtagagacggggttttaccatgttggccaggctggtcttgaactcctgacctcgtgatctgcctgcctcagcctcccaaagtgctgggattacaggtgtgagccactgcgcccagcttgttgttcatttttatagagtatacattaagtttttatcaagcaaagcatgcatgctctcaattaatggtatattttatttaaaacaaatatacctaatttcaaattaacaggatcttaaaattagtactgtctcattatattaacgattttttttttaagacagagtctcgctctgttgcccaggcaggagtgcagtggtgccatcatagctcactgtagccttgacttcccaggttcaagcaatcctcccacttcaacctcccaagtatctgggactacaggtgtgtgccaccatgcccatcttaatacttttgtaaagacaggatctcactacgttctccaagttggtcttgaactcctgggctcaagcaatcctcctgccatggtctcccaaagtgttgggattacaggcatgagccatcacgcccagccaacagtatttttaaaatccagagggagtggtcagagccaatccttggtcttaccttggctgctaacagaaatagcacacatacagagatgtccacagcttaccttattgcggcattccttcagcaggccctctacaaacttccaattggtctgggcaatcactgatggagagaggttggacagtttgggctggcggatagtgctgcccatagtcctggcttcctggatgtacttctatatcaaacagaaaaataaagaccctttgtgtccatgtacataaaccaaaggtcagcagtactggtgggtgcctgaagagggcattattttctcacattttctttttttttctttttctttttttttttgagacgaatcttgctctgtcgccaggctggagtgcagtggtgtgatctcagctcgctgcaacctccacctcccaggctcaggcaatcctcctgcctcagcctcctgagtggctgggactacaggcatgtgccaccacgcccggctaattttttgtattttagtagagacggggtttcaccatgttagccaggatggtctttatctcctgacctggtgatccatctgcctcagtctcccaaagtactgagattacaggcatgagccaccgtgcccagcttattttctcgcactttcttagctgcctctttctaggctcagatagttaggaatagaaaatttttaatttaattcttgtattaaagagaaaaactgagatgatggtttctgttttagctgatgtaaagcactccccaaatggtataattacctttgatttaaagatacaagagtcaggcaaggcgcagtggctcacgcctgtaatcccagcactttgggaggctgaggtgggtggatcacaaggtcaggagttcaagaccagcctggccaacacagtgaaactccatctttactaaaaatataaaaattagccaagtgtggtggtgcatgcctgtaatcccagctactcaggaggctgaggcaggagaattgcttgaacccgggaggtggaggttgtggtgagctgagatcgcgccactgcactctagcctgggcgacagagcgagactccatcacaaaaaataaataaataaataaaaatttaaaaaattaaattaaaaaaagatacaagagtcaaaaaacacatgactacagcaaatctcaaatctctgagtaacactgagaaaataatttcccccaccaagctgagaagaatttaactcctctgcccgtatcaaagatatctaccctttctatcataaagtataaaattaaggcctggaaaataagattgcacactcaaaacaacaactgcaattattttgtataatgtgctggtgattcttcttcatatgttgtttaacacagaacccacatcaatgcagtaaaatgcaatctgatatcctctcagtaggttcataaccaacatttttaccctaaacttctcccttcccccatatttattccagtggcataactctgtccattctatcttatggccccttaatctatctctactaccaaccccccaaggttagggtccaattactattacttggactgctgttacctgtctcctaacttgttagctatctccataccaccctcctccaaaatattctgcccacagcctcctttacacatttacacaccaaactttagatcctgccatgtcctctacttgaaatgctcttcttatagctccagggagatgaaagattaaaaaaaaaaaaaaaaagaaaaagaaaaacagccaggagcagtgactctggcctgtaatcccagcactgaggcgagtggatcacttgagctcagaagtttgagaccatcctgggcaacatgaagaaaccctgtctctaccaaaaatacaaaaaagaccaaaacaacaacaacaaacaattagccaggaatggtggcgtgtgcctgtggtcccagctactagagaggctgaggtgggaggatcacctgagccttggaggcagaggttgcagtgagccaaggttacaccattgcactccaacctgggtgacagagtaagaccccatttcaaaataaaataaaagctcttctaacaatcccatcattctctaaggcttaaagagatgcttgctcctcttccaaatcatcttgtttgatgatgaccccaagtagaagtaacctctgctttctctaatcagtaatcaaacattggtttgctcctcatatggtcatttcaaaagcttattctcttgaagttatctttctatctgattttgctcccttatatcaactggtattccctgaggacaagactaacctcttttgtcacctttgtatttcaaagtgttaacctcagtgattttttttttttttgtctttagcaaagaattccttgatacctcagtgatatggtttggctgtgaccccatccaaatctcatcttgaattgtagctcctacaattcccacatgttgtgggagggacccagtgggaggtaactgagtcacgggggtagatctttcctgagctgttctcgtgatagtgcataagtctcatgagatctgatggttttataagggggaatttccctgcacaagctctctctttgcccactgccatccacgttaagacgtgacttgctccctccttgctgtccaccatgattgtgaagcctccccagccatgtggaactgtgagtccattaaatctttcttttgtaaattgcccagtcttgtgtatgtcctttatcagcaacatgaaaacagactaatacactcagtgattctgaccaagaaaatgtggtcaataaacactgctgaaaatagtaatgaggaggttaggtggaagacagacttttaaaataacacaaataaccaaaatttcttatgctactctcacaaaaaaaaaaatcccagtgcaactgtatcctataaatcagcagttgaagattcataaccatatcttacaattttaatttattcattaaaaacatagcaaagggagaatatgttatttattttccaattcactgagctgccagacacatgaaaacagtatgccttcttgggttctctctgtgcaagatgaaaattacagggtcttttctcaaagataagttactgaaataggcttctgaagttaacactcattttcacaacttctttgcaactaagtaaggcagggtctacaacctgaagtttataactagaaacttaagaagcaagttacagtagagctgagaaactcagcttacaagcaatgaagattcaggaggtaaattcaagaatcttgggtttccaggtacctgataataatgttcctctcctttagtcttttaaagaagaagaagaaaaaaaaagtcaagattatctgtttcaatttaaggtaagaaacagtaggaaaaaaactctaacaaaattaacttctttctgggctgggcgcagtagctcacacctataatcccagcactttgcggggatgaggcaggcggattacctgaggtcaggtgtttgagaccagcctggccaacgtggtgaaaccccgtctctactaaaaatacagaaattatctgcgcgttgaggtggtgcctgtaattccagctactcaagaggctgaggcaggggaattgcttgaacccaggagatggaggctgcagtgagccgagatcgctccactgcactccagcctgggcgataaaagcgagactctgtctcaaacaaaaaaagaattaaaaaaaattaacttttttcctatatacacacgcacacacacacacacacacacacacacacacacaaaactcacaccaatttttaaaggatttctcccaagtttcagactcttaacttctgaggttcctattgaactcctcagggagcatcatgcatgagaaattacaatcggttagtagctagctggaatttgcaaaacatcccacattctgatttgtgataacccaggcccagcattagatatcaggaactagacctattattaacccttctttatggggtgaggtcattgctgagacgtttgaatcagaccagagaacaggaaatgagaaagagaaggagtgcacagcatgatagcaaggtcatccttatcattcttaaggtatcttacctccctctggtcattatctaaacgcaggtgttctgtgtgctgcttctgccgatctttccgcctccactgggcaggggcattccttttcgtccacctaacacaatcagaaccaaagcaggcaattaataatgtctcacttaaaaagcaatgtcaactaacaggagaaaacatgaatgactacgagtcaatgctggacacaggaaatgacctagatgtcaccagagacagctcagagaccttgaggaagagcagattaaagatgagtgactggacatgagagagacacctcctcatggaacatgtctctcttgaaacatctacaaacacttgacatatagatctaaaactatattcacttaactctatctgggctttgatacagtcatcttcaaaagtaactaatgagtaattctgctaacttacctacttttcagttcaggttctgattatttcaactgccatttattaaatacaatgctagcttgctgttgaatgggatccaggcatgagatgattttaacccatctgcagctttttgcaggtcctagacatatggagctatcccaatctgcatagtggaggcagaactgaaagatattctgtcacatactttcttgttcaaataagcaaaccacctagatagtctgggtcttctccatatctgctttagaaaagtacaaggtcttctaggggtaacagccctagcccagatactagatgaccctattacagctagggagttggattagtgaatccctggggttgactcacttgttgctggctggcccagtggaaagtacatcagactgcagcttagggaagaagcccggctcatatttcccttgtccaatcttcatgtcaagtaaatgtgggtgaattgcagtatggtcaatttttgccagacgcagctcaattgctttctctggatgagaatacacacacacacacacacacacacacacataaatacacacacaaataaatcaagtcaaacattctttaagaatctagctactcttccatttccagccaagatagagtaaaagggactgattttcctgcctaataggaaaaaacccatgcaaaataatataaaatgataaacttcagaatactggacatcaggcaatgaagggcaggaccctgagaaacaggtaacaaatgaggtaacccctagaactatcccagctaactgcttagagaaagcttccaggctgtggcacagggaggggagttctaggcagagactggtggactccctgagttaaggagaccaaggtggctagagttcatatgaacagtaccagagaagagagagaatccaggggatctgcagggcattcagcagggtaatgggtcagttcacgcaagtaaagaaactactcaaggctggagaaagaatcaccggaaaggattaggagaaacaatacaaaatgctcacacagggctgggaataatgcctgtccccacctgccagactagaaaacctaatcactcatggggcactgagtaaagtactcagagggtcttgcctcagtagtagataattaatcacagcctaaaggatgctctggtcctgccagaggaaagcacaaagaaatcaaattatttctaagtaacttaactacatcccagaacaaagactgagaatatttataggaatatggaagtgtccaggactcaaatagtaaaattcacagtgtctggcatctaatcaaagattaccagggcctgatagcttacgcctgtaatcccagcactctgggaggccaaagtgagggtatcatttaaggccaggacttcaagaccagcctgggcaacatagtgagacctcatctcttcaaaaaaaaaaaaaaaatgagccagacatggtggcatacacctttattcctagctattcaggaggccaaggccagaagatcacttgagcccaggagtttaaggttatggtgagctataattacactaccgcactccagcctgggcaacaaagcagaacctcttaaaaacaaacaaacaaacaacatcaacaacaaaaaactagaaacatggaactcaaacttctgaagatgaaagctgtaatatctgagatgaaaaatacacgggctgggttaaaagcacactcaacaatgcaggagaaaaaataagtgagcttgaagccatagcaagagaaatgatcccaaagaagccacagagagagagaaaaaactgttgccattaaaagagtatcagcggttctgggataactacgcaatcccagatattacatgtatgtgtaactgcagtccctaaggtagggatggggagaacagaaaaattactagaagaaatactggccagaatttttacaaatttgacgtaaacaaaaaatccacagatctaaaaagcacaatgagctgcaagcacaagaatcatgaaggaaactacaccaagccacatcataatcaaattgctcaaaatcagtgataaaaagaaaatcttaaaatctggtagagaaagtagacattttgtatatagagaagatcaaaattaaggatgacagcagatttcttatcagaaaacaatggaagtgtaatatggtttggctccatgtccgcacccaaatctcaacttgaactgtaataatccccatgtgtggtgggagggacccagtgggaggtaactgaatcacaggggcggtttccctcatgctattctcgcgatagtgagtgagttctcatagatgtgatggtttcataagcatctggcatttgccctcctggtactcattctctctcctgctgtgctgtgaagaggtgccttccaccatgcttgtaagtttcttgaggcattcccagccatgcggaactgagtcaattaaacctctttcctttacaaattacccagtcttgggtatttcttcatagcagcatgagaataaactaattataaagtgagaagacagaggagcgacatcttttttttatttttatttttttgagacagggtctcattctgtcgcccgggctagagtgctgtggtgtgatcttggctcactacaacctccaccttccgggttcaagcaattcttgtgcctcagcctcctgagtagcttggactacaagcacgtactatcatgcctggctaatttttttttttttttatatgtttagtagcaacggggtttcaccatgttggccaggctggtctcaaactcctgacctcaagtgttctgcccacctcagactcccaaagtgctgggattacaggagtgagccaccgcgcctggcctggagcaacatctttagagtactgaaaggaaaaagctattaacctatactcagggaaaatacctttcaaagacaaaagaattacaaaagctgaaagaattcatcaccagcagatctacactacaagaaatgttaaaggaagtccttctggcagtaggaaaataatgccagatggaagtatggatctacagaaaagaaagaagagcaccagaaatgctaactacacagttaatgtattagattttgtacttattattcaaatccctttaaaaggtaattgactgtttaaacaaaaatgaccatgtagtgttaggtttatgacatatgtaaaagtaaaatagatgacaatagcacgtcggctaggaagagagaaatggaaatagagttttgtgaagttctttttgttgttgtttagagacagggtctcatcatgtgatccaagttggactcaaactcctgggctcaggcaaccctcccccttcagcttaccaaacagctgggagtatgggtgcacatgactgtgcctggcagttctgtacagttcttatactatgtggaaagtgatattgtatcacctaaaagtagactgtgataagttaaatgtgtactataaatcctaaagcaactgctaaaataacacaagttatagctagtaaaccaacaaagtagataaaatgaaatcataaaaaaaattgaaaggccgggtgcagtggctcacgcctgtaatcccagcactttgggaggccgaggcgggcggatcacgaggtcaggagatcaagagatcaagaccacggtgaaaccccgtctctactaaaaatacaaaaaattagctgggctgcgcagtggcgagcgcctgtagtcccagctactcgggaggctgaggcaggagaatggcgtgaacccggaaggcagaagttgcagtgagcctagatctcgccactgcactccagcctgggcgatagagcaagactccgtctcaaaaaaaaaaaaaaaaaaaaaaaaaaagaaaaaaaaattgaaaatattcaattagtacacaagagggcagaaaaagaagaaaagggaacaaagaacagatgggacaaatagaaaacaaacagcaaaatgacaggcttaaacccagcaatatcaataatcatattaaatgtacatggtctgaagacctcagttaaaaaccggaaactgtcaaattggataaaaatgcaaaacccaattacatgctgcctacaataaataccctttaaatataaagacacaaatagattaaaagtaaaataatgacaaagatatgccctgttagcactagtcaaaagaaagctggagtagttattaatatcagacaaaacagatttcacagtaaagaatattactctgaataaagaaggttatttcttttttttttttttttagaaaaaaaaattaaaaattagccaggcatggcggcacacatctactgtcctagctacttgagaagctaagacgagaggatcccttcagcccactagttcaaagttacagaaaaccacggccacaccactgcactctagcctgagcaacagagcgagaccccatcaacattaaaacaacaacaaaaaaaatcaatataattcaccatattaacaaactaaagctaaaaaccatataattaccttgatagatacagaaaaagcatttgacaaaattcaacatccacctcagataaaaacgctgaacaaactagtaagatccttaactgctaaaggttatctatgaaaaacaaaggaataagatgcccactctcaccacttctatttgacttcgtactagaggttcaagccagtgtaatacagaaaaaaaataaataaataagaagaagaagaaaaagaaaaggaaaagaaataaaaggtatccagggtggtggaaaggaaaagtaaaactatcattattcacaggtaatatgactgtctatgtagaaaatctgatggatgtacaaaaaagctattaaaagttagtttagtatggttgcaggacacaatataaacatacaaaatgctattatagttctatatactagcaatgaacaattagaaattaaaattaagaaagcaataaaatagcaccaaatttatataacacaaaacaatttaaaataacaccaaaaaatatgaactacttagggaaaaatctgataagacatataaaacctgtaccctgaaaagtacataatgctgttgagaaaaattaaagatgacctaaataaatggaaagatatgccatgttaatggatcagaagactcggtactgttaggatgtcaaatatcaatcaaaatcttgaaaggtttctttgcagaagttggcaagttgactctaaatatgtatggaaatacaaagaacccagaatagccaaaacaactttgaaaagaacaaagttacaagattaacactacttgatttcaagatttaatataagctacagtaatcatttaatgtaagctacagtaatcaagacagtgtggtattggtataaatgtagaccaacagatcaatgaaacagaacagagaatccagaagtagacgaacacatatacagactaataacattttgacaaaagcaaaaaggcaattcattagagaaaggatggtcttttcaacagatgaatatctatatgaaaaaaaaatggacgcataacttatactacttacaaaattaacttgaaatggatcagagacttgaacgtaaaacctaaaactataaaacttctacagggaaatatagggtaaaatctctatgtgaccttggtagggcaaaagtgtcttagatacaataaaagtataatccaactgataaattgggcctcatcaaaataaaagattttgttctcaaaaagacaattaggcacacacaaatcaaaatcacgtctcccttacattttctagtcttctctctttacctttcattcctgttccaggaccctcattaagatgaccttttggcaaagtccttttggcaaaggcttgaggacaagttgtccatgcaattagactactttaactcagttagaacataggttcctgaactagaaaatgtaagactttgaactagaaaatgcaagactttgtctaaactgtcagcagttatatcttcaaagcctagaaacaagcctggcaaattcattcatctggcaaatatttcttgaagacttgccatacatttggcatctggtaggtagttataaaatgcagcaaatgagtgaccaaaatatacaaaaatgccttaacaaggacactgaacatcctgcaggaagtgaacacactacttaatctagtacttcaagctgaaaccattctctagctaaactaatgtagatgagtcctctgaacaaaaggacatgttcaatcatttgtgtagattataacatccctacatgctgggtacaatgccagaagaatgggggtaagaaaatgagtaaatacaatctctgtccttaagctgttccccaataatgatagctagaaaaagtagagattattgagtaaaagcatgcacaaagcaccacaggaacagagaagaagaatcaactgactcagtctgggggcatcagagaaggtttcatagagaaggaaatgtatctgctaggtttgtgtggcaaataccatcaactgcttactcataattcattcaccccttctttcttgctcatagaccttcatactgttcagggtaacattatacccagttcaatgttcactttcacagcttcccatgcacttgaggttgatcatataatatgattttggcctatgagacaatgaaagttgttagaaatttctgggaaagcttttcctttctgataaaagtgggaaaaataggctgggcacagtggctaacgcctataatcctagcactttggaatgcagaggtgggagaactgcttgagcccaagagttcgaggccagcctgggcaacatggcgagactctgtctctaaaaaatataaaaaattagccaggtatggtggtatgtgcctgcagtcctagctacacgggagactgaggtgagagaattgcttgagcctaggaagtcaaggctgtggcgagccataatcgcaccactaccctccagcctaggcaactgagtgagaccctgtctcgaaaaaaaaaaaaaagaaagaaagaaaaaaaaaaaaggtggaatggtgaatatagccggcatcaaccttcccctcttcttgcctcgaatgtgaatatgaaaagcttctggggctggagctgggtgtggtggttcatgcgcgtaatgccaacactttgggaggccaagacaggaggatcacttgaacgcaaaaattgaagaccagacggagcatagcaaaaccttgtctccacaaaaaaaaaaaattttttaattagccaggcatgggagcacatgcctgtagtcccagttgcttgggaggctgaggcaagagaatcacttgagcccaagagttcaaaagctgcagtgagctatgttcacaccactgcattttagcctgggtgacagagagagaccctgtcacacaggcagaaaaaagggcagaaaagaaagagcttctgtaaccatgaggctttcattgacatcatttaaaaaaaaaaaaaatgaggcaacagtatgaccataaaagccaacaacaaggattcactgaataaaaagacagaatctcagttcttgtttacatggttgagcagctgagccaaccccagcaaccaccaattgtgtacttcttgctaatataagaaaaagaaccccctatttgtttaacccactgctgattagggtctctactacatacaatgagatccattcctaactaacagtgttaaaggatgagaagaagataaccaggcaaaaagaaaacaaggaagaagactgcaggcaatgggaaccacatacacaaaggcagaaacagataaagaggctggcatatttaggaaaagggacatgttaatgccataatccaagaggcctgaatgtacatttccaaggaggccttacctgcttcatccacagtggtacacttctggtacatggatgtacggagagtaggtgtccgaacattcaacagcctgatcttgtcaactcgggaatcaaatacccggagtacagggtctttatcatcatcatcatgacacattattttgttgtcaatgaaagatgcaaacatctgggtctccaggaatcttgagaggaagggcaggtagggctcaggctgatctgacagaaaagatgcctggtgggaccaaaaagaagcagtaattgacagggaaaagggtaatgtcaatgtgcccaagggatccagtaggttaattattctctgaggctgcctaggtctttaagaataccaagctgcaaaatctctacattaaaaaaaaaaaaacccactcatgtaagttcaggtatcttgaaactttgacactggaacaaactcacttgggtaacctactgagtcaaccaatcttcccagaatcctgatgttcactctacatgtctatctttgccttaagagatccctttggctgaaggtaaatcgtctgataataataatcagcacatctattcataagcaacaagacctattttatcaacatcaaatggaccataaacttgtttccagcatatgataatcttccattacttcttcgagtaattttccattacttcttcaagacataactggcaagttctcattcctcaccacctcccaagcaggattacactcactttatcaaagttttgcatttgctccctgttggtaaaccaggattccttatcctggctgggttggatgacaaacacctcataatctgcaaacatctgagtgaaacgatttgcaaaaacttcccggatctgaatgtttagctggtaaatcctgagttcttcttcatcacactgaactttgagatccttattgctgctggggtcttcacgcacttccaactacaaaaaaagaaaaagcagttgagaacacatacactttttccttttaacccaaggaatgcaattcctgatttttttatctgatttttttttacagtgctaatttacttagcaggaaatgatgagaacaaaagaggaaaaactggaaaaaataaataaataaaaggaaagggactcagacacagaggagagaaaagtcaaagagtttcacttaaagatatccaacaactcaatgaaagtggagataagatctttatgggcagagagagattctgccatgaaagaaaaggtgctaattatctcaaaggtcagggagaaaggaaggaatgtgggaggtcaatttaacaaaccaacaaggttaaattctggctctcttgattttttattttttccctcatatcactttccttctttctgcaaaaaaaccttttttttttttttttgagacagagtttcgctcttgttgcccaggctggagtgcaatggcgccatctcggctcaccgcaacctctgcctcccaggttcaagtgattctcctacctcaccctccccagtagctgggattacaggcatgcgccaccacgcccggctaattttgtattttcagtagagacggggtgtctccatgttggtcagactggtctcgaactcccaacctctggtgatcctcccacctcagcctcccaaagtgctgggattacaggcgtgagccaccgcatccagcccaaaacacctttttaatctcaccaaatatttctgttcctctttaactgcccatgatttttgaaaaatatctagtctactaagcaaaaaaaaaatctgctccactaaagcagaaaaaatgaaatatttcactaaaaaacagcccaacaagattattacattggcccattggtttataagtaacttacgaaagtaatttaacagtgagaattcaagaggactagattctaggctcagctcagctacatattaggcatttaatcttgggcaaaacacttaggctctctaagccttggtttctttggctataaaacctgttctatctgccttaggttgctgtgaaactcaaagggcaatggatctaaaagagatctgggcctggcacggtggctcacacttataatcccaccactttgggaggcaaggctggaggactgcttgagcccggaagtttgagactagctgagcaacatagtgagaccctgcctctacaaaaaaaaaataataataattgggtgtggtggcatgcacctgtggtcccagctacttgagaggctgaggcagaaggatcacctgagcccaggagattgaggctgcagtgagccgtgaccgtgccaccacactccagcctgagtgacagagtaagaacctctctcaaaaaataaaagaggtctgaacactaagattactatcatggtctctccaatcactgtgctgtagtgttcacatagaatgatggcagactctccctgatgttcaaagcggaagctactcagatttagattaaagtagcatttactaggataacatctgccagatggaattcagagtcccccatacagaacattctttcactgctcacaaatatgagttgtccagaactgggtgctttctcatcccataccttacttcaccaggacagcaccctagcacagatcacacgtgtcacagactcatatacacatcttaccttttccaggctcaccccagttctcttgaccaaggcttgcagccgggcaatagtttcattctccttaagaagctcgtaggaatgcaaaggggagccagcaatgttcccattcctcttgtccgagacaagctcagaggcccgcagcctcttcagcttggaggcactctcactgcaatgaagattcccttcagggggaattccaaatgccatgagaatctcagagacttcctggacaaactccaatttgttggggaactgtggcaagtcctctggcaactcaatgaagtggttgtcaatgtccacaaagcagaggttagcctggaagtcaaaacaggatgaggagtatgaataactccagagcattacaggaagaagttttagaaaggttagtgaacaagagggcaaaaacaaaacacctgaaatggctatatttgagatatggtataaggaagatagggctcagaaataagacagacttgagttccaatattaccctgccacattctcgttgtgtgaccttaggaaagttacttaacctttctgattctatttccttagctgtaaaatggagataaagagataaacaatgtatgttagagtggtgaagattttataatgtcatagatgtttagcatcaaacacaaaagtctcacacatggtaaacactcattaaatgtttggtaaaggccaggcgcagtggctcacatctgcaatgccaacactctgggaggctgagatgggcggatcacttgaacccagactgttgcccagactggtctgggcaacatggagaaacccagtctctacaaaaaaatgcaaaaattagccagggatggtggcatgcacctacagtcccagctacttgagaggctgaggtaggagggatcacctgagcccaagaagctgaggctgcagtgagccatgatcacaccactgcactccagcctgggcaacagagtgagactctgtctcaaaaaataaaaaataaattcctggtgaatttgtgaattctatactcagtgaaaagaaccctaggagtgagttcaaaaagtctaggttccagatttgactctgttatgatctccctctatgaccctggatataccattctctctttctgagcctcagtcttaatttgtaaggtttagtggctgatctttgttctttctgtgcttccttctggatttaaaattgcttctgagagaatgtaaagagatagtgctcacacactgctgatggggtagataatctggattaacaaacaatttaggggccaggagcagtggttcatgcctgtaatcccagcactttgggaggctgaggcagatcacctgaggtcagaggtttgagaccagactggccaacatggtgaaaccccatctctgctaaaagtacaaaaagtagccaggtgtggtgatgggcacctgtaatcccagctactcgggaggctgaggcagaacaattgcttgaacccaggaggcagaggttacagtaagctgagattgtgccactgcactccagcctgggcaagagagtgagactccctctcaaaaaacaaactaacaaaaaacccccacagtaatgcagcagtatctagctatccctattttacagacaaaaactgacacagagaggttaagtaacatgccaaaagtcacacagctattaactagtacagctgggacttgaactcagctaccctgacttcagtcatatgcttaagctcttaaccatctactcttctcctctttagcggtcttgtacatttaatttaaatactttgtagtttaacaatggtatactattccaccataaaaatgaatgaaatcctgtcattcatggcaatatggatgagcctggagcatattatgttaagtgaaataagctaggcacagaaagataaataccacatgttctcacttgtatgtgggagctaaatatgttgatctcactgaagtagagaatagaagagtggttaccagagactgggaagggtggcaaggaggaggaatagaaagagactgattatccaatacaaaattatggctagacaggaggattgcagtcttctatagcactgtagggtgactacactcaacaaacatttgttgtattttttcaagtagctagaaaagaggattctgaatgttaccaatataaataaataaaaaaggtttgagatgatggatatgctaattaccatttgatcattacatacacccccatttgatcattacatacatgtactgaaatataccataccctgtaaatatgtataattatgtgtcaataaaaatgtgtgtgtacatatatatttaaatactttgtagttcttgtccctgttggaatgttcttgcaggtataaattacagaagcctttcatatttgtatatttatcttatactcatgaatctgttctagccaagacaacattgccttcattgcagcacattattaaatgcttaagggtgcttctgttccattcacgtaacagagataacaatattaccaatgtcatagacttgttttgaggattatataacaataaatgtcaaggatttagcacagtgccaggcacatagtacataataaatgttaatcaacatttattatatatatgtatgtatgcctttaaatttttacatatttttaaatttcatacaggtttttaactttttttttttttttgagacagagttttgctctattgcccagtctggagtgcagtggcacagtcatggctcactgcagccttgacttcctgggctgccaagtagcttggactataggcacacaacatcacacctggctaattgttgttgttgagacagagtgtcgctgtgttgcccaggctggtcttgaactcctggcctcaagcaatcctcccacctcagcctcccaaaatactgggtgggatcaggtgtgagccaccacacccagccaggtttttaaattttatacaaggattatcattccataagcagtcttttggtagtaacttcaatcaacattaggttgagattcaaccattttgttgtgtgtagccatacttcattcattttcactcttctataatattccaccaatatgaatataacataatatattgatcagttttcctgttaaaagacatttgaggccgggcgccgtggctcacccctgtaatcccagctactagggaagctgaggcaggagaatcgcttgaacctgggaggcagaggttgcagggagccgagatcatgccattgcactacagcttgggcaacaacagtgaaactccatctcaaaaaaaaaaagacatttgggccgggcacagtggctcacacctgtaatcccagcactttgggaggccgaggcgggcgcatcacaaggtcaggagatagagaccatcctagccaacatggtgaaaccctgtctctactaaaaatgcaaaaaaattagccgggcgtggtggcgggtgcctatagtcccagctacttggaaggctgaggcaggagaatgtcatgaacctcggaggcggagcttgcagtgagccaagatcgcgccactgcactccagcctgggcgacagagcgagactccgtctcaaaagaaaaaaaaaaaagacatttcagttgttttttgtttactgtatttacactgattgttattacatgttttcttggactcctgcaagattttatatatgggtatatcctaggagtagaaccacagtgttgtaaggtatgcaaatatcccactttagaaaatgatgcctagctgtattccaaagtggttgcaacaatttacatttttaaccagcaaactaaagtgatcctactgatccaaatccctcccaaaacttggtattatcacacttcttgaaatttgccaacaaaatgagcataaaatggcactgcatcgtgtatttgatttcacttccctgattaagaaattaagagaaattaagaaatgtgcattttttacgcaatgcctgttcatatcttatgccatgtttctattggattgcttatcaccttcttacccacttgcagttctttatattctgttgatattaactctttgtaggttataaatgttatgtatttcttcagtttttatctttaaggtgtctttttcttcatttagaaaatccaatttatcaggctgggcacagtgcctcacgcctgtaatcccagcactttgggaggccaggtgggtggatcacctgaggtcaggagttcgagaccagcctgaccaacatggcgaaacctcatctctactaaaaatacaaaaattagccgggcattgtggcacacacctgtaatcccagctacttgggaggctgaggcaggagaatcatatgaacccagcaggcggagtctgcagtgagtcgagattgcgccactgcactccagcctgggcgacagtgtgagactctggaccaattaaaaaaaacccccaattatcaatcttttattttctttgatggatagtgctttttataacttgtttacaaaactccttccctagccagaagtcagaaaggtatttattaatttttttttccacaagatttaaacttgtgcttttgacatttaacttcttaatccatctgaagttgattttgttatggtttacttttttcccctacagataagcaatttttccagctccattattaaatagctcttccttgagtgtgtatccctattgtatatctaaatgttgtttcattgatctgtttctccctatgccaacaagtcatattctaaaagaaaacactgcaggggctaggggagggatagcattaggagaaataccctaatgtagataacaggttgatggatgcagcaaaccaccatggcacatgtatacctatgttacaaccctgcacgttctgcacatgtatcccagaacttaagatgtatatgtgtctgtgtgtgcttgtatatttgtgtatctgtgtgtctctgtacgtgtctgtgtctacgtgtgtgttgttcctgtatgtgtggtctgcgtctgtgtgtgtggctgtgtatgttatctctgtgtctttgtgcctctgtgtgagctgtctgtaaatttgtgtgtgtgtatctgtgtctgtgttgtctgtgtgtgtgcgttttctggatgtttacgtgtctgtgcatgtgtgtctattgtatttctgtgtgttgtctctgtgtgtctgtattgtctctgtgtctgtgataataaaaaataaaaaagaagacactgaagggtaggcgtaagtccagcttaatataactatttcataaactctcaatctattaaaactgcatgtttaacaagtccatgtgtgtatcattcaataaacatttgctgagtgcataaattactctgtctaccaatctataactaagagagctttcccatgtcaaaaattcaaagactgtaagaatcactttaaatttcactttctagagctcctccactggataacaactttgaaccccacctagtcaaaaggccaataaatgtttaacttaacacctaaaaacacgctacattttgcttattcctttaagattttaaaattatgtcatcaggctgcgccattagaagagataaagacagaattaaatcatctagtcatgaagatcacctgcctcataagccctgtccatacacctaacaaaacaagccactgtgacccacgaaaggcacacaatgcaatcatttacctcctcagttaccctctcctcagaagaaaaaagcagtttctccaataggaaacacagaaacagctagaaatacctacatctactaaacaatgcttggttggcttttctcccactactgtgaaccaaatatagagtctgtaaagaatctttaaaactccaaatgctgtgtccacatttgtagaaacctttggtcagaggtgggtagagaagaaatatgcccatgcacatttcagagatgaattagattaagataagataggaccctctgagtaggcaccactagccattctttgcaaaaattggttgaagttaatataccctagagactgagttttaaaagagccgggtgcggtggctcacgcctgtaatcccagcactttgggaggctgaggcgggcagatcacttgaagtcaggagttcaagaccagtctggccaacatggtgaaaccccgtctctactaaaaacacaaaaaaaattagccaggcattgcggtgtgtgcctgtaatcccagctactcgggagactgaggcaggaaaattgcttgaacccgtgaagcagaggttgcagtgagctgagatggcaccactgcactccagcctaggtaacagagcaagactccatctcaaacaaaaaaaagagaagaaagaattgagctaaaggagggagtggtaaaaaagcaaattactacactcatacaatagtcaattactagactcatacaatagcctcatgctgtttcctcccatcatacagaggggctctagcacacagaagcacttacaaaatactaggaactcctcatatatcctccttcctcagctgacgaggggttacttcttacctaacagctttggggagagtagcctggaagaggtaccgaatgccaagtgatcagttttcctctgttaacctcctgccttgttgagagggatgatgggtagacttagctgctctgaggtagtgatcacatggatcccccaaatcccaagaagtctcccaaatatcttccgctcaaggtcacaatgatctttcccaatgctcaattcctaataccaaaaaacagccagcctgtttctccagtctatcctcatgttattcattgaaaaggagttcaacacacagatgactgggaaaaagctattgaaggagtgtcctgagaaaatgggggaaaagtaggaaaaaggggtccaagatagaaaaaaatggtacccctttctttactctaatatcctttgcttaattctgtaatatagctgtggatgaaatgcctccttcctgaactcagacaacgaagctccaaagagaagcctaagacaaaggatgcctcacaaaggcagctcagtaccttcacttgctcagggccagctgagctcatgtgttggtgcaaaaaggaacaaaaagctttttacagacttctgatgcccaaagacggcagtaactgatgaattctgatttggtgggctaggaaatgtacactctctgtccctctggagaaagtcctttttataaaccaagcttgccccacctcactaccctgatgatgcccccttatacggtcccaggtaaatttccccagccctgccggatatggtttggctgtgtccccacccaaatctcatcttaaattctcacgtgttgtgggagggacccagtgggggatagttgaatcatggcggcaggtctttcccatactgttcttgtgacagtgaataagtctcaagagatctgatggttttataagggggagtttccctgcagaagctctctctttgcctgctgccatccatgtaaacatgatttgctcctccttgccttccaccatgattgtgaggcttccccagccacgaggaactgttaagtccattaaacctctttttcttcccactctcaggtatgtctttatcagcaacatgagaaaagactaacacagttaattggtaccagtagagtggggcgctgcttaaaagatacccaaaaatgtggaagcaacattgaaactgggtgtcaggcagagattggaacagtttggagggatcaggagaagacaggaaaatgtgggaaagtttggaactccctagagacttgttgaatggctgtgaccaaaatgctaataatgatatggacaatgaaatccaggctgaggtggtttcagatggagataaggaacttgctgggaactggagcaaaggtgactcttgtgttttactgaagagactggcggcattttgcccctaccctagagatttgtgtgactttgaacttaagagagatgatctagggtatctggcagaagaaatttctaagcagcaaagcattcaagaggtctcttgggtgctgttaaagacattcagttttaaaagggaaacagagcataaaagtttggaaaatttgcagcctgacaatgcaatagaaaagaaaatcccattttctgaggagaaaagtcaagctggctacagaaatttacataagtaacaagaagccaaatgttaatccccaagacaatgggggtaaatgtctccagagcatatcagaggtcttcacggcagcccctccctttacaggcctgggggcctaggaggaaaaagtggtttcgtgggcctgacacagggtccccatgctgtgtgcagcctagggacttggtgccctgcatcccagctgctccagctgtggctgaaaggggctatcacagagctcaggctgtggcttcagagggtgcaagtcccaagccttggcagcttccacgtggtattgagcctgcaagtacatggaagtcaagaattggggtttgggaacctctgcctagatttttgcagaggtacggaaatacctggatgcccagagagaagtttgttgcagggacagggccctcatggagaacttctgctagagtagtgcggaagggaaatgtagggtcagagcccccacacagagtccctactgagacactgcctagtggagctgtgagaagaaagccatcatccttcagaccccagaatggtagatccactgacagcttgcactgtgtgcctggaaaagccacagacactcaacgccagcccataaaagcagccaggagggaggctgtaccctgcaaagccacaggggtggagcagcccaagactatgggaacccacctctttttttgttgctgttgtttggttttttttttttggtttttttgtttgtttgtttgtttttgagatggagtttcactattgttgcccaggctagagtgcaatggcacaatctcagctcactgcaacctccacctcccagattcaagcaattctcctgcctcagcctctcgagtaggtgggataacaggcttgtgccaccatgcccagccaattttgtgttttaagtagagatggcgtatctccacgttggtcaggctggtcttgaactcccgacctcaggtgatccacctgcctcggcctcccaaagtgctgggattacaggcgtgagccactgtgcccagccagggaatccacctcttgcatcagtgtgacctggacgtgagacacggagtcaaaggagatcattttggaactttaagatttgactgccccgctggatttcagacttgcatggggcctgcagctctttgtttttggccaatttctctcatttggaatggcaatatttatctaatgcctgtaccctcattgtatctaggaagtaactaacttgcttttgattttacaggcttataaggaaaggacttgtcttgtctcagatgagactttagactatggacttttgagttaatgctgaaataagattttgggggactgttgggaggcatgattggttataaaatgtgagggcataagatttggaaggggccagggcagagtgatacggtttggctgtgtccccacccaaatctcatcttaaattcccatgtgttgtgtgaggtacccagtagggggtagttgaatcatgggggcaggtctttcccatgctgttctcgtgatagtgaataagtctcacaagatctgatggtttcataagggggagtttccctgcacaagctctctctttgcctgctgccatccatgtaagacgtgacttgctcctccttgccttccaccatgattgtgaggctttcccagccacatggaactctaagtccattaaacctctttcttttgtaaactgcccggtctcaggtatgtctttctcagcagtgtaaaaatggactaatacactgccccaaagcttccttctaagactgtagttaaaagataccacatactttaaagatgtgcatcaaaatatcaaaagtagttatctctgggtggtaaaatttgaggtaattttaattttattgtttatgcttttgtgcactgttagcattttttactatgaacatgtcatttctgagacaccccaaagtcgtctttcaaagccagctctcttcccctagtctaaggttttccacgggaaatacataggctcagataccccagagcttatctgctaaaaatcaaggtagaaaatatccagctatataactgctcccacaaatgtgtgaccttcagaagacaggtgtggatgaactaggactctgaaacccaagaaccacttatgaagcacacacagttaattctactgttccactgtcaccactccttcccaagcagactacaggggagccagaagctcagatacaaagtttatagcagggatggggaatacagcaacatggaggctccaatagcccagaacagagggaacttttgggtttcttttctgttttttttttgaggtggagtctcacactgtcacccaggctggagtgcagtggcgcgatccacccaggttggagtgcagtggcgtgatctcggctcactgcaacctctggctccgggcttcaacaattctcctgcctcagcctcccacgtagctgggactacaggcgtgcaccaccatgcccagctaatttttttgtatttttagtagagatggagtttcaccatgttgaccagactggtctcgaactcctgacttcaggtgatctgcccgcctcggcctcccaaagtgatgggattataggcgtgagccaccgcacccggccaacttttgggtttcttaaacaacccatggtttcttaaacagtcccattaagaaatctgttgatccctcagaggtccctttgtatagccgtatacatgaagcacatagggaacaacgttgaaaaatcctagagagatcagaatttgccccaagtataaagaaagctgatgccaaagaggaaaataaaactgagaaatctggcttcttgcttagtggcctatgtattaaagtatgcacatagcttgcctctttggccttccaccttcaacaattttttgttattgttctttttgtgactttacagaatcataattaggttgactaagttgtatcaatattaaatagacatttgtttaaagcaaacaacaaaaagctcttctttctccagtcgactcttcaggtttatgtatggtacagtaagcaagtacacaaaaaaccccaatattatctcaactcaatgattttatccatcatttagattttttttccttaattaatcttgttccaccccaaagagcacaacgctctataaagtcaaagaagaaaaaagggcagaaatggaagaagctacaaggaagacaaggaagacattttgattctaaaactaaagaagagagaaaagagcagagatgcatttgactataatttaaatatcacagacatggtctaattatcagggtattcatcaaagatgctgcccagtcatgaccagtgacacagtgctgcccagatccagttccatgagaatgctctcttcttggggcccctcacttatattcctcacttatatacaaaaatctctacccccggccgggcgcggtggctcacgcctgtaatcccagcactttgggaggccaaggcgggtggatcatgaggtcaggcgttcgagaccagcctggccaacatagtgaaaccccgtctctactaaaaatacaaaaatttagccgggtgtggtggtgggcacctgtaatcacagctacttgggagactgaagcaggagaatcacttgaacctggaaggcagaggttgcagtcagccaagattgtgccactgcactccagcctgggtgacagtgcgagacttcgtctcaaaaaaaaaacaaaaaaaaacaaaaaaaaaactctacccccaaaaaaatggtggtggaaggaggaaacgaagagtcatggtgacaccagtgtatgtatactccaaagtcttcttcccaggcctttctaatgactaagaaattcaaagtaggaaagcacttccctgcaggtagtttcacaacagccacaaagtaacataccagttctgctggtaattctaaaaaaattaaaaataaaaaatcttatttctaatcatgctttaaatctactttagaatggaataggaaatacattattttaaatcaattcttttcttagccaggcacagtggctcatgcctataatcccaacactttgggaagccaaggcaggaggattacttgagcccaggagttcgagaccagcctgggcaacatggtgagaccctgcatctacaagacataaaaaaacaattagctgggcatcgtggcacactcctttagtcccaactactcaggaggctgagtcaggaggctcacttgagcccaggagttcaaggctacagtaagctacgatcatgctactgcacccagcctgggtaacacagcaagaccttgtctcttaaaaagcaaaacaaaacaaaaacaatagcataaatacagaaattacaatgtacatatgtcagttgataaagataataagtgtctctgggatgacataaattgaactaaatattcattgtttttacttttttcctgagaagttattcataatcaccaaaatagaagaaaataaacttggtaacatcatgcatgctgggttcatcccaaagcccttctctccccaatcctggattggggccagaggcaccaacactcaagatctcacctcttgaggcagctccagctttgaccggtcatccaggccattggaatgcaaacccatcaggtatggaacaggagcatctaagaaatgcaggagagaagctgggagaatagggacatagacatgctgccactggaaaggaaacatgagagctgtaatcgtctccgccacagtcatcagtctctggtaatctgggtcaacaacaacaaaaaaagcacacacacaaatcagtcaaaaacaaggcacttgctttccaaacagtaagttaaaactttcagtacaatttcttatttagaaacgatcacgataaacttcagctagggtatgctcaatgtgattcccttgagggtgtccaagagacaaccaagagacccttgtggaccacaaattgaaataaacctacacacacaggtccttgctcataataaaatctaatatggaaatacaacaaaaataattaatgacatcttgctccaaatactaccacagaatgttaagtagatcctcttaagaaagggggtaggagaactgaacaaaaagaaagacagtggtcctgggtctccattcagcatggaagcaaaaacatgctcagttctcactaagatacatctgcagaacatcctataaggagcttatgtgagctttgcctgcaaagtcaagcacaaagaaccaccaagcatgcagaagctggttttccacactagccaagtctgctctacacctggcaacctttcctgaatgagaacagcataaaaatgttattataacgtttcaataaaaagcttccctagaggctgggcatggtggctcacgcctgtaatgccagcactttgggaggccgaggcaggtgaatcacttgaggtcaggagttcgagaccagactggccaaccaacatggtgaaaccccatctctactaaaaatacaaaaattagccgggcgtggtggcatgcacctgtaatcccagctacttgggaggctgagacgtaagaattgcttgaacctgggaggcagaggttgcagtgagccgagactgcacagctgcacacgccagccagtgacagagctagactccttcttaaaaaaaaaaaaaaggcttccctagaacttgaaagactcagaggattgactttagctactcaaaactcttgttataggtcagagatcatagcctaaagggaaggctcgtgggcttgtgatcatatttggcttatcttcagaatgtaatttctaggccttttttttttttgtgacggggtcttgctctgttgcccaggctagagtgcagtggcaccatctcagctcactgcaacctccacctcctgggttcaagtgattctcctgcctcagcctcccgagtagctgggattacaggtgcccaccaccgcacctggctaattttgtgtttttggtagagacggggtttcaccacctcggccaggctggtctcgaactcctaaccttgtgatccacccgcctcagcctcccaaagtgctgggattacaggtgtgagccaccgcgcccagccagccttttttttttttttttaatgactaataaatatattggtacagccaataaaattgactagttaaaactttttttttttttttgacggagttttgctgttattgcccaggctgcagtgcaatggcacaatctcagctccacaacctccacctcccgggtttaagcgattctcctgcctcagcctcctgagtagctgggattacaggcatgcgccaccacccgagctaattttgtattttttagtagagacaaggtttctccatgtcaggctggtcacgaactcccaacctcaggtgatccgcctgcctcggcctcccaaagtgctgggattacaggaatgagccactgcgcttggcctaaaacttaaattttacaaattactatttgtaatgatatgatgatatgatggtttcaggcatttaaggacaaagcagaaatatgcatttttaaatcatatgagtaaaatccttctggaatggctggtttcaaatgagctgtcataggaattaaaatgatgttatgcactaaaaacccactccaccatttaaatcacagcttggttcataaagtagttgtaagtaacaaaaaactttctaggaaatgaggaagtctcagtacaaagggaacagaagctgaaaagtattaaggtagaagtttagcaaaacatcctacatttgctcactaataaagctttgaaagttgcctatcaccttgctcctagctaatcaaagaagagcataacctgtagataactttactagtgtgataaatatgtatctatttggtcttttccccggttcctgaaacacacagctcctaaaacccttggaagctactgggcagtaagaatatcttttaagtgacattgtctcaaaaaacaaaaaaaaaaggatgtcttttaaatagggtgtaatggctcaaacctgtaatcccagcactttttttgttttttgagacaaagtctcgctctgtcacccaggttggagtgcagtggcgcaatctcggctcactgcaacctatgcttcccaggttcaagcgattctcttgcctcagcctccccagtagctgggattataggcacgagccaccatgcctggctaatttttgtatttttagtagagaaggagtttcatcatgttggcaagggtggtctcgaactcctcacctcaaatgatccacccacctcggcctcccaaactgctgggattacaggtgtgagccaccgtgcccggcccatttttatgacttgtatgtgcagataaagacatcagacttggaatcactctataaataagccccctctaaacaaactacagggcagctcctacgtatttatgaacaattataaactatcctgggaggttgcaaaacaatgattagtatgctcccatttgtgttctttttgaaaagtatatatatagtatatacacggctatatctacaagtaagcagaaaacagtggtaacctccctgaaggagaaccagggtgcagaggcagaagttacacacttcgctgtacactcttctaatgctgtgaatttctacccttcattttacactcctgaaatgccttttttcaaattttattttatttatttattattttattggagacagggtcttgctctgtcgcccaggctggagcgcagtggtgggatctctgctcactgcaacctctgtctcctgggttcaagtgattctcgtgcctcagcctctggagtagctgggattacaagtgtgtaccaccacacccagctaatttttgtatttttagtagagatgaggttttatcatgttggtcaggttggtcttaagcttctgatctcaagtgatctgtcctccttggcctctcaaagtgctgggattacaggcgtgagccaccacacctggcctcaagttttattttaatataccatacagatttcatagtgtatatgtataatttaaagaatattaaaattaatacacatatattcaacacctaacataaaaaatagtacattaggccaggtgtggtggctcatgcctgtaatcctagcaccttggcaggccaaggtaggcggatcgcttgaagtcaggagtttaagaccaacctggcaagaatagcaaaaccccgtctctactaaaaacacaaaaattagctgggtatggtggcacgtgcctgtaatcccagctactagggaggctgaggcagaagaatcgtttgaacccgggaggcagaggttgcagcgagccaagatcgcgccactgcactccaacctgggcaacagagtgaaactccatctcaaaaaaaatatatatatatagtgtattattaaaaatactggaaaagagggaatttttaaaaattaagagattacttctcagggataggatactagatcaaagaaaaaggggctgagtgcagtggctcacgcctgtaatcccaacactttgggaggccaaggtggccagttcacttgaggtcaggagtttgagaccaggctggccaacatggcaaatcccatctctgctaaaaatacaaaaattagccaggtgtggttgcacgtacctgtagtcccagctacttggggggctgaggcacaagaactgcttgaacccaggaggtagaagctatagggggctgagatcgcgccactgcactctagcctgggcaacagagcaagaccccgtcttaaaaaaaagtgagttggggagaaccttcaactttctctgcattatttgtgcacatattatttatttgtttttaaaaactattattttcattaaggatacacaaaaaattggatatccagctactatatgaagaaaagagaggaaaatatttgattccctttggaattgttttaattatatgccttaagcaatcattatttttacagtaaaagactactttagatagtaaaatatcattggagatttcttaccaacgtccacttagccaactcactttaccgattgattttccccactctgagtaaagcatacattgctcccactcatttgttcccaaacctgtgctagctgaacttactactggattatacaacgtaaccaaatattgtgtaaataaatggtaaaatctgagggcaaaaagaaaggatgtctgtttctctggaaacaaaattaaatgcttttaaaagactcagtagtacaaagtcactaaaaaacactgtaattgaattaggcatatcatgaagcaattaagaataaaaaactagggaacactacaaaaatctagaagtagtctctgctcatgttcttttgcaaggttctttatcactccactttaaaaaaaaaaaaaaagtaaccagggctgggcgcagtggctcacacctgtaatcccagcactttgaggccgaggcgggtggatcacgaggtcaagaaatcgagaccatcctggccaacatggagaaactgcatctctaccaaaaatacaaaaattaggtgggcgtggtggtgcacacctgtagtcccagctactcaggaggctgaggcagaagaattgcttgaactcaggagacagaggttgcagtgagccgagattgcgccactgcactccagcctggcaacagagcaagactccacctcaaaaaaaaaaagaaaaaagaaaagtaaagtaactaggaaatctagtcaatgtattatgggtgtggtttatgcaagaagtgcagatatctgatttgtgaagtcataatcatgagaaatgcctggacccttcgtcaaagattagtgactatacagttatatgttttaagttaaattatttaggccaggtgtggtggctcatgcctgtaatcccagcactttgggaggctgaggctggtggatcacctgagatcaggagttcgagaccagcccggccaacatggtgaaacctcatctctactaaaaatacaaaaattagccaggtgtggtgtcctagctactcgggaggctgaggcaggagactcacttgatcccaggaggcggaggttgcaatgagccgagatcatgccactgcattctagcttaggcaacaagagcaaactccgtctcaaaaataataataaataataaatagtttaactataaaattaattgtacatatcatttttaggattctgtgacttaactgacttttttggtttccaatcaactactctatcaggccacttcagataaagagcttctgttctgcatataatttttaaataaggccaggtgcagtggctcatgcctgtaatcccagcactttgggaggccaaggaaggtggattgcttaagcccagagttcaagatcagcctgggcaacatggcaaaacctcatctctacaaaaaatacagaaactagccagactcggcagtacatgcctgtagtcccagctacccaggaggctgaggtgggaggatcatctgagtctggggaggtcaaggctgcagtgagtcatgattgtgccactgcactctagcataggtgacagaatgagaccctgtctcaaaaaaagtaacaataattttttaacaaccaattaaaaattatgctattaaaaaaacactaattctatatggactaaagaataaatattatctaaaagtaaataaaatgacctataccaaaaagaaaacactgcttaaaactgccaattcagcattccaaagggttacactttcagaatcttacaattcagcctgcattccttttccctatgtaacacctcttttctattcagagggcaggacatgcagcaggcaaaatcaactgcagtggtgatagcttgtttttggccagagtgatttttatccatacaaggaagatgtccttggatcattaatataactacttcaagaaaaccaacctaaattgtttaaagcactctattaacaacaaaaagcataatttacatccaatgaaaagtaatccactccactgtggcctcagccaggctcagcaatatccaggaatttctgaaaaaagctttctcttgtccatgctgagcctgactttaggtcctaagttaaattcaattctacatactaaccatctcaattacattcaaacctcctaaaattcttattatggatacagtaacccatattctaggaaatacaaaagaaactcagatggaagaatgttatttttccattatgttcatcatatttgtttcaatcatcctttccttgcctctaaacacccccaatgcctaaaagcctactgtatcttctaacactctatatagtttggtttcctcctctctgttctgttctaaaccagagaagttcctccctattcaactaattctccatttcaaagtatttttatgaagctccagccaagaaatagctaggaaagcaatatgatttgtccaagtctatatttcacccagagagaggaggctctaacttcgtatcttaaactagaagttgcaaagtgaagcctcaggaactacattcagccagcagatgctttttgtttggcctgcagtgtttaaaaagaacattattgccaatatttaaaaatcagagatttcatgtaaaaaatctgggtcctcatcaattattggaatatttagtaacatcaggccagtatacccacaaggaattaactggagctaattagcggctatccactttatatgaggtatgtgctcttcagttcaacatagtttccattacttcaccttcaaactatatccagaacccaaccattccacaccacttcactgttatctccttagttctaactgacatcacctctcacctggattattacaaattacctcttaacggaactctttgctttcttccattctccctttggggatatactcttaatataatggccagagtgatcctgttaaaagcctaagttattcatttatttaacaacatttattgagcacccttatataccagccacagttttagtgcttggaatccatcaatgagcaaaaagcaaaagccctgccattgtggaggtccattcctttgcccatggaccaaatctgggaaatttgagcatcaaaataaataattatagtgaattataacctgagtaaaataaaaatctatgaatccatacaataataaacaaaggagaaagaaacactcttcattatggtataatgccaattaataaataaagataaagtttgaaaaccactattctgccagcctgggcaataaagcaagaacctagctctacaaaaaaaaaaaatttttttttaattagccaggcatggtggtgggcacctgtagtcccagctactcaggcggctgagatgggaagatcacttgagtccaggatatcaagactgcagtgagccattattgtgccactacactctagcctgggtgatagaataagactctatttctttaaaaaaaaaaaaaaattttaaggctgggcacagtggcgcctgtaatcccagcactttgggaaaccaggcaggaggttcagcccaggagtttgagaccagcctgggcaatgtagcaagaccccatgtctacaaaaaataaaaaattagccaagcatggtggtgcatgcctgtagttccagctacacgggaagctgaggtgggaggatcacttgagcatgggaggacgaggctgcagtgagccatgaaggcaccacttaactccaacctgggcagcagagtgagaccctgtctcaaaaggaaaaagaaaagaaaaagaaaatcacctttttgctactattcttgaaataactgattcagaatagaatcatcaataaatgctaaactattaggcatccataaactgcaaatataattcaaaaaataaaaactaaaaaaaaaatggttaggcaaaactttaaagaagaacagaataattagtttcaaagtatctccccatgacttacatgttaattaccaagggaaaaattataactttccagttaagaaaccacagacaccatcttaaccaagtaagcagattagtatcaccaaaaatgagacaaaatgacatcatatgcctgcctcctgtaatcatgaaaactgacagtatgtgcctcctaatataatgcactgagagaagcacatcacttctatggtattttaggcaaaaatttataatctgaatctaatcatgaaaacatcagacaaaaccaaattaagggacagtctataaaataacttgcttgtactcttcaaaaatgtctatgtcatgaaagacaaaagctgagaaactcacaactaaaagcaatgcatgatatggcactagatcctgaataaggaatttttttaaattatcataacagacattatcgggtaccagagaaactttaatatagtattgtctcaatgttaggttttccaaatttgatcaatgatagttatttaagagaatgtttttattcttaggaaataaacacatgagaatttaggagtcacaataactctcaatggttcagttatgttcacacacagagatcataataaagcaaatgtggcaaaatgttaacaattggtgaatttgggataggttatacaagagtcctttgaatacccctcgcgaatcttccgtagctagaaattattttaaaataaaaagtaaaaaaaattgaaaactctgatggctatctaagagccatttaagagtaaaagccaaagtccttacaatggcctacaagattctataccatctggcctccagttaagtctctaacaccatctcctactatactcccgctcattcactccattccatccacccagcttctggttcttgaatacacgaagcacattcttgtcttagaccgtttatacttcctgtgccctttgcctggaatacttttcctacagatattaacaggtcactcagggatgcctacctaaccaccctattacaaactggaacttctcttccccaaatactatccctttccctgttttatttttctttataacccttattaagtaccttacaaactacatattttatatatttatttaatcacctctcttctcccactaaaatttaagttccactatagcaacaatttttctgtcttgtccaccactacccttgaaacaatgcctgacacatagtgcactctcagtaaatatgtactgaatgaatgaatttcatgttactagcctggctcattaagtaagcatctgtttctttctaatctactttactattttgtccaaatatgctgcttacactcaacctcccatttatgaaaacaattcagttaagcaaacaacaaaaagatgcaacacatccacattttctcaatatataaaggattatcctttgtgaatcctcaattttactaggctgaggaagaggcagaaataactctgcagaatgacagaacagaactgatggaaagtcagcttcctgtgaccatcacctcctacccacccctcttttcacttcaatcagaagggacataggaagcaatgttcccctccaagactggaatgcccagcaaaaggccatgaagatagttaatcagaaatactggccctctcatgtctatcaatttgccatccaccacctacctgcaaaagatctgggttttgctcaaactgtaatagctcttaacctttacagtcagcctcactgtatctgaacatggaaagcaaagaagcctgaggcaggcagaaggctctagtaagcactgacttacgctgtgagtagagcaggatttgaaactccagaagggcacaagtaaaaagctgaaacacattctccaccccgagcagttcaaaaacctctttgacaggaaagtcaaataggggaagctcattggtacttggtctctggcagattattggcccatagaccccagaaaacttcaaggaccggccaggaggtgggagcggcacctcgtagagtacgttgtatatgtagctctcaaggggcagtggagggggctgaggtgaagtgactgcctggtggagttgctccagcacgctccgacatgccttcatgaaagacatgggtgtgatgaggcagatgcacttagagacgtagagagtgtcccggctaatgtcataggagttgaagcgctgcagtttggtcacaggagtgtcttcaccatcctccatgctgctctggtctctgtcatcagcagggggagcatgtaggacatcatactcagcattgtgcatgtggtagagggtctgcattgcactgcagatctgcttgctagtcacctcttcataaaatgtgagggcaaacccaaatgtccgagagccatcctcccttgtgataataaaggcatggaattggggctccctgggatcagcctgggtcttgaatgccagccctttcggcatacatagctgcaaaagacaacaaggcaacaagcagtgagaacactcactggcgatcctctttcagaacaccatcactatttatttatttatagagcacctactaagctgagcgtgtatctggcttaaagctctctctttctaatgcaagacatgcaagtaaataaaatcataatgcagtcatcagggatatacaaaagtatatgcaaagtactacaggaacacagcacagacaactcagcctgggaatatcagaaaaagctacaaaaatgggccaggtgcagtggctcacacctgtaatcccagcattttgggaggccaaggcaggtggatcgcttgaggccagcagttcaagaccagcctgggcaacatggcgaaaccctgtctctactaaaaacacaaaaattaaccaggtgtgctggtgcacgcctataatcccagccactggggaggccgaggcataagaatcacttgactcaggagacggaggttgcagtgagccaagatcatgcactgcactccagcctgagcgacagagcaagactgtcaccaaaaaaaggtaatgttagagttcatcaagtacacaagggatagaagggtattttggggacaagaagaaaatgcacaaagacatggagataaaagaaaacttggaaaatttaggaaatggtaggtggttaagcatgacagcatgacagagagtaagatatgtatattaggagatgatgctagaaatatatctaaaaaccagatacatgcaactttatacctaaaaataaaacaaacttgtaaatagtattggactatcacctcacaaaattctgtcattagtaaaacttcttttcacatcaaaaagtatgctcatttcatataaaccaaggagatgacataatcaggataaagatgtactgttttcactctaattcagaggggttatataaagaaacttggatagttaaacgaactgacctgaatcaatcagttcccattttccagttttacatgaacctggctatacaaataaaatatgatatcctgggttaacaaatacaaggacctatattatattatatctattagccttaaacttgacttcccaaaggctaggtatttctagaacatagcatgttaaaatgaaataaacgctagactaggagtcaaaaaacttgaggctctcaaagacagtttcttcatctgtgaaataataatatagtttcctctccctacttcacagggtttttgtatgcatcaaacaagaccatcctctaaaaactacagaatgctattaaaaatgtaatagaaggccaggtgcagtggctcacgcctatagtcgcagcactttgggaggtcaaggtaggcggactgtttgagcccaggaatttgagaacagcctggacaacagagcaaaacactgcttctataaaaaaaaaatccaaaaagtagccaggcatagtgtcgtgcaccagtagtcccagctactcgggtggctgaggtgggaggatcacttgagctcaggaggatgaggctgcagtgaggcaagatcacaccactgctctccaacagcctgggtgacagaatgagaccctgtctcaaaatcaaatgtaatagaggcagtacaaagataaggttaagagcagaggtctggaaccagactacagtgctcaaactccaactcaactacttattggccatgcgagcttgaatacattacctaacctctttggatcttaatttcttcatctgtaaaatatgtacgtgtgtatgtgtttatttaatactacccatgtaaagagtactgtaaggattaaataagttaattcatataaaatgcttattagagtgcctagcacaaggtgaatattcaataaaggttagcttactctagtggtatattcttccacatgagatttttaaatgctgtcctatctaaaattatgatgaaacaaaaaaatgaaaataaaattatgatgaaacaaaaatacccacttctgtcatattacttagatatatacagtgcagaatgaaagaaaacaattttaaactagtgaagtttaaaattgactcatcatataatctcaatgcaataaataatcaacagatcaggaccacaaaataagttcactgacacaatactatgtatttctctgacacaacagaaacacattataacttttagcatatttaatatattctgaatatttggtattttgaccaaaatgcagaataataaacaatatgcattataatcctttcttcaaaagttattggtatttggtggcaccactgctaccacagcctgaactcacaatcctattataaattactctgtaaattatctcatacttgtggctaacaaataccaaccattcctactgcatcttggtcaaagggattccattctacgttctcaggatatcgtgcaaggaccttagatttgaatgttcttctcaatggtgtctgctcaaaattttctcctgtaagaaaaagaatgaagtaaatcatttctacaaaatccctttaagtcacagggttataaatgtctgagcttggtagtccagcaaggtacagaaatgaaggcaagggggttagtatgccaaccatctaagaataaaaataggaaaggcattaaagttattaggtcagtaaagaagctgaaaaagtatagcatggttaatgtcagacatcactagctgtcagttcttcttcaaaatgaaattactactcaaacccaatggttaattttcatgggagagagtgagaaagcacaaggaatgacaaggattgtatctatcttttttttttccctgaaagccacatttaatttgcttaaagtcaactaaaaacatcacagaagcatattttacctaaaattcagaataaactatgcatttcaatgatctctgggaaaaatacaaagaaatgaaaagatgtaagaacattaacgaagcagatttcagggtaaatctaatgagatattctgtcaattcagaattacttgaaatttctggaattgtcctttgttttcccattccccctcctaaaaacactaaagtatattgaaataacaacattaaagtgaagagagaaagaaccaaagaacccaccacctagagggatacaaatctgaaaaatctagtggtcaaaaaaggcacaagaaagttagaaggtcaaaggttacaaaatgccactggagagatatatgtaagaaccattagaaagctttgggtgttctcaattttgttttgtttttaccttcagtcgtacttgaaatgaaagggctggcaccatccctggctttagaagcctgtatgtactggcataatgctatatgataaatgaaataacagagtattacaataaagcagtgttattcaaacttttttgaccattattccagtacaaattacattttacattatgaaacaataaacacatacatgtatgtgtatacataaatttacctaaagcaaaaatttcacaaaacaatacttacctttactatatatataatgtcctctcatatttcctactctatatcattaaaacaaaaaatgctgactgcagacctactaattatcataattcagtttgaaaaacattataatacggtatagtagaacgaagagctcaactgataccaaattactataaagtcactagtgctttatctaaaagtatactatcccaaatattgcttttcctaaggaattagggagtgtgggacaaattaaatgcatataaacagttcaaacaaacaaatctcaggtgtcgggggaacataatcaaggacaattcaagtgaaatctatacctgtttactgagtaatcaagggacttagatattgtgaggaatagagatgaaccagacaaagcacataccctcaatgatctcagtgtcaaatatacaggaaaaagaacatacacatacaaataaccatttcacaggaaggctattatctgggaggctccagatctttcacctacgtggcctaaccattcagagtacacttgcacagggtcctgtttgcgtgtgctagttgacagaataaattctgttacaaatgtagtttttctaagttggtctggaacctaaagggacttgtggttattaaggaaaatgcattcttcactatcacaggatgagatgcacctaagtcagaaaatcctttaccctaaatcaatcccaaaggcacctcaaaagtttctaaaagagaaaagtttataataactctaaggcacctgttccagaaactaataataattccagtcagaaagttactgcttttataactacaatctctcctctattttctctgaggttttgtccatcatcagaagcagcagctcacttattcacaattttcaaattctgataggacccaaccttctttctgttattaaaagcaagtgccacaatttcattcctcttatttcctgatccttcttccaaacaaattcttctgaaactttctttttgagtaaatttcgtccctcaaaatacatttggtaatcttcactaaagactggcaaaaatcagcaggcagctggtaatagctgcagcaacaaggcctacagcttatgtagagctaggctcagagctttctgtaacacctgcagagcccacccatggtaagcctgcacttactgtacaaagtaattaagcagcaagccgctgacataatgatctcgtctacagtctgaaattcttgggatgtatttttaaactgcattcatgtctgaaagaagataactgtttcttcctcctaagcttcttcactttcagttatcagtttgttcatttcttcctaactagccagaaaatcccctcagtaaaaaccacgaaatatcacaacagagagaggaatcaggacaactatcaccgttctctgtaaaggaaagacgccttcctaaaatggctctaggcgtctatggccataaccaccctaaatgcgcctgatctcatctaaaatggctgtaaggagctccctaagacatgacatgcatgtgtgagaagataggaaagctgagtgattaaggggagaactttttaaaagtgagatgaagaatggagccaaaggtgagcatgaccagctgatctgaagtgtggtcaaaagggagagaaaggctatgaatcactggagaagtgattgttagagcctctgtccccaccaccacctctccacatctgccccttctttaaattagctaagggaagaagtcttgttaaagagtctggttctaaataaaggactatacggggtgccaaagttagacaaatgtccttctgtgaattagactggaccagtagcaagagcaaagtattttctccataaggggaaaggagatgtataaagaagtatgagggccctgaaaacaaatcatattctcatttcagccgctctacaaagagtgccagaaaaggtaagagaaggggattcacaaacctaagattttttttagtgaaatgattcactcatcatttacttagggctgagttttaagaataaacagtaaggggctgggcacggtggctcatacctgtaatcccagcactttgggaggctaaggtgggtggatcacttgaggtcaggagttacaaaccagcctggccaacatggtgaaaccccatctctactaaaaaatacaaaaattagccaggcgtagtggcggacacctgtaatcccagctaactgggaggctgaggcaggagaatcacttgaacccgggggatggaggttgcagtgagctgagatcacaccattatactccagcttgggtgacacagcaagactccatctcaaaaaaaaaagagaagaaacagtaggaaaacttaatcctcagaaacacctacataggcccacctcctgaaacctgtgtatcacaggtaccttaaattctcaattatttagacccttggaaattcaaacaatattaggaatatgacatcaccaacatgactgtcctattgtcctagaaacaacgactaattatttgttcaacacatatagattatacaaacatcagcagatccagatataagatctaaagcccatttccaagaacaatttcaaaattagtcaactatgtgtgagtctatctttgtgaatctgcttccaaggaagtacagttcaaatcaatcataacagacttttttttaaagcatacatgccttacaagaacttctaataggttttttatctgttctgttttgaccaagccagaaataaatcgacatttgttgttgttgttgttttgagataaggtcacactctgttgcccaggctggggtgcagtggcacaatcacggctcactgcagcctcaacctcctgagctcaggctatcctcccacctcagcctccagagtagctaggaccaccacgcccagctaattgtttaaatttttttgtagagtcagggtctagctaggttgcccaggttgctctcaaattcctgggcttacgcaatcctctgacttcagcctcccttacaggcatgctccaccacacccagtttaaagacatttttatatctggcctcttgaaggtgatagggaggataatataaagatctgtgaaactacaatgggaaaaaattgattttatcaacagaatattttatgtctagttcatacagattctgcttccagtcatggcagagtagctcccttcagaccaactttcctgcagacaagtatgagcttgtctggagaattaaaaagcaagaagattctcaagtagggaagaaggtcagcacttcaaagaaggtaatgatactgggtgagtttcccttttttatggcttccagtcaggcaagtacctgtctgtcataagaggtgggtaaaactcaaaaactcataatcttactagcttaagaaaccagagggcaaattttaaggcaaaccacagcagctgggaagtgaaagagggagattccagagagaaccacagaagggaagacccaaaaatctgtgtacaaactctgcctacaaacctggctgatccctgaaacacgcatgcatggagaagaccccaagcagccaagttaagggtaaaagaactgaactgaaatttaagttgccacccactacagggaaacagttaacttaaaaataataacaataataataataaaataaaaaaagaatgctctctggagggaggtaacagaatctagttctttacaatccagaactgctcagcatataaagaaacaggaaaatatgacccattctcaagagaagagtcaatcaacagaaaccaaccctgagtttactcaaatactggaattagcaaacaagaattttaaagcagctatgatcataatgaatgaaaaaatagatctcaggccagacatggtggctcactcctgtaatcccaggactttgggaggccgaggcgggaagatcacgaggtcaggagttcgagacaagcctggccaatatggtgaaaccccgtctctactaaaaatataaaaatcaggcgggtgtggtggcgtgtgcctgtagtcccagttactggggaggctgaggcagaagaatctcttgaggttgaggtggagatttcagtaagccaagatcgtgccactgcactccaccctgggcaacagagcaagactccgtctcaaaaaaaaaaaaaaaaaaaacagatctcaacagagaacagacattacaatgcagtgggctggcttaaaagcagattggaaatgacaggagagatactgaccttgaaaaatgaacaacaaaaattatccaatcagaaatacagacagaaaaaaggattaggaaaagaaagagctggctgggcgtggtagctcacacttataacctcagcactttgggaggccaaggttgagaggactgcttgaggccaggagttcaagaccagcctaggtaacacagcaagaccccatctctacacaataaaatgtataaattaaaaaagaaaagggcagcaggagagaggacctcagagatgtgtggggcaacaagtctaacataatataattggagttccagaaggaaaatagaaagaatgaggcagaaaacaatatttgaagaattaataatcaaaattttcccaaatttggtaaaagacaaaaatttacagattcaaaaagctcaatggactccaagcagtataaatgccaataaaataatacacaagtacaccacagacaaacttctagaaaccaatgataagagagaaccttgaaaagagctagaaagaaaggatacacattatattcaaggggaagaaactgaaattactactgccttctcatcagaaacaatgaaggctagaaaacatggaacaacacaagtactgaaaaaaaaacacaaataaataaaaatctgtcaaacccagaattttatgaacagaaaaaatatccttcaaaaatgagggcaaattaaaaacattttcaggcaaaacagagagaattcatcaccagtagacctgtacaggaatgagaaaagccaatcacaacaggttacgtattgtgtgattccatttatataatattcttgaaacaataaaattagggaaacaaagaatggtggggaagggggagagttgggtggttgtggggagaggaaggtagatgggtgtggctataaaagggcaaccccaagaattcttatggtgatggaactctttgataccttgactatatcaatgtcaagttcctggttctgatttttttttttttttttttgagacagagttttactcttgttgcccaggctggaatgcaatggtacaatcttgactcactgcaacatccacctcccaggttcaagtgattctccttcctcggcctcccgagtagctgggattacaggtgcctgccaccacatccagctaatttttttgtattttaaatagtgacggggtttcaccatgttggccaggctggtctcgaactcttgaccgcaggcaatccacccgcctcagcctcccaaagtgctgggattacaggcgtgagtttctgataatatctatatagttctgcaagatgtcaccaataagggaagctgggtagagtgcacaggggatctctctattatttcttacaattgcaaataaatctataattacctcaaatttaaagtttaacttaaaaaaaaaacaccttttttttaatggttctaacaacctctcagggtttttaaaacagaggctgcaggcaatatatttcaagcattcaaaactatactgtgggcagggtacggtggctcacacctgtaatcccagcattttgggaggccgaggcgggtgcatcaactgaggtcaggagttcaagaccagctgggccaacatggtgaaaacccatctctactaaaacacaaaaattagccaggcatggtggcaggtgcttgtaatcacagctacctgggaggctgagatggcacgatcgcttgaaccctggagatggtggctgcagtgagccgagattgcaccactgcactccagcctgggtggctgagcgagactccgtctcccaaaaaaaaaagaagaagaagaagcagtgagccagggaggggacaagggaacctctcctgtttcagtatcacatagactgcctcaacttaccatatcaacaacaatcctataaggtctatttcatattatctgtagatcatctgcagcaagagtgatgaaattctttcctctgcgaatgcatacgtctaagttaatatgctatcctttgcatattggcattctgggatatactaaaattgatactactggtgaccaaccacggtcatcaactgagtgtcgtccatgctataatcagtttatttcccacactaaaagatggcactgtatctttcctgttataaacacttgtgaaatagactgcccaatagcatagtactgctaccaactcacacttctattttttgtgcatgttgagagccaggttgttttgtcttcaactctctggctgctccagcatttcaattctccctatcttccacataatttctgaacccctatacaaatcagagggcatcacctgtctgatggcagggcacaatgtaggaagggaagagattacacatttctaattaaatgagaattaaccttatcattacttttattaatagatgactttcattactatcagcactttttaaatagagacaccttaaatacaggcacacatacacaataaggactgcagagctttggaagctatcactcttccttatctcttcttcacatgaaattgattttacaactcctacaccgtaaagaaaagaaggtaactgttccttgaagagacaggctgtaacttggcccacatcaccagctgactgtgatgctcaggagtcagacattcacaagtaagtacccagaatacaagcagtgaactgtccactgccccccaacccccacccacaagacttttttgttttgttttgtttttttgagacggagtctcgctctgtcacccaggctggagtgcagtggcacaatcttggctcactgcaacctgtgcctcccaggttcaactgattctcctgcctcggcctcccaactagctgggattacaggcgcctgccatcaccctcagctaatctttctatttttagtagggatggggttttaccacattagccagactggtctcgaactcctgaccttaagtggtccattgtccaccttggcctcccaaagtgctgggattacaggcatgagtcaccgcaccagccccgcaggccacttctaagtcctcttccaaggcactaacccaggaaagctgcttaccaggcttttcaatgtaaatttaagagaaaccctgttactcctattttctcaaggcagatttgttcactctctttctcaatacatttactttgtcagatagttttaggtttgtatacacagccattatttttattgatgttttgcctcctgcttaacatcttccaggcaccacacatgatccaactcatgtacctagtatttctaaaatggctgaacttcttatgtgaccagttttagagagactaggtttgagagcctatccagtcaggactgttccaaactgcatctaggacaaactgaaagcacttttgttcacattgccttccttttagcccagccgaatgccctgcagagcacacatctgtcaggtaacacctggaactcacattatttcctgtttagtgggtgatgcaaccagctgtccaattcatggtcttttagaccagtctaagaaacccaatcctgtgttctttttttttttttttgagatggagtctcgctctgtcgcccaggctatagtgcagtggcacgaactcagctcactgcaacctccacctcccaggttcaggcaattctcctgtctcagcctccctagtagctgggattacaggcacacaccaccatgcccagctaattgtttttgtgttttagtaaagatagggtttcgccgtgttggccaggctgatctcaaacccctgacctcagaagatccgcccgcctcagcctcccaaagtgctgggattacaagcgtgagccaccgcgcctggccgttcttttatataattaataagttagttagatgtatacgcacactcttccaaatatagtgagctcccagaggctacacaggtaggtacacatgcacctttctctaaaagctagcccctccagaaaattgggcttaagcaaacccatttctgtaactaaaaagtggcaaaggccaaatgtgaacaagggtccccatgctctcctcaataccaaattttaatgtaatcagcctaaattaagtctgagcaactagtcaagaaggcaggagacaggattaaggacctaacttggctacttactaattgtatgacattaaacaatttactgagtcttgtgagtctcattttcttcacctgaaagatgaagtatatgactagctgctcatctctaaaggtttttccagcttggtcattccatgactattgggcctagagcctgatacagcatgggaatcccaccttttaaactttcagtgaaagactgagggctgaaggtatgcattagctcttcctcagctacctctctctttccaaaaccttgctaaaacaatggaggatggggagtggcataaacccacaaaatcagagtgaaggtaatagtaacaacattttagaagctgaaaagctgatggatgaatggttaccaacagtaggcttgagaaaggctgagatacaacgtaacctccaaaaagctcaggaacttatagcattaggcacctttcaaagtggggataaagatggagctaaaaacaggaggactaaccgaaagcctgtttaagaaccagcagggcaggggactgtggctcatgcctgtaatcccagataatcaggaggatggcttgaggccaggagctcggaaccaacctggacaatgtaacgagatcctgtctctacaaaaaatttaataattactagtctggaggctgaggtggagggattgcttgagcctgggagattgagctgcagtgagctgtgatggtgctactgcattccagcctgggtgacagaacaagagcctatctcaaaataataataataataagccaggcatggtggtatgcatctgtagtaccagctattcaggaggctgtggtgggaggatcacttaagcccaggagtttgaggctgcagtgagctatgatcacactactgcactatagtctgggcaacagagcaagatcccatctcaaaaaaataaatacgaaagaatcagcaggcatcagctgatgaacagatgaatgaaatgtataataatacaatggaacattattcagccataaaaaagaatggtgtactgttacatgctacaacacagatgaatcttgaaaacatgccaagtggcttaagatcacatactgtatcattccatttatataaaatgtcctggccaggcgcgatggctcatgcctgtaatcccagcactttgagaggctgaggcgggtgatcacctgaggtcaggagtttgagaccagcctggccaacatggtgaaaccccatctctactaaaaatgcaaaaattagccaggcgtggtggggcacacctgtagttccagctactcgagaagctgaggcaggagaatagctagaacccaggaggcagagggtgcagtgagccgagatctcaccactgcactccagcctgggcaataagagcaaaaattccgtctcaaattaattaattaattaattgcccagaaaaggcctacgtatggagacagaaagtagattagtgtttacctgggatgaggggatacagagtgactgctaattagtacaaagtttctttttaaagtgattaaaatattctaaaattaaattatggtaacgattgcacaactctgcaaatacattaaaaaacagaaattgtatactgtaagcaggtaaactaggctatgtaaagtatatcttcataaagtgatttaaaaaataaaaggacaaacaacaaaagaaatttggcatgctagtaaaatacagtctcctactgtcaaagcatgtgtcatttccaacaaagtatcttttcccacacacaaaaattattatcacagataaaagatatgcagagataaaagatgacattgtatacataaaacaagaatagactgttgttttaaaagaatattcagaaaataaaacaaggctgggcagtggctcatgcctgtaatctcagcaccaaggtgggtagagattgtttgagtccaggagttcaagaccaacctgggcaacatggcaagaccccatctgtacaaaataataattaaaagattagccaggcatggtggtgcccaccagtagtctcagctactcaggaggctgaggcaggaggactgcatgagctcaggaggcagaggctgcagtgagctgagatagcaccactgcactccaggctgggtgacagagcaagaccccgtctcaaaaaaataaacaaaaaaaaaacaagcttgtggaaattaaaatggtgtcagaaaaatttaaaactcaacagaagagttagcaaatagatttgaggaaatatcctcagaagtaggacaaaataaataaaattagagaaaaaatagtaataaaattagtctgggtacagtggctcatgcttaggctcagctcatgcttaggcgggatgcagtggctcccagctctttgggaggccgaggggagtggatcacttaagcccaggagtttgagaccagtctgtgcaacatggcgaaatcctgtctactaaaaatacaaaaattagctgggtgtggtggagtgtgcctgtagtaggctgaggtgggaagatcgctagagcccgggagatgaaggttagagtgagctgtgatcgtgtcactgcactccagctgggtgacagagtgaaactttgtctcaaaaataaatgtattgggccggcgtggtggctcacgcctgtaatcccagcacttcaggaggctgagacaggtggatcacctgaggtcaggagtgcaagaccaagctagccaacatggtgaaaccccacctctactaaaaaaataaaaattagccaggcgtagtggcacatgcctgtaatcccagctacttgggaggctgaggcaggagaatcgcttgaacccgggaggtggaggttgcagtaagccaagatcgcgccactgcactccagcctgggcaacaagaatgaaactccatctcaaaaaaataaataaacaaataaatgaaataaatttatttatttatttaagaaataataaaattagagtccatccaagaggtctaaaacccaaataaaagtataccataaaaagcgaagagaaaaaataaaggggaggaaattatcaacaaaataataaagtttcccagaaatgacaggcatgaacttccaaactgaaagtgctcttcaaggatctagcacaatggatgaaaacagacccacaccaagacacgtcatgatgtaatttcagaatgccagggacaatgagaaaattctagatgtttccaggaagaaacaaatttaccaaggaaagatatctgaatagcactggatttctcaatagcaacactggaatctagcagacaatgaggcaatgtcctcaaaattctgtgggaaaattatttccagttagaattatatactcagccaaataataagagagtaaaagaaagaaatttcaaacatgtaatctcaaaaaaagaatgtattttctatgaatcctttctcaggaagcatatgctctgccaaaacgagaattaacaaaaaaaaacgacttacatatgggatggaggaaactggagccatcacgagaaagtgacagaggataactccaagataaggtgaggggacatcccaagattttagtgcaataggcctggcaggccaacacctcaaataatccagattgatggggctcaggcaagaatccacagcttgcatcatattttccaagggatctgtgagccaaaaaatactttaagccactgctttaaggtgtccattacaggtcttgcacaagggacaaaccacaacagacttctataacaaaaagaaatttttcagatgttgcaaatctcagagacaaagaatgtggagtaatgcagtagattaacacattttttctgattggatatcatcatttagaaagaaaggaaaggggctcagttaaagcactctagaagcccagggaatttgattcaaatgaagcttaataccttactcctcaaaacattctgaagagagattggttttgttttgttttttcaatttgtgatttatgtcccacctatgtcaaaaaacaaggtggtatataagaaaaatcatactaaaaaattaaagcaggacaaagaacactaaaagcaaaaaaaatagatgtgcttaaacgcctgtggcataactttcttataaattgcaaaaaatgatagtttgcttgcaatgtatgatatttaaaaataattcgggccaggcacagtggctcatgcctgtaatcccaacactttgggaggccgacgcgggcagatcacctgaggtcaggagttcaagaccagtctgaccaacatggagaaaccctgtctctactaaaaatacaaaattagccgggcgtggtggcacatgcccgtaatcccagctacttgggaagctgaggcaggagaatcacttgaacccaggaggtggaagttgcagtgagccaagatcatgccattgcactccagtataggcaacaagagcgaaactctgtctcaaaaataataataataataataataataattcaacatggaaaaaaatatgaatgaaaataccggccgggcacaggtggctcacacctataatcccagcactttgggaggctgagggggttagattacctgaggtcaggagttccagaccagcctggctaacatggcaaaacccagtctcttctaaaaataaaaaaattagccaggcatggtggtgggtacctgtaatcccagctactggggaggctgaggtacgagaattgcttgaacctgggaggcagaggttgcagtaagctgagatcgcaccactgcactccagcttgggcgacaaagcgagactctgtctcaaaaaaaaaaagtgtgtgtgtgtacacacacacacataaattagccaggcatagtggcgggtgcctgtagactcagctacttgggaggctgaggtgggaggactgcttgagcccaggaggcagaggttgccgtgagccgagatggcgccattgagctccaacctggatgagagagcaagacactgtctaaaaaaagaatacaaacccaaaaaacaaaaaactttggtatcagaatcagagattaaaacattcaatcggctggacacggtggctcacgcctgtaatcctagcactttgggaggccaaggcaggtggatcacctgaagtcaggagttcaagaccagcctggccaacatggtgaaaccctgtctctactaaaaatacaaaaattagccgggcatggtggcgagtgcctgtagtctcagctactcaggaggctgaggcagaagaatctcttgaacctgggaggcagaggttgtagtgagccgagatagcgccacctcactccagcctggatgacagagcaagactccatctcaaacaaacaaacaaacaacagcaacaaaaaaaacactgaataggtcccaacccattcagtgctggcattacaggcatgagcaactgcgcctggcctggctaatttttgtatttttagtagagatggggtttcaccatgttagccaggctggtcttgaactcctgacctcaggcaatcggtctgcctcggcctcccaaactgctgggattacaggcgtgagccaccgcgcccagccaaccccatgtatatttctagttattacaaggaaatcagaagttataattgccaataatgtcttcaactaattgagaattttgttgttgttgttgttgttttcttttttttaagatggagtcttgctctgtcacccaggccggagtacagtggtgcgatcttggctcactgcaacctctgcctcccaggttcaagtaattctcctgactcagcctcccaaatagctggaactacaggtgcatgccaccacgcccggctaattttttatatttttagtagagatgaggtttcacagtgttggccaggatggtcttgatctcctgacctcatgatccgcccaccttggcctcccaaagtgctgggattacaggcgtgagccactgcgcttggcaagaatttttaatatccaattataattttacaaatgcaggggtcttttaagaggacatgagctttttctaacattttatcataaaaagtacaatgaactgccatgtatctatcacctagctttagcaattatcaatgcatggctaatcttgctttacttgtatatcctcatgccagattattttaaagcaaatccaaacatatcattttatttataatatttcagcatgtctctctaaaagacagtatcttttttaacataacctcaatactattattatacctagaaaaatttgaccaaaaaaatcctaatgccaaaaatctagtcagtgttcaaatttctttagtttattcataaatgtttgaaaccttttagatcactaagtagacttaaaatactgtataatggcctgtaatagtaaaagaaaaatttaatgtttccaggaacttttttatatgaagttgcttaagagcattagaagaaaaaaaggcaatttttccctataaatacaccacagaaaaattagaggaacttcaggtctgacataagatcagagaatagggataaatagagccagacataagatcagagaatgcagatgaatagaaccagatacgattttcaaaatatttaacaatctgggcagtgtgagcaccaaccaatcagaacaaacactagccatacacatatggcatataggctagatatcaaccctggatacagccttgactgaggaaaagcaaagaggcctcaagaacgtgctttccatgctgaaattcaacgctgcctgcagtggagcaataagctgcaactacatcagttagaagcaaagttgccacaagctcttgctatagcctaccttctaccagacatagctattaactgctaaatcactatagctgtaactgatcatccctgcatctatcatttgaactagtcaaagaaagaatcctttttgaagcaattagcatggtaaagtagaaagagttcttgattgtagaatgatctagaatacaagctgcttgtctctgaaagttaaaactgtaatagccggctgggcgcggtggctcatgcctgtaatcccagcactttgggagctgagacaagaagatcacttgagctgaggagttcaagaccagccgaagcaacatagcaagacatcatctttaccaaaagaaaaaaaaaattaaggctgggtgcggggtctcacgcctgtaatcccagcactttgggaggctgaggtgggcagaataggccaaggcaggcggaggtcaggagtttaagaccagcctggccaacatggtgaaaaccccatctctactaaaaatacaaaaattagccaggcatgatggcaggtacctgtaatcgcagctacttgggaggctgaggcaagagaaacacttgaacctgggaagtggaggttgcagtgagccaagatctcaccattgcactccagcctgggcaacagagcgagactccatctcaaaaaaattaattaattaaaaaaattaaattagcagggtgtgatggcaccacacctgaggtcccagctacttgggaggctgaggtgggaggattgctcgagccagggagactgaggctacggtgagctatgatcacaccactgcactccagtctgggcaacagagcaagcaagagagaaaaaaagcgtaacatctgacagtggtacctgggaatgttaatatccttcaacctattgcctgtaggttacagcttttccaataaattatttagcttgctaaagaatataaaagatagtcctctgtgattgttatttagaatcctttcataaacagagggcatgccctgaccatttaaaaataaacctagaacggtcaggtgtggtggctcatgcctgtaatcccagcactttgggaggccgcagtgggcggatcacctgaggtcaggagttcaagaccagcctggccaacatggcaaaaccctgtctctactaaaaaaatacaaaaattagccaggtgtggtggcgcatgcctgtaatcccaactactagggaggctgaggcaggagaatcgcttgaacctgggaggcagaggttgcagtgagccgagatcacgccattcactccagcctgggcgacagagcaagactccatctcaaaaaataaagtaaaataaaacataagcctaaaacaacatgcctaaaggaagggaagaaggagagaactcttgaagggaagtgagaaagcttgggggtctagcatgattcaacatatctcaagccttacgcaaatcactttatcttcctgggctccagtttctccatctgcatataaggcacctgccaacattcctagtctcacctcccaacacctgctttctccctctaatacattgattcacttgagttccccaaacagggcatgctttttcgtgctttcattctttgttagatgttattctctgcttagaataacctttatacccttcttcacctgattagccaatctacttttattcaagtgagtgctatgaaaatccatggtgcccagtgcggtggctcacacctataatcccagcactttgggaggctgaggcaggcagatcacgaggtcaggagttcgagaccagcctgactgacatggtgaaaacccgtctttactaaaaatacaaaaacagccgggcgtggtggcgcgcgcctgtaatcccagccactcaggaggctgaggcaagagaatcgcttgaacctgggaggcagaggttgcagtgagccaagatcgcgccactgcactccagcctgggcaacagagcaagactccatccaaaaaaaaaaaaaaaaaaaatccacagtatcccaacgttttcattttcccatccccaagttcttctggaaattttctgtgagtgctagggtcagagccatttactggttataaaacaaatctgctcctttgaatgtagttcatatgacatggttttcagttccctcacaatcctagtccctagaaccgacgtctaactctatgtgtaatctaactacttaataacacaatttaaaacaggactatccactccctcttttttgacaatgtatctctagaattgcaactaaaaatcacaatttttggcaactaaatcacgcttttgccataaatcaaactcgcagccaactaaaagtgttacattttttaaaaagtgttgatattagctcacatcttcttcctataacctctacttctgcatcatttatttcatcatatagcttaaatttctctcttattcccaactatatcctagtcattcctgtgaaacattcttgaatccaaaaatggtagctcacagtattccccgttctatccatgtactcacctgaatgaacacatggttagtgtaacctaacatattcttagtgggcagatgttggctcttaataataatagttttggggcgggcacggtggctcacgcctgtaatcccaatgcttgggaggctgaagccagccgatcacttgtggtcaggatttcgagaacagcctagccaacgtggtaaaaccctgtctctactaaaaatacaaaaaaaatcagccgggcatggtagcacatacctataatctggctactcgggtggctgaggcaggggaatcacttgaacctgggaggtggaagttacagtgaaccaagatcacgccactctactccagcctgggcaacagagcaagactctgtctcaaaaaatatatataagtaataataataacaataatagttttggccaggtgccgtggttcatgcctgtaatcccagcactttgggaggccaagttgagtggattgcttgagcccaggaggtcaagaccagcctggacaacatagcaagaccctatctctacaacaaataaattagctgagtatgttggcatgtgcctaggccccagctacctggaaggctgaggtgggaggactgattgagccagggaggtcaaggctgcaatgagctgtgctcatgccactgcactccagcctgggcaacagagtgagaccctgtctcaaaaatcatcatcatcatcattatcatcatcatcatcaccattatcatcaatcaggtctttttctaaaccctcagattatatcattaataagctattctagattttgactggaacatgtcatgctgttaccttcttcccagttttgagattatgtcttcttgtggtaattctatgattcctcaaaggttattgacatctactgaatgatctcatcccaaaattatctagaaccctacggtataatttgtctgggtcaggagactctcattcagagcaattaaatgatcctgtataaatgagtaatgatctcaatttcagtctcctcttaatcgatttgttctatcctttccaatctatatataatttaccttgacaatgggaaaaaaaagtttctggggctatttcaatcttcaaggttttttgtttttgtttttgtttttcaaatgtggttatttgggatttcacatttagagtatcacccaacataaaatactcttcttgaagaattatttaacacaataaagttttccttttttttaaattcataaaactgtaagaggaagcagagatgctaattataacagagctcttcttaccacagtggcaaaaaccaaactgaccgatctaaagtaagctaaacaagagttgtgaaaattaacatacttccttaaggtgaaaatttccccataattcatcaccatgtcctacaaatattactgaatgtgcaagactcaaaacaattcacccaaaacctcacatcatactcacaccctgtcaataaatccaagctatgaaaataagcacaaggacgagagtggtgactcacacctgtaatcccagcactttgggaggccaaggcgggcagatcacctgaggtcaggagttcgagaccagggtgaccaacatggagaaaccctgtctctactaaaaatacaaaattagccgggcatggtagcacatgcctgtaatcccagatactccagaggctgaagcaggagaatcgcttgaacccgggaggcagaggttacagtaaggtgagatcacgccattgtactccagcctgggcaacaagagtgaaactccatctcaaaataaataaataaataaataaataaataaataaataaataagcaagcaagcacagagtgatattttctccactcaatcaccatgggacttataaagaccttatctaccccacattgagccgttttgctacattattacattacgatcactcaaacaactaatccatcacttttctattgagttccaactatctatacaactccatgttaagtgctatggaaacatacaaatttataattaaaaaccagtaactcctggaacgcatgagcacattttagtaaatgtgtacctccttctctaggcaaaggagtcccctcaaatctgaaagggcatctcatccagatgaagctgggaaggtagtgcagtatattctgtgttacatacactatagtggaaggcacaggactttaaagacaggaaaatttagaactcaaatattagttccatgttttgtttaatttcttctaggtaacttgtccaaggtctctgtgaaaaatgcatatttgggccaggtgcagtggctcatgcctgtaatctaacactatgggaggccaagatgggaggatcacctgacgccagttcaagaccagcctgggcaacatagcaagataccatctctacaaaaataaaaaatttaaattaaaaaaaaaatgaggccaggcactgtggctcacgcttgtaaatcccagcactttgggaggccgtgggggcgggtggcgaatcacgaggtcaggggttcgagaccaacctggccaacatggtgaaaccctgtctctactaaaaatacaaaaaattagccgggcatggtggtgcatgcctgtaatcccagctacttgggagcctgaagcaggagaatcatttgaacccaggaggcggaggttgcagtgaggggagattataccattgcactccagcctgggcgatagcaagactccatctcaaaaaaaaaaaaaaaaaaaaaacttacatttggtcttagtccctggttactggcatgcagctcctaaaacctttggaatctcccagatgagcacagcgtttgtatgctaatgacatgactggtgaccagggccactaatttagtggcttaatacctactaaatagcttaagctaatagcttaaggatggtggctggtcaccagaaagaccaaggatgattacaggattgaaactttcagctccccaccaccacctgcagagaggagagagacgctgaagtgagttaatcaccagtgagcaattatttcaaaatcgtgccaacacagtaatgaaaactccactttgaaaacccataaggccaggtgcggtggctcatgcttgcaatcctggcactttgggaggccaacgcaggtagatcacctgaggtcaggagttcgagaccagcctgaacaacatagtgaaaccccatttctattaaaaatacaaaaattagccgggtgtggtggcatgcggcagaagaatcacttgaacccgggaggcagaggttgcagtgagccgagatcgcaccactgcactccagcctgggcagcagagtgagacaccgtctcaaaaaaaaaaaaaacataaacaacagggttcagggaccttctgggttgatgaacacacttaagtattgcagaatggtgcactcagcgtgagcacgaaggctccacacacacatcttgccgcaaacttgccccatccatctcttccacttggctgttcctgagttatatcctttataataaatgggtaatagtaagtaaagtactttccagagttctatgagccattctggcaaattatgcaaacttaggaaggggtcatgggaacccctgacttatagcaggttggtcaaagtacagacgggcggcaatctgggactttactggcatctgaagtggggacagtcttgtgagactaagcacttaacctgtggagtgtgcactaagcctaggcagttagtgtcagaattgaactgaattggaaaaaaataataataacaattgaattgaattgcaggacacccagctggtaaccagagagttacagaattggttagcatagtgttagattacaggcatgagccactgcgcctggcccaaatatgcatttatcacagagaccttggccaagttacaaatgtggggaaaaaaccacacatttggtgtcagaggtgtaatgcatggtattgaggctcaaaaaatgatacccctaagtaagacaccttgacatgctgagtattatgaactaaaggagaccggaagacctcagaaatagcctcagaagcaaagtctctccttgccctcctgtctcactcctcttactcccccaaagcaagtcatagaaaccagaatccccctttccccaaggcgggtcacagataatagaaaagcaagccataatacctaaaaagtattacctcctactcaaacatatacctctcccccaaagtaagccataatacctaaaaatgtcactctctccccttttccttgaagaccctcagctccagcggggtcctgccctatacccaggaagaaggaatgctgcacagagtccaagaagaatctgaacagacaggccttgctgggtccccctgccccacccagtctattaccattagataacaccctttgtctactaacatttctacaggcctctccctttcttcattcttcattgagcctaagcataaaaacagttttccctaggtctttgggtcttcatttctgaaagctcccatttctttttttttttttttttttttttttgagacagtcttgctctgtcacccaggctagagtgcagtggtgtgatctcagctccttgcaagctccacctcccgggttcacgccattctcctgcctcagcctcccgagtagctgggtgggactacaggcgcctgccaccacgtccagctaatttttttgtatttttagtagagacggggtttcaccgtgttagccaggatggtctcgatctcctgacctcgtgatccacccgtgtcagcctcccaaagtgctgggattacaggcatgagccaccgcgcccggccccatttcatgtaaaactaatgctttttttttttttttttttttttttttttgagacaagtctcactttttcacccaggccaaagtgcagtggtgcaaacagagctcactacaatctcaaccttctgagctcaagcgatccacccaccttagcctcccaagtagctgggactataggtatgctccaccacgccaggctaatttttaaaaattttttgcagacaggttctcaccgtttttcccaggctggtctcaaactcctgggcttaagcaatcctcccagcacagcctcccaaagagctgggattacaagtgtgagccacacccagcctcttatgctttcttcttgttaatttgtcttttgttgcagaagtgtcagccattgaaccttaagatgggtgaggaaaggtatcacatctttctgcccttactgtagaaacactaagggcatcttttccataaatctcaatttcttcatctataacatgaggagaacaatacctaagccaggcacagtggctcacatctgtaatcccagaattttgggaggccaaggcgggtagatcacctgagcctaggagttcaagactagcccagacaacatagggagaccggtctctacaaagaaatagaaaaattaggcatggtggcacacatttgtagtcccagctgctagggaggctgagatgggaagatcacttaagcctggaggtctagactgcagtgagcagttagcgtgcactctagcctgggtgacagagcaagaccctctgtcaaaaacaaaacaaacaaacaaaaaaaacccaaaaaactacctacctcatcagcctattgagaggaatgaatgagttaacatatgtaaagcatatgggacacatttgtattgagcataagaggtactcaacaaatattagctcctttctttccaaaaggtctgtcatacatgcaagagttatctcaaaatctttagccatgaaaacaggacacataaatgtgctagaagttaccaaatgtttcctaacatgcaaacctctactgcactaaagtggcaacacatatctgtttcacagaatgtataccacggcagagcccacagcagcaaacgtggctatactaagaacactgacaagtccgcaaattcagatttcaaaccacaacttataagggaccacccagcagcctcttcttccccatagcacataagcagatttaagactctgggagccaggctgggcgcggtggctcacgcctgtaatcccagcactttgggaggcagaggcaggcagatcacctgaggtcgggagttggagaccagcctgaccaacatagagaaactccatctctactaaaaatacaaaagttgcagggagtggtggcgcatgcctgtaatcctagctactcaggagactgaggcaagagaatcacttgaacccaggaggcagaggttgcagtgagccgagatcgcgccattgcattccagcctgggcaacaagagcgaaactccgtctcaaaaaaaaaaaaaaaaagactctgggagcttcctgttagtttaccctcagtaacataagagaaagtttcctttacttttaagaacttttatagtaataaattctctctctttttttttaacagactttcctaaccactaaaattttaccaactggtactatatcaaagcacaaagactagcatttgttttatcaaatctgcattaaaagcactgtattggtcatatcaaagcctttttgtacttcaggcccagctgtgacagcaatggtaatgtttctctttcacttgcagaatgctgaaaaacggccaagaaaaaaaaatggggaagctttttttcaggcagtacagagtagtgttaacagcagactgtttaagaaaattaattagccctaggactgtagatctaaatatgaaaggtaaaaaaataaagcctttagaagaaaacacagaacatcttcatgatcctgcaataacaaagatataaaatgcactaaacattaagagagaaaaacgtataaattgtacattacaatttaaaacttttgttccttgaaagtcgccattaaaagaatgaaaacgcacagattacaagaatatatttgcactatatatatatgaaatgaacaaaaaagacatatctagaacatataaagaactgcattaaatcaataaagaaaaaaagatcactcaaagaaaaacagcaaaagccctgaatagatacttcaaaaaagacatataaatgcctaataaacttttgagaggtgctcaacttcattagtcatccagaaaattcaaatttaaataatacaatactattatataaccaccagaatagctaaaatgaaaagaaaatgccaagagttggtaaggatagggagtaacctacactgtcgtgcactgcaagtgggaatgtaaactggtacaatcactatggaaaactgtctggcagcacctactaaagctgaacatgcgtatacctatgacccagcaattccactcctgagcatatacccaacagaccaaaagccatgttcacgaaaaggcacatacaggaatgttcataacatgtcactattgtaatactcaaaaactacaaactacccatgagcctatcaactgcagaattaacagataaggtgtggtaaagtcacacaatggcaaactctacagcagtgagaacgaccaacctaaaactatacacaatatgaatgaacctctcaaatatattgtacaaaagaatccaaacacaagagttcaccatatataattacatttatataaagtacaaagacatgaaaaactatgctgttagaagtcaaaatactggttacctgtggtgagtgggaaggcaaatagtgactgaagtagactacttcttgctcacatcctaagaaattcaagacagccagtcgcaggggctcacgcctataatcccaacactttgggaagccgaggcaggcggatcacgaggtcaggagttcgagaccagcctggccagcatcgtgaaacctcgcctctactaaaaatacaaaaattaactggacatggtggtgggtgcctgtaatcccagctactcaggaggctgaggcaggagaattgtttgaacccaggaggcagaggttggagtgagctgagatcgcgccattgcactctagcctgggcgacagagcgagactctgtctcaaaaaaaaaaaaaaaaaaagaaattcaagacccaccctttagaccctctggagtgggttgaatggtggccccaaaaaaggtatgtccacatcctaatctccagaagctatgaatgttatcttacttggaaaaaggatcttacagatgtagtcaaaaatattgagatgagatcatcctggagtagttgagtgtacccaaaataccatgataggtatccctaaaataatagacacagaggaaaagatacacatgaaggtgaaggcaatgagaagacagaagcagcgattagggtggtgtagtcagaaaccaaagcataatgccaacagtcaccagaagctcaaggaattattctccccaagagcctctgagggggtgtgccctgctgacaccctgattttggatttctgtcctccaaaactgtgagaaaataaattattgttgttttaagccacccagtttgtggtaatttgttgccacagccacagtaaactaatataggctgggtgcagtggctcaggcctgtaatcccagcactttgggaggccgaggtgggtggatcacttgaggtcaggagttcgagaccagcctggccaacatggtgaaaccccgtctctactaaaaatacaaaaattagccgggcatggtagcacatgcctgtagtcccagctactcgggaggctgaggcaggagaatggcttgaatccaggaggcggaggctgcactgagccatgatcgtgccactgcacccccagcctgggcaacagagcaaaactccgtctcaaaaaaaaaaaaaaaggcaactaatataccctccaaaccacattcctttactcaccccaattctgtagcaaactcaccagctttcctaagaaagagagattcaaaagtgcccaaacctcaatctttcccaccgatcccccccccaaaaaaatgagcaaaaagagaaattataaccagtatacagacaattcacaataccaatataaagaatgagta

SEQ ID NO: 150 - DNA, 357794 bp, Homo sapiens
gcatccattagtttgataaaagttaattgtaaaatgtgaaaaaaaaatcagtgcccaccaacatcatttttcaatatcttctcctttgattacataattggcttaagcttatactctaacggggttgtttttttatttttcttttccaaaaagtagtcatgagaatggtattttaaaagttcttatctgttttaaaaatagctttatcatgagctttggcttgaatgaatgttgactgcatgtttaagtcaaactttgctttaagatttcaagcaggcctggtgcagtggctcacacctgtaataacagtgctttgggagatccaggcaggtggatcacttgagcccaggagttcaaaaccagcctggccaccatggggaaactctgtctctactaaaaatacagaaaatagccaggcatggttgtgcacacctgtagtcttagctacttgggaggctgaggcaggagaattgcttgagccagggaggtggaggttgcagtgaaccgagatcatgccattgtactccagcctgggcaacagagtgagactctgtctcaaaaaacaaacaaaaacatttctatcaaatgacgttaagtagaaatctgtgggtggcttgattgttctcatttatagatgccttgatttgccgatttttgcccacagaattatttctcagtctttgaaatatattcccaaatgtggcacatcctgaatcagttcttgaatcacattgtgacttttaatttatttttaattttatttaaactaaaaaaaatctatttagtgggtacaagtgcaggtttctgaaaagcatgtgtcgtgtagtggggaagtcggggttcttagtgcacctgtcacccaatagtgaacctcgtacccaacaggtaattcttcaacctccacctccccacccttctactttttgtgtctcaatatctattcctccactctgcgtgtccttgtgtacacatggtttagcctccacttatacgtgggaacacgcagtatttgactttctgtttctaagttatttcagtcaggataatgcccatcagttccatccatgttgctgcaaaagacatgatttcattcttttttatgacattgtgccattttatttggtagactgaagcataccttaatttaaggaaggttttttgtcttctgctttgtttgtttgcttgttttttgagacagggtctcactcttgttgcccagggtgcagtggaggttgctcactgcagccttgacctcctgaactcaaaggatcctcctgcctcaagctcccgagtagctgggactataggcatgtgccaccacacttggctaaatgtaattttttgtagagatggggtctcactatgttgcccaggctagtcttgaactcctgggctcaagtgatccgtctgccttggcttctcgaaatgttgggattacaggtgtgagccactgtgtgtggctggagagtttttttcaagttcttgacatttattctcttgcatttattcttgtcttttttgtttgtttgttttttgagactgagtctcgctctgtcactgaggctggagtccaatggtgcgatctcagctcactgcaagctctgcctcctgtgttcaagtgcttctcctgcctcaagcctcctgagtagctgggaccacatgcacattccaccatgcctggctaacttttgtattttcagtagagacgggggttttgccatgttggccaggccatgtttgccatgttgccactcctggcctgaagtgatctgcctgccttggcctcctaaagtgctaggattacgggtatcagccaccgcgcctggcctattcttgtctttgacttatacatctttaatttggctttaaaatgctcttaaacattttgtcctttgctctctcttttgctctgtttctcaatcatgttctccaccacactgaatgacgacggagtggagtctgtttttcttttgtgctgcttttattgtgatcttcatttctggagactctctccctttctttttatctgagtttgtcgctccatcatttcatctcctttgcatcagattgcctgtgtcgtccaacccttatgtttctttttcagacccttacatgtgatagacaagacattctgtaaattctttcatctcacagagaactagttcttcccaattgtattagttttctatgtctgccataagaaatttctacaaacttactgtctgaaaaaccacaaaagttataatcttacagttctgcaggtctgaagtaaaatatgggcctcactgggctaaaatcatggcactggcagggctgcgttcctctctgggtttcaggggagattctgttcccctgcgtttcctgcttccagaggcttcccttattccttagctcgtggcccttttcatctgagtccttcacacgtcacatccctctgaccctccttttaccttcctctttcccttgtaaagacccttatattcgggtccatagattaggctcacctggatggtccgggatactctccctaccttcaggtcagctgattaacgaacttaattccatctgctgccttaactctccttagctgtgtgtcttcatctgttttatgtggctatcacagaatggcacagccagggttatttataatgaacagaaatgtatttggctcatcattcgggaggtctgggagactgagcgcacagtgagcaaagtgccggcatctggtgagtggcttcatgctgtgtcatcccatgacagaaggcagaaggggcagagagggcaagagtaaaagcaagagaggctgaacttgcttgtttttgttttggttgttgttgttttaagagacagggtctctctctatcatccaggctggagtgccgtggcacaatcacagatcactgtagcctggaactcccaggctcaagtgatcctcccactttggtctcccacatagctgggatgataggtgtgcaccaggctggtctcgaactcctggcctcaagtgatcctcctgcctcagcctcccaaagtggtaggattagaggcatgagccactgcttttataacagaactattcttgtaataatgaacccattccctggataatgacattaattcattaataagcgcagtgtcctcgtgagctaatcacatcttatgaggccctcaccttccaacaccattgccttggtgatgaggcttccagcacatgactttgtggggggcgcattcaaaccagagcaccatgtcacatcatgagagcgccatgtcacatcatggagtgccacgccacatcataagagcaccgtgccaagtcatgagagcaccacgccacgtcatgagagcgtcacgccatgtcatgagagcactgcgtcccttcatggagcgccacaccacgtcatgagagcgccacgttacatcatgagagcgccacgttacatcatgagagtgccacgtcacatcatgagagcgccacgtgacatcatgagagcgccacatcccttcatggagtgccacaccacgtcatgagagcaccatgtcacgtcatgagagcgccacgtcacatcatgagagcactgtgtcacttcatggagcaccgtgccacatcattagagcaccgcgttacgtcatgagaatgccacaccacatcatgagtgtgtcgcatcatgtcatgagagcaccacgtcacatcatgagagcaccatgtcacgtcatgagagcgctgcgtcacgtcatgagagcgccatgtcacatcatgagagcgccacgtcacatcatgagagcgccacgtcacatcatgagagcgccatgtcacgtcatgagagcaccatgtcacatcatgagagcaccacgctacatcatgagagcaccacgtcacatcatgagagtgccacgtcacatcaagtacttatggtttacaggggttaggctatgggcatctttgggagccgttattgtgcctgctttgtggtataccgtcatcactcagtgttctccattatctttctgtctgccatatgcctttcctctttttgttttcttctctgacattatctttaatattttccgtgatggttcttttaaaaaaattggtcactgttcttgaaataatggaatttttcctggagtagcgctgttttggagagtagttgggagaaggcctagcaaatatccccaaggagtctgtggatatcattcaggggagatctgtgagtttggatgggaagaatgttctcttctttattttctctaatgaatgtgagtgacacagcccattagtatcagtaggtcctatacatttttcacattagaaattagataccttcatattgttacagttttgctgaaacgtcagttgctgtcaccactactttcaaattatgccagttattaggcccgctgctagatatgattaattggtgcataaatattacaaactttaaaaatgttttaccattctctttgtcatctctgtgttttatttcatgcactcgaagtccttgttctgataaaggatgtatccgcgtcaccagtcatcagagtgacagcgaggttcgggcactggaacagtgccaggccgaggcctggggacgtgctggcagggcaggcagcgtgagtcctgcctcctgctttcatcctgtgctctctgctcctctttgtggggtgtggtcctctccagactaacaggaagtctccttgactcacaccaaaacctacatgtcacagatttggggtgatttcacttgcacttctcagtgactggtgtcagcatggctgaggctggtcttgacctgcagtttctcccacactgggaacagacaaccatttgctctggcagatgctcgtccgtgtttcctccccacttcctgctgttgctcacagtgtccaaagaggttttggggtttgcccgtggacttgaccttgtggttccaaagagagcggggctcagggttgatgactccactagtttgtgcttcagccctgggaaaaccttgattctctttgccacccccaaggtctacagagggtctccctcatcctggccctcctcttcccagtcccaggtgccaagcacctgggggtcagtcccccactgagtggtgtcttcatagaagtggagattccttttctgtttctctttcttgttgttcgtagttgattttagaaatgacacgggggctagagctttccccctgccctctttatcaggaactctttttagctttttctgtaactttttaacaaattgctgatgttatttgcaaaaaacagatgatacagaattgtgtgaagcagaaacttcttctcccaactcagtcacctcttttcagggtgacctcggaggcaaaagtggtatgtattttccattcttttctctatgcttataaatatatttcaagaattcagtccatttattatttatattggtatatctggtaaagcgaaatacagtttcttacttttaataatcatattgttgcacaaccaatctccagaatgctttcatcttgcaaaagtgaaactctgtactcatgaagcactcattccccattcctctctccccaatccccccaccctctgtttttttttgtccctggttctattttttgtttctgtgaatttggttactgtagaaacttcctatacatagaatcgtacagtgtgtgtcccttggtgactggcctgtcgcactcagcaaatgtcctcagggtttgtccatgttgcagtgtgtgtcagaatttcctttctctttagactattccgtggtgtgtgtatagcccttgttgtttttccattcatctgttgcgggagactggggttgtctctaccttttggctcttgggcatagccacctgttatggacaaggagcactaaaatcaccgtttttgtttttttttttttttcctgcagataactgactgctctcaaatgtcccttatctctgatgaaggaacttgattgtttattttttgattatttatttgtttaaaggcaaggttgaaagtcaggtgctgtgaattccaattcctcgagtttccggtgggcgatataaatgagaggtgtggacggaaagtaggaggtagtagggagtggtgaggactgtggaaaacctgagtccatgctcagtgggggcagcctgcacaagctcctggtgccacgtttgttgaagggatggtggttgacttagttctagaattctaagttttaaacagaaacctgaaatctgactagtttatgtaaaagccctgattttacatcttggcaacaaacttagaaatgtaagtatactgtgagactgagattttgtgtctatacctcacaataaagatgaatcaactaaaaatgtattcaaaagaagacaatattttttaaaagcaccgaaaattgtgaaaaagaaaaaaatgtaggtgggattgaatttattccctcatatatgaaactgtttatatttcagcaatgaaataaaatataagtgactcagtcactggtttttagtcaagccatgtatgcctcacaaaaatcatactattggctgggcgtggtggctcgcgcctgtaatcccagcactttgggaggccgaggtgcgtggatcacctgaggtcaggagttggagaccagcctgaccaatatggtgaaaccccatctctactaaaaatacaaaaattagccgggcgtggtggtgggtgcctgtagtcccagctactcgggaggctgaggcaggagaattgcttgaatgcgggaggcagaaattacagtgagccgagattgcgccactgcactccagcatgggcaatagagtggactccgtctcaagtaaacaaacaaacaaatgaacaaaaaacaaaatcatactatctattacttttgtaatgaagaatacttacctgttttccttctctttgtgagtttgcaataaagtcctctcgatttgctttaacttggcatgtgtctttcagagatattggagagcactgggaggcattccttaaaggtagatgaggcaaagaaccaagacaaggggctctggctctaacactcttggtgggttctagagatcagattatgaacacaggaaaaggagaagataaatgggatgaagaagccaattccaacatattacatagcatgcttatatgaaggacttggctttcgtaaagtaagaactgacagcttttttcttgatggccatccactttttagtctgtgtctcagaaagtgtagaggtcgaggaatcgggggcccctgggactcttgggtcatagacacattaggaaaacccacctcagctggggaagctgactcagcgccagcactccaggccccagaggagcagtcacccctggaaagagggaagagcagcagcagcaacggaaggtcacgtctcctcacaagaactcacaaagtctcgctaatgttatgactgtactttctgaaacccaatttgtctttgttcataccttttcccttcctgctagtcacattttttctggtgagagaaagtgaaattgccatttttaatatcagccagtcactttcagtttgaaatgcagtctgtttcttggtaacctcagatactttggcactccccacctccgatctcttctgttctctctagtaggggaggatgtctggcttctgggctgatctctgcctttgctgagcacccctgagatcatcccacttgggcttgtgtcttagtccgtttgtactaacaaaacacctgagactgggtaatttctaaggagcagaaatttatttcttagagctctggaggccgtgaggtccaggatcaaggcgctggccttggtgcccggtgagaagtgctctctgcttccaagatggtgccttgttgccatgtcctcacatggcccatggcagataggcaagagagagcacccccttgaacccggagcccttttacaagtgtgtgaatcccattcatcaccccacaaactcaatcaccccacaaacaccacacccctgaatactattgtattgggggattaagttctttttaaatttttatttatttgcgtatttttatttatttatttatttggagacaggatttggctctgtcacccaggctgaagtgcagtgacacaatctcagttcactgcaagccttgacttcctgggttcagaagatcctcccacctcagcctccccagtagctggggaccacaggtgatttcaacttgaaatcattcatgcaattttagtttggaattcagtgctgtgagttccagtccacttaagtgagctttgggtatttaatggaagcaattatttttcttaaatgtacaagagtaaattattattatttttttttgcatgaatgatgtatggaaaatcaccgcgttttacttttgtgagttgacttatttatttgtgttgattttgatattcccaaatctgaaacaaaattttttcagaatgcataataacacacagagtatggtggtctttcattgacaagtttttatgtatgattagagtatcttttcaagattcataatctgcatttttttaatatagggtctcactctgtcacccaggctggagtgcagtggcacagtcctagctcactgcagcctcaatttcctgggctcaagcgatcctcccacctcagcgtcctgagtagctggtactacaggcatgcaccaccacatccgtctattttttaattttttgtggagatggggtctcactatgttgcccaggctgctcttggcctcctggcttcaagtgatcctcctgcctcaaacctcccaaagcgttgggattacaggtgtgagccactgaaactggcctgacctacaatttgaatactactgtacagtttacattttgctgtcaggtattattttatttattttttcctctctacaataatgtattatagatcaggtcttgttttatttgagcctcacaggaaagctgaggtgagggtcgcaggcaaggagtcggaccacaggagtggtcgcagcattcagcggagagtgaagcagcgaaggctggaaacctcatctgcttctcgtgaacttcccactgccccaagtgactgatgtccttacacaattgcagccagttcgccagctgcatgagtgacagtggcataattgacgattgccaaaaacggaaacagcccaactgtcctttgcctagggaatagaaaaccaaattgtggcctatccaacccatgaaatacttaactgcagtaaaaaggaataagctactgatctgaatctcacaggcatcatatgaagtgagcggactcgctcaccaaaggctgcacactgtttatgtgatgctctggaaaaggtaatgctttagcaggtggaagaagtggggctgcgggtggggacagaggctgactatgtggcagcacagtgggtggggacagaggctgcacagggagcatgtgcagctgatgcaggtgctctgtgtgggctgtggtggtgggtagctatatgcttgtgagcactcacaggcctgtgcatgaaaaaggtgcgaatatttattttattgtacatatttcaggtgtataacatggcagtttgatatacatagtgaaatgattgctgcagtcaagcaaattaacatgagttaacatagccaccatctcacataataatctttcttgtgggtggtaaaaacatctaaaatctctcttagcaaatttcaggtttataatatttttaactatcgttcccacactgtttgttagatctctcggcttatttatcctacataaccgaaatttcgtaccctttgaccgtcattttatttcctctaccccggtaactctctgtttctatatattcaactatttttttttgagacaggatctcggtctgtcactcaggctggagtgcagtggtgtgatctcggctcactgcagcctcgacctcccagactcaagcaatcctcccacctcagcctcccagcctctcaagtagctggggtgacatgtgcacaccactgcacctggcttccttccctccctccctcctttcttttctttttttcatttttttggtagaggtgaagcctcactatcttgcccaggctggtctcaagctcttgggctcaagtgatccactcacctcagcctcccaaagtgctgggattacaggtgtgaggcaccactcctggcctaactttttttttttttttttttaaggttccacatatgagtgagatcatgtagtgtttgtctttctgtgcctggcttattatgctttgtgtaaagtccaccgggttcatctatgttgtggcaaatagcagagtctcaatttttaatactaactaagattgtattgtgtatatatgccccaaactctttatttattcatctgtcaatagacacttgggttgtttgcctatctggaccatggtgaataatgctgctatgaacatgagtgcacagatgtctttgtgaggtggtgattttatttcctttggatacacactcagaagaaggattgctgggtcatacggtagttctatttttaatttctttaggaacctccatattgttttctgcaatggctgcaccaatctgcattcccagcagcaatgtgcaagggttccctgttcttcacgccctagccaatgtttgtctcttgtcattttgctaatagccatcctaacaggtttgaggtggtacctcattgtgggtttggtttgcatttccctgatgattagtgatgttgagcacttttttgtatacatgttgaccatttttgtttcttttttagagaaatgtctattcagttcctttcttcattttaaaaatcagattatttgttttatgctttgagttgtgtgaattccttacatattttgcatattaactacttatctgatatatggcttaaaactattttcttccaatttgttggctaccttttcactctgttgattgtttcttttgctatacaggagctttttactttgatgtattcccacttatttatctttacttttgttcctttgcttttgttgagacattaaaaatatccatgccaaggctaatatcaagaagttttctcctctgttttctattttttatatttagttttttatctgtttagagattgggtctcattctgttacccaggctggaatgcagtagtgtcattatagctcactgtaacctcaaattcctgggctcaagtgatcttcttgcctcggcctcctgagtagctgggctacaggtgcacagcaccatgcctggctaatttttttttttttaattttgtagacacaaagtctcactatgttgcccaggctgactgtgaacttctggcctcaggtgatcctcctgcctcagcctcccagagtgctgggattacaggcatgagccaccatgcctggcttcttctctattttcttctaggagttttacagttttagatcttatgtttagatctttaatccattttgagttggtttttgtgtgtgccaagttttattcttttgcgtgtggaaatccagtttcaccaaaagcttaatttttcaaaatcttatatttttcttgatttttttttcacacttctatagccaacatctttattgaagagattgtcctttctccattgtgtcttcttggtgaccttgtcaaagaattagttgactgcatatacttgagtttatttctgttccactggtctatgggtctgtttttataaaggcatggatttttactgcatatgaattatacctaaatttgtcttttttttttcctttttctggagaatggggtctcactatattgcccaggcaggtctcgaactcctgggctcaagctatcctcccgcctcttgcctccctgagagctgggattacaggcgtgagccactgcgcccggctgaattatacctaaattaacttgactaaacaaacaaaaacaaaaagatcccaggttcagccaatgagctcctttttttttttttgaaatggagtcttgctcttgtcacccaggctggagtgcagtggcacaatctcagctcactgcagcctccacctcccaggttcaagtgattctcttgcctcagcttcctgagtagctgggattacaggtgcccgccaccacacccagctatttttttttatatttttagtagagatggggtttcgtcatgttggccaggctggtctcaaactcctgaccttgtgatctgcctgccttggcctctcaaagtgctgggattacaggcatgagccactgcacccaggctgagctcctttcttttggagcatatttggtctgctttctctctagcttcagcacctgaagtttttgctgctcctgcctcagctccagccccgaatgacacctttcacctggttcatggagactcaggtctgctgtcatgcccctaagcaggactagatgcctctctcatgttgtagagcattctctctgcagttctgtagaaaggtggtagtcatcggaaccaactgcttattctagcttctctgtgccaggctctgttttaaaggcctcacgtttagccattcactcagtgttttctgacagccttctaggataggtaccgttatttgggttgatgtagtgcttggtcaaatgcagtataatgaagggatcaaggagggggcaattccaagcaaaaccacttgttcatccatcctgagtctaggagatttggaagatctaaagaagtagcaggcaattattgtcacccttttacaggtatgaggcacagacagacccagtcatttgctgacatccctccactgaactgggtgctcgtccttttcactcacccagaggctgagcgagtgcctctcacccaccaagctctgttgaacttgtgcctttgccggtctgtggtcctgcggccgtctcatgagctgcagagtaggtctgtgtgtgtctctcctcaagctactcaagctgaggctttgtgtgcatgcctgccacataccagccattccgtgagtgttagtggaacaggtgagtcaatgagtcagggagtaaaatttgtgctttaaaagtagaacatgtcggagagaacctgtactgccttccagccatcttgctgtgagaggacagggcatggactctggagtttgaaggctgggtcaggtcatgctctggattctttactcactcgcatggcatgtccttagtttcacttccctcactctcagtggagccgttgcagcgggcagtgtcagaggcaacatccatttagcactgccgatttgacccccagccccatctcatactggcctcccaccctgcttctgtggggtgcctcagaggagagcaaggtgaaccccagtatggaaccgagacacggttttgacaacactgttgatcccatttggaaaatccagctatgtgattaaccattagtctctctgcctctgctctgatgtaagtggagaccacatccttcctgccccttctggggctgcgactgctataaattcattgcatttcctctctagctgttcctgaggctggcatctgggtaagtccagctccgcggggcagtgtgggcgacaggaccgggagagcagtgggggagattgtgttcagagggcagaacttgtcctggttaatgcactaggaatttcttctggcgtctccaaggttgtgcttcaacaacatttctggaatgttcttttatcattatttgggctctacgtgtgcaagttcgtgtgtgtgtatgtggcggggggaagcggggaggacagcggcagcaaccatagtttacacccacgacttcagcagatttgcccagtatccctcccaggggagaagatggatgggatatacagaaggaaacaaacctccttaaagaccaaagggcagcagatttttgtgctggtgttagggtggaaggagcacagaagaaaggcagaatcctgatgcagatggaaggactgatggggcaggagctgggagggtatgcggagctaatagggctgtctggagagcagtcacctcaggatgggcaggagctgggagggtatgcggagctaatagggctgtctggagagcagtcacctcaggatgcacagggctgggtttgcagggctcaggaggcgaggagtagataggcaggaatggagatgggacgggagagatgagtgagtctgaggcatcttgacattgaactgcagtcacagaaattccaatttggagagctccaccgttttccaggctctctgcctcccttgagtgttatttatggctttaggttgaggtgctttgccaaatagagtataatcaagggatcaaggagggaacaattccaaacaaagccaacttgttcatccatccggactctaggagatatggaagatctaaagatacagcaggtgattgctagtttttgtggaactcacagtctagttgggaagactatgttggtgaatgctgcagtgatacacctgtgataaatgctggggaagtgtgtcttttagtcatctattttgttgtctttgtctttgtctgactgaaacaagtgatggaagacatggtctcatatctctggtcaaaatcctggctctgttccttcctggttctaaacccctcggcaggcttcctagtccccctaagactcagtttatgcatctataaaatggggctaggaataggtgcacctcatagagctctgtgcaggttagatggggaaaaacatcagtgagtgcctagcctgtggaaagctctaaattaatgtgaattataatgataacaattgcgaattttgcaaggagacattaaaggatgtatgtttttatttattttattttattctattttattttttgagatggagttttgctcttattgcccaggctggagtgcagtggtgtgatcttggctcatcgcaacctccgcctcctgggttcaagcgattctcctgcctcagcctcccgagtagctgggattacaggtgcctggtaccatgcccggttaatttttgtatttttagtagagacgggatttctccctgttgtttggtgagcctggtctccaactcctgacctcaggtgatccgcccacctcggcctcccaaagtgctgggattacagggatgtatgtttttattattctccattatgcactcccagcttcatctcacttcaatccactggttgatagaagtgcagtcaaagactgtcccctcctctgcaagcttttatgttctctctcctctctccctagccacgtcctgttctgttatcaacacacttactcacctcctggccttctccttctattgtctctcatccctcttccctcacaaaaacagaagcaaagagccagagccttcagtttggaggaactgaaaacattctcttctgctttctcattttgtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggtgagtggaaggaagacttttaaaaaaaattgtggccaagtgcacatagtgtacaattttccatctttatatatatatatatatatatttttttttgagacggagttgctcttgttgcccaggctggagtgcaatggtgagatcttggctcactgcaacctccacctcccgggttcaagcgattttcctgcctcagcctcccaagtagctgggattacaggcattgcacctccacgcccggctaattttgtatttttagtagagatggggtttctccatgttggtcaggttggtctcaaactcccgacctcaggtgatccacccgcctcggcctcgcaaagtgctggaattacaggtgtgagccaccgcgcccggccgtaataatttttaaatgtacagttcagtagtgttaggtacactcacattgtgcaaccagtctccagaactgttttcatcttgcaaaactgaaactcctcacccattgaatgataactcctcattgcctcattctcccagccctggtaaccaccattctatttgccatctctgtgaatcttactactctgggtacctcatataagtggaaacatacagcattttttcctttatgagtagtttatttcactcagcataatgtcctccgggttcaactatgttgtagcatgtgtcggaattcccttcctttaaaaaagactgtataaatactccatggtaccatataccaaattttgtttagttatctgttgatgaacacctggattacttctacctttttgttattgttaatgctgttatgagtgttggtgcacaaatatctcttcaagaccctgctttgaattctctggggtatatactcagaagtgaaatttctgaatcatacggtaattctgttaaatattttgaagaactgctctactgttttagataccatctgcaccatttcccaccaacagcacacaagggttccaatttctccatatcctaagaacacgttatttttatttattttttcttttttatagtagccattctaatgagtgtgaggtggtatctcactgtagttttgatttccgtttccctaatgataagtgatgctgagcacattttcactgcttgttggccatttatagagcttcttcagagaaagttctgttcaagttcttttctcattttcagaccaggtttggcttttgttgttgccttgtaggagttctttatgtattctagatattaaccccatatcagatatatgatttacaaatattttctcctattctgtgggttgtcttttcatttggttaactgtgtcctttgatgcacagaagttagtatgatttttttttttttaaatcatggccgggcatggtggctcatgcctgtaattccagcactttgtgaggctgaggtgggtggatcacctgaggtcaggagttcaacaccagcctggccaacatggcaaaaccccatctctactaaaaatacaaaaaaaattagccgggtgtggtggtgggcacctgtaatcccagctactcaggaggctgaggtaggagaattgcttgaacatggggagtggaggttgcagtgagctgagattgcaccacggcactccagcctgggctaaagagcaagaccctgtttcaaaaaaaaatttttttttcttgtattgtcttggttttttctcttttcccctctcacggtagtgctatgagaaggtggaggcaaactgtttgctttctctaactcctttaaaaagctgatgcagactgtacctaccccctgggcacctgccatgattagtccctctttatctgaatctcagcagtgcctagacctgcctccaattctccatccagcttctcagaccacatgttttgtccagtatctgctgtgtggtcagcaggcttgggcctctgcttcctatggcccagagggcagcctctctccttgaagaaccgtggagtttggggcagaagcctttcctttcaccaccactttgggaattggaatgtaaaagaaattctcttaatccccatgtacacattggggataaggttctttcttttgtcttgtgttctaggcaaaggtagggctcagagaagggcagggtattgcaggatgatgatgtagagctggtggtgatgggaaggaggagtacaaatgagtcagtggatagggagacacatgttaaggcagggcagcagtgtgggtgtaatgacactggggaaacagacagcagtgtgcagccgggggaggtcagaaaccagttgctgcaatggctctcacctgtagtcccagctactcaggaggctaaggcaggaggatcgcttgagcccaggagctcaaaaccagcctgagcaacatagggagacctcatctctaagtaaataaagcaattatcattgtgtcagtacttatatactcacatacccaaatgaaagtgtcataatcacaactgtagaagtactttgctaagcagtttttatggattttatggcacattcaagaaacccatgaaacagcttctggtattatccctcctgcaagtgaatgaggtgagcctggaagagatcctaactggcccatggtttatttctagccataaccagagctggggtaaaaagcagggcatgtctctgatcaaagcctggctcttaaccactacaccgtctttgcttccatatctggattttgaggcagaaaagttataactagggttagaagtttgtttgtttgtttcctggggtggggttaggttttaggtaatagactttggctaatttactgtcatggctcctacctgagtcccagttactcaggtggctgaagtgggtgcatcacttgagctcaggagttccaggctggagtgagctatgaccatgccactgccctccagctttggaaacaaagcaagactctgtctcttaaaaaaaaagaataagattttggttttggcttagattttttggattttattttgtgatatggttaccaagtagacagctgtcagaggtcttttatgggctgggcgcagtggcttatgcctgtaatcccagcacttcaggaggccaagatgggaggattgcttgagcccaggagtttgagaccagcctgggcaacatagtgagaacctgtctctacaaaaaatgcaaacattagttaggtgtggtggcacgtgtcaatagtcccagctgttctggaggctgaggtgggaggatcacttgagcccaggaggttgaggctgcagggagccatgattgtgtcattgcactccagcctgggcaatagagtgaggccctgtctcaaaaaaaaaaaaaaaatcatttatgttacttgtagattcctgcccacctgaagttatctgtcttatatatttcccctagtgactaactcttgttttacctaacctgaatttctcctatagaatgccttcttaagatatgctatctagtgactgtttggatttgtgattctcaacacagatgcatgttggaatcacctgggagcttttagtatgtgatggttcctgggcctcacctcagagggactgaaaaagaacctctgggcgtgcagtcctgaagtccatatttttaaagcttcctgggtgattctaaagtcagccaggattcccaaccactagattaggcacgaaatagactggtcgttctcactcttgaagaaccagacatctagacttgacaatagaagacgtgtgtaaaatggattgcagggaactgcggtcagggaagggtgacctttcttagcccacagccgtgttggggatataggagagcttggagatgccctcacaatcaggctgccaggggcaggcaaaagcaaacgagggtaaaagaaacttagcctgcttcgcatgtttgctgattgatttccaggcctgaggaagagattctgagactggggacagtgggaacacatgcttggcaggtggacagcagaagttgttttgaaactaggagtgcagaaatgctcccaaccagacttttgactggatacctgtcctctgcaactcagagccatgttttgatttgggggatgtttggggtctcctctctcatgccaaatattaggccaggtttcaattgcatcctctgtgataatagttctgggttttgacaccttttttttcccttttaggttcagataatgcacgtgtttcgaatcccactgtgatatgccaggaagacagcattgaagaggagtggatgggtttactggagtacctttcgagaatctctatttgtaaaatgaagaaaggtaagcgactggggtggtgcttctagttgagttttaagacctggttcaggaggctctgggaagctgagcagctgggtaacttggccatactataggttcctgctctttggaatgcaaaggcctgtctcaggaaatccattgtcagttgaagaaacaaattcatgtttgtgtggctcttgcagtcccagagccagcggcggtgattaagcgtttcaagtttgataaggcataggatgcagattacttaaaggaataagattgattcaaatgatctttgggctggtagctacacatagagatgggccttctgctcagctgtgtatcttaaaaacttgacaccagagattctcggcacctttcctacccagtggggaggagctgcaccttccatttctccattccggttaccactcgcttccgatgacaggccccagctgagagcgcatctcaggtggatgtgtgtatactttccccctaacttcctgtctttgccgtagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatgggtaaggaaactcggcttccaggtgcttcctcctgcttcctcgccagcttcttcttggcgcttgcctcctctcatctcttttcaactatcttccaaatactgttgccacagctacatcataatgccaccactgtctgtttgagactccttcatgagcaaagattgatgtatggtaggtggataaatgggatgaggaaaaaaaaaataaaacaaggaacaaatgtttggggaatgccagtttagcacaaggtattaagtaggatgtaggattgcctacaaatatttgtcaactgaaatttcttgtaagctacttggagcactagtgcctaagagtcagtcaatgtctgtggggcagaacaatgccagagagtctgtgtcccaggagcgaggggacagagggcctcagagctggaggctggggggatgtttcttagaaatgtgcaatctaagcctcctttaaggaatggtgggacctgggcgcatagagaagaaattaaaggaattctgcactgaagactggtatgagccaaatcatgaatgcagtctgagaaaaagtgtgtgcaggtgacagtggagagagacacagtttccttggaaaaaaacatgatgaaggtaaatcaagggaaatagagcagaaatgtggagaccctctttctaggcccccatgttgctctgcactgggcattgccaaaaccccgttttcgggtctgttcacacacttgctgggtggttggaagctagtggccaagtctgtgcaatgaagtggttgagtcacctgacttctgagtcccttttgggtttatcgttcagtgcctcctgcagaaggaccacccacagtggttgtaggaaggtggccaccctgtgatgtgtgagtttagcctggatagaagacacttgacgtggggcaaaattaagggaaacaggaggcttggcccttccacaggcaacaatgagtttcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcaccagcggggcacgggtgggtgtccccgctcagccagcttccggaggatgggcagtgagagagtgagagaaggaaaggggcagccaggctgggggcttacggtgttgagagagagggcaggtgtgggaaagcagggtacggtttctacggcagcaaacagttccgagtgactggaaaaaagacagttgtcttcattcatcaggttgccataacaaaacactgcaggctggttggcttataagcaaaaggaaggttcaccttacggttctggaggctgggaagtccatgatccaggctctggcagatctggtgtttggtgagggcctgttccctggtcgatggtgccttctcactgtgtccttacatggtgaagaggcaaggcagctctctggggtccctttcctaaggacagcaatcccactcctgagggctccaccctcataacttaaccacacctcaaaggccccatcgcctgatacgtcatgttgagggttaggatttcagcgtatggattttggggcacacaaacattcagaccatagaaatgggagaagaagagtaagacagagagaaaagtaggcagaactactcattaagagtgaggtggaaggtggagagggcagggagaccttatgaagatcacacatctgtgaggaaggtttgcacactctcactgaagccccggtaggaggctcagcacccatttctctagatagcaccttccttcctctgaggacagattctgactggagccctggtagggggctcagcacccatccctctagatggcacctgccttactctgaggacagactctcactgaagccccggtaggaggctcagcacccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctctgaggacagactctgattggagccctggcagggggctcagcacccatccctctagatggcacctgccttactctgaggacagactctcactgaagccccggtaggaggctcagcaaccatttctctagatagcaccttccttcctctgaggacagactctgattggagccctggcagggggctcagcacccatttctctagatagcaccttccttcctctgaggacagactctcactgaagccccggtaggaggctcagcacccatttctctagatagcaccttccttcctcaggacagactctgactggaaccctggtagggggctcagcacccatccctctagatggcacctgccttactctgaggacagactctgacgggagccctggtagggggctcagcacccatccctctagatggcacctgccttactctgaggacagactctgactggagccctggtagggggctcagcacccatctttctagatggcagctgccttactctgagggcaggagcttgctttgtatgttccagtcccttctgagaaccagaagcctgagcatctattagaaatgcaggattgtggacccaatcttagacctagagagctagactttgcatttgaatgagagctacaggtgattcaaaggtgactgcatgtgtgggtgcagtggctcttgcctgtaatcctaggttttgggaggccaagatggggggattgcttgaagccaggaattcaagtcctacctgagcagcaaagtgagagcacctctctacagaaaaacaaaagcaaaaatgtgactgcatgttggagccacctggctttttttaaataaaaaagatccatatagctggacacagtgactcgtgcctgtaacctcagctactcgggaggctgaggcaagaggattgcttgagcccaggagtttgaggctgcagtgagctatgatcatggcactgcattccagcttgggtttcatctgaaaaaaaatttaaaaaattcatctagttccacctcagagcttctgattttatttccatggatgtggcctgggcttgcgattttctttttcttttttttttttttgagatgaagtcttgctctgttgcccaggctggagtgctgtggcatgatcttggctcactgcaacttccacctcccaggttcaagtgattctcctgcctcagcctccctaatagctgggatgacaggctcgtgccaccacacccaattaatttttgtatttttagtagagagagggtttcaccatgttggccaggctgatcttgaactcctgacctcaggtgatctgcccgcctcggcctcccaaagtgctgggattacaggtgtgagccaccatgcccagcctggcctgaggatttttgtgagcactcctgatgctgttgtgtagccaggagtgaggactgccctctgatcacccagcacagaacgttcagggccatgttgggacagtggactggtaagggcgagaggaggacactggggagcaggctgtagggtgccacagtccgccacagtcacaggctcatgctctccgtccgagaggaggcagaactgcttttaccaaggctcatccagccctcttcatttctctgggaacaatttttggtttcgtgacccatttcttaatccccggaaggcatttctctgaactggtgccaggcaccccggcccccagctccagttagttattattcgaggctgatttcttttctgtctgtcttccttctaattcctagattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggtgagtccccgtgcatgtgatctgtgtgagtgcaagttcatatgagagagagagagagaaacagactggagaaagatcttcaggaccaggttgctggtgtggtttctttcttttctttttctttttttctttttttgaggcagagttttgctcttattgcccaggctggagtgcaatgccgtgacctcggctcactgcaatctctgcctcctgggttcaagtgattctcctgcctcagcctcctgagtagctgggattacaggcacccaccaccatacccagctaattttttgtatttttagtagagatggggtttcatcatgttgtccaggctagtctcgaagtcctgacctcaggtgatccgcccgcctcggcctcccaaaatgctgggattacaggcatgagccaccgcacccggccggtggtgtggtttctgctgtaacaaagtgccacagactgaatggcttcaacaacaaaaattcattttcttgcagttctgaggccgaaagtctaagatcaaggtgtcagcagggttggtttcttctgaggccgccctccttggtttgtagatgcccccttctccctgtgtactgatgccatcttgccttggggggaagagtggcctagtctcctcttcttacagggacagcagtcctgatggattaggcacagtcaggcatgactacacaagacctaatgttaatctagtcactcctttaaagaccccatttcccaaaacagccacattatgaggtcttgaggattagggcttcaacatgtaaatttttgggggggcacagttcagcccagaacaagtgagaaggtagaatgggttggaggccagctggggaagttttgtgtggggaagaatgaatgaggaactaaaaaaaaagtcatttcttgaaacaaccatgatgctcgatatattccatttcctcatgggccatgttcatagatgagagttggagaatttgccatttacaacaatggcaacctcacctaaaaactatgaaaatactttttttttttttctttgagacaggacctctctctgtcacccaggctggagtgtgtgatcacagcttactgcagcctcgacctcccaggctcaagcaatcctcccacctcagctcccccgagtagctgggactacaggcatgcaccaccatgctggctaatttttgtattttttttgtagagatgtggtctcatcacgttgcccagcctggtcagaatgctttgtatgggttgaaatgtcacagggaatctcctgtgactttattaataatgtgcttgctcacacctgtagtcccagctactcgggaggctgaggcaggagaactgtgtgtacccgggaggcggagatggcagtgagccgagatcgtgccattgcactccagcctgggtgacagagcgagattccatttcaaaataataataataataataataataaaaaatgtgcttgctttctcccacaccatgaatcagattcacacgccccaccgcgctggtgcctgggccgcctcactagctctgtttcattccctgctctgtggacgcatgcaggcgtctgcatttttgaggagctgcacagcaagtgttaaagtccgccactctaggacattttgctacctccctctccggctcaacacactcaccttgtcaccagtcttatcaatttttcctcctacccgagctgttttccacttttcctcgtcctcaccccaccagcccaggtccagcaactgtcaccacttgcctggacacgcagtgacctcctagaccatcagctccccggggatggggtttgcgtttgtttgtcttgctgtcatctttgccacgcctggacagacatcttagtacccatcagtggtcaaaagcacgcactgaatgaatgttggctctttggtctccctgtgtctgcctttttccctcacccgaccattctctgcacaaaagtaagatggtcctttagaaaattctgattcgattgtgctgttcggtggcttaaatgctttctgtctgctctgctctttattttttactttatgtatttatttttgtagatgtagggggcgcaagagcagctttgtttcatggatatgttactgcacagtggtagtgtctgggcttttactgtaactacccctttttttttgagatggactctcgccgtgttgcccaggctggagtacagtggagtgatctcggctcactgcaacatccacctcctgggttcaagcaattcttcgagtagttgggattacaggcatgggccaccacgcccagctgatttttgtatttttagtagggacaaggtttcaccgtattggctaggctggtctcaaactcctgacctcgtgatccacccgcctcggcctcccaaagtgctgggattacaggcgtgagccaccgtgcccggccttagtgtaactcttacccaaatagtgaacattgtacccaataaataattttccagccctcacctggctcccaccctcccacccttctgaggctctagtgtctatcattccatgctctatggatgttaccctttgtttagctcccacttgtaagtgagaacgtgtggtatttgactctgtttctgagttgtttcacttaaggtaatggcctccagttccatctgtgtggcttcaaagatgtgacttcattcttttctatggctgagcagtattccattatgtatatagatcacactcttcatctttgctcttttggtaaatttcaaatcgtagtgccatggagactggttgtttgggacatttaaccttatttctccaacttcatgcccaaattctctccccactgccattgcccctgtatgattctggagaggcagacacaaacagggaagggtaggggacagtgagatgcttcgcagagaagtagagatccatttgtccatttgcttgaagttggtgtaaggatagggacagaaaggaaggtggtctaacaggctccaggacctatgaactattgccctggaaagaagctagaatgttgttcttgcccccatgacagggataaagtatagtttttgttgctggtggtggtggtgacggtggtagtgatgtgcgtgtgtgtttgtgtgcatgtgtgtgacggggaaactaatcaagaatcagagctgcagcgggatgtggaatcccagcactttgagaggctgaggtgggcagatcacctgagcccaggagttcaaaaccagcctgagcaagctggtgagaccttgtctttagaagataataataataataaaaataaaatataaataaaataaaatggctaagcatggtagcacatgcctgtatttgcagccacttgggaggctgaggcaggtggatcccttgagcccaggagttcgaggtggcagtgagctatgatctcgccagtgcactccagcctgtgcaacaaagtgagaccctgtctttaaaaaaagaaaagaaaagaaaagaaaaagaatcagagctgcttttcctttcaatatagatggagggctgggatgaaatcgtcaaacacaatggggtgacaatgttggtgaagacaagaaatagctgagtgcagcactggcgagggcagtgccgactgcgggcacgtcaatggttaggaacacgagggaaggaggtgggtgcacaggcccacaccgcccgcttcacttacaaaccaggagcgcaccattcacatgtctggggggtgatctcaatgcacccggcactgtttacggccgggagttcactgacaggtgatccctctgctgtgactggggagactgggggctgacctcccaatgtgccttgtgctgtattccggagctctctggtcaggtgtattctgatgctttctctattccagagctctctggtcaggtgtgtcctgatgctttctctattccagagctctctggtcaggtgtgtcctgatgctttctctattccggagctctctggtcaggtgtgtcctgatgctttctctattccggagctctctggtcaggtgtgtcctgatgcattctctattccagagctctctggtcaggtgtgtcctgatgctttctctattccagagctctcttgtcaggtgtgtcctgatgctttctctattctggagctctctggtcagatgtgttctgatgctttctctattccggagctctctggtcaggtgtgttctgatgctttctgtattccggagctctctgatcagatgtgttctgatgctttctctattccggagcttcctgatcaggtgtgtcctgatgcttcctctgttctggagctctctggtcaggtgtgttctgatgctttctgcctctgttcttggcatgaaggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggtgagtcgagcccgttcccctaaggaagttctgccagcgaggcgtgctgcgcactctggcttcagtgaggcccggtgggctggggtttgagtgagaatggccttggcggctcgggtgactgcgtgtgcttgtcttggggtgtctagcattgcggtcagtgagtgtttgtcgtggggaaagccacacactcaaccctgacaaggagcataaataataacaaaaagaagatgtctgcctttagggtgcctactgcctagctgacaaaaagaaaaaatcagtgtaatgcattgctttagaggagttttagaacttcatgacaagccctgggtcctcatattgtataagaaaaatggtgctaaagcaatgcagaccctcgatgttgtatgcagcccttccctgagtgcttctgggagacttgcattttgaaggagagaaaaaaccacttaaaaatggaagggccatttctcacccattaggatggctattatcaaacaaaagcaagaaaactagaaaacaacaagtattggtgtgggtgcggagaaatggaagccattgtgtgttgctggtgggaatgtaaatgatgcagccactatggaaaacagcacagcaattcctaaaaaataaatacagaattactactggagccagcatttccactgctgggtatatctgcaaaagagttcaaagcaggaactcagccaggagcggtggctcacacctgtaatcccagcattttgggaggctgaggcaggtggatcactggaggtcgggagttcgagactagcctggccatcatagtaaaaccttgtctctactaaaaatacaaaaattagccaggcatggtggtgcatgcctgtaatcccagttactcggggtggaggcaagagaatcttttgaacctgggaggcgggggttgcagtgagtcaagatcccgtcactgtactcccgcctgggtgacagaggaagcattaaaaaaaacagaaggcaggaactcaaacatgttatttgtacatctatgtccatagcaacactattagaaatagccaaaaggtggaaataaccaaacgtccttcaacggatgaagggtgttgaaaagtgctatatatgtacattcagctttaaaaagaattctagtacacactacaacatggatgagcctcggggacattatgctaagtaagataagctagactcgaaagggcaaatactctgattgtccttataggaggtgtctagaacagacagattcatagagacaggaagaaacgtggttgcaggcaatgggagggcggagagtgggaagacattgtttaatggttatggagtttcagttctgcaagatgaaaggagttctggagatggtggtggtgatggttgcacaacaatgtgaagtgcttaaggccattaattgtgcacttaaaaatggttaaaatggtaaattttattttacacgtattttaccacaataaagctgaatgtagggagctgggaagatgtagtattggtgggagcttggagaatgcttacttgttattccaccaaatggaaaaggaaatcagaagtgtacatagagcttgtgtccactccctttccatgtgtaaactggagtagaggcagtggcaggtacgggtgcttccttgtccatggtggagcgtgggtgagagacatgactgacattctgccatctctatggaaggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggtaagtcttcatgggtgtcttaccagaaaagtaacttcttttcagaggtgaattatttggaaaatgtggatgggggttactttggtcaggcagagctgaaggtagagtaaggaggtaaaaacatcagaaatgctttgaaggactggaggcatataatgtatactgctgctaataagataatttatgctaatttatgattatagaactagagtttcttagtgttggaagaaaccttagagatggtgcagcccaattgcctgttgagggaaaaacttgcttccaagacactcacatgaatagtcacccattttatgtgtgcatgcttgcaagcatgcaagttatcgcatagtgcatgcagcctctacactaggaaagagctctcaccctgcagcctctacactaggagaggactcttacactgcagcctctatatcctcaacagtgtcatggctcagcaccttcacctatgtagccatgctctcccaggtacacaggctggtttgttagtgtctgtctttgaaatgtggtgcccagacctgatgatgcatggtggatgttttacctcctgttgcagagaactatggtttcactggtggaatctctgatttccttgttttttttggcagttacataagccttttgattcatgttggaattctgcagtaaacagtagtagggaatacccactaataatcatgcactttccctgtaccactttcctgtatcactttccctgtatcacctgctctttcatgttcttacatggattttctcagttggcttcagaaagatgctatagggtagggtatctgtgtctccaatttaaagaggagaaaataaaattcagggagcctcataactttgtccaaggacactcagagagaaggtagtggaactcagtgtagacaaacgtctgtgacctcccaagccactgccttaattcccagtgcattgccttaggagatgttgctaatgggctctctacagggcttcttcatctggctctcagcttaagggtgggacctccaatttagctttgctaaacctcatcttacctgtcttttgacccattgactaggcagttttgaatcttcattctgacaataatatctacaaatacaataagcaaattggataggtcttcattcattcacattattaatatatataccagccagatcagcattcaagacaaaatttggcaggaaaggtcttcccagaggagtaatccactaatccataattaacaaccaacctctgttcacaaagctctgatacttccttggacctctcccatcagccaatcctcagatgtgaccatatctctttctatgaagtcttcctgcagtgccttcatttcctcgccttagggtattacccttccttagcaaatcgccttagaatattactcttccttggcaatttgacttctgcttctctaagtttgttcaacagacatgattttgtcccttcattttgcaggccctctgggggctctgtggtgggcactgacagcagcagtgagtaaaacagaccaaaatcctgttttcacaaccgttcttttagggaagtgataacagataatagacatgctaaacaatataccctgtgtataagagctataagaaaaactggagtgacggcgaggggtgcttctctgctcacgtttggcgagtgcctctccgagcgggtgacattggagcaggtgctcagtgaagcgtgggatgggctgtgaaggagccggaagagccctccaggcaaagcagatggaaccgaagaggcccaggcgtaggcactcaggtgactctcagtgatcctggttccaaattccacatgacaaacaagccaattacaaatgtgcctgatgcatctgtaatatgctctatgtagttactattgtcaatacctaacctggtagagctgctgtaataaagtatcacaaacagagcggcctaaacaacaagagtttattgcctctcagttcaggaggccaaagtctgagactgaggcatcagcaggctgggtccttataggtcgtacaggtccttcccagtccttactttagttgacatctgctgcctttaattcatttcactcttcctctttggaagccttcttcgctcttatttttaggtcactacttagtctttcctgctaatgttatagcttccccctccctggatcctgcattggcttctcttcctgtggtctggggatttcacgactggtttagttgtgtttttttttttttttttttttttgagttggagtcttactctgtcacccaggctaaaatgcagtggcgcaatcttggctcactgcaacctctgcctcccgggttccaacaattcttctgcctcagccttctgagtagcagggactacaggtgtgcactgccatgcctggctaatttttgtatttttagtagatacggggtttcaccatgtttgccaggctggtctcgaatttctgacctcaggtgatctgcctgccttggcctcccaaagtgttgggattacaggcgtgagccacacacccgcctggtttaccttttttgttgttgttgttactaaatatttctaaactccctgagaattctcatatacctctcaatttcaacaacagtaggtctcaaacccagatatcattcacaaactttttattagaaaagtaacacatgcttggtgtaaacatatcatagtacagacaaagtggaaagtgaaagctccttctcagccctcttctgagagagccatttacaatagtctgatgaacaaccatccagactttttttaatacaatagattgttatataatccattcatctgtccatccatccatccatccatcatccatccctctattttccatccgtcaatccatccatccatccatccatccatccatccatccatccatcaatccatccaagggagtatcagagctttgtgaacatatattggttgctaattatggacaaatggatttcctgtatatgctgatctgggtggtatttatatcagtaatgtgaatgaagacctatgtgattttcatgttgcatttgtaatacattgttatgtagtattttaaatgcctagtctgttagagctactgtaataaagtatcacaaacagagcagcttaaacaacagaaatttattgtccctcagttctggaggccagaagtgtgagattaagatgctagcaggctgggtccttctgagggctgtggggaatctgttcatgcttctctttggcttctggtggaatgtcatcttgctgacacattttgccattccttgacctgtagatgcctctgccacaccattgcctttatctctacgtggtgtcttccctgtgtctgtgtgtgtctttctccatgtcccaagtttccctgtgaaagaacacaagtcatgttagatttgtaacgacctgatcttaactaattacattttcagtaaccgtatcaccaaataaggtcacaatctgaagtactggggcctaggacttccacatataaagtcttagaggaaacaattcaatccataacaccctatctattgaaactagaaccataatataaatatttttctgtgatatccttttttcatttatcatggataaatttccatgctgatttgtgtagatctatcgattggggcataatatcccatagtgtgctttaccataatttatttaatcaaatcatgcattttgggataactgttcttttccactattacaaacaactctgcaaaaagcacatttgtatatatagttttatgcatgtgtatttgctttgagataggtatctataagtggcattaatcagtcgagacttttatgcattttatgtgttaggtacagccatacatgtggctgtgtgttaggtatagcctatgggttaggcatagcctgtgtgttaggtatagcctatgggttaggtatagcctacgtgttaggtatagcctatgtgttaggtatagcctatgtgttaggtatagctacatttttttctctcgaactttgggtcctcatctctggctgcatattgtgtactgcctgtctcaatactgctcaagggtcacacatgctgagcatttgcaacattggtttaattatcataccccaccttccacccccgttctctgacctgctcctgccctcttcctcctgcctcattgaatagtggggctttccaggaggctgctgagtgagtaaacgggggacggtcctaaatgctctgctttcggttccctctaccactcatcactacaccagagggaactttttaagatgcaaatttgaaaatattgaccctttgttcaaaaatcttcaaaagttcttctctgcagtcagagtgacatcttagcttggcacacaaggctgtccctgatactgccctctctcctgccataccttgcactccattttgagtcatattggatgagttttgttttgctgttttagagatggggacttgctatgatgctcaggctgaatttgaattcctgggttcatctacagccataccacccagagtgcctgatctcatctgcactcctgggctcaagcaatcctcccgtctcagccgcccaagtagctgggactataggtggacatcactgtgcccagctatgaattagttttgaaacatcttggtggttcttttaatcttccttattcttgctactcttttccttttgcctggaaggttacccccactttcccactttctactatccatctaagaagctcctacttattttttaattactgtgatcctcattttgtccatttaaaagcagggataaaactaacattcccatcttgaggttgtgatcattcaatgagataaccctgtttaaagtcgtcatccatgtcaagcacacaataaatactcaaaaaatgtttgatcttcttcttcagattccttccttccttccttccttcttcctcctcctcctttctttctctctttttctttttctctttctttctttctttctctctctctctctttctttctttctctttctcccttcccttcccctcccccccccctttccctttcccctttcctttccttattttcctttcttttcttttctttttttaagacagggttttgctctgtggctcagactggagtgcagtggtaggatcatagctcactgtagccttgaactctcctgggctcaagcaatcttcctgcctcagccttctgactagctaggactacaggtgtgtactaccatgcctgggtaatgtttaaaatgtttaaaattttttatgtagagacagggtcttgctatgttgcccaggctggtctcaaactcctggcctcaagtggtcctcccaccttggcctcccaaagcactgggattcagttttcattatgagacagttttgtgacataggcaggtagttaataaataaaaatccccaaccaattaacttaatacagtacatggcaagatatccgtgcttggtaaatgtagagctcagttaggtggattggttgaaatcgagatgtcaatcacattcctctaatccaaggattggttggtgggacatggttgtttgattctttaaacattttattatgtgttcagtgtaaccgttgcttaatagttaccagcattttcacaatttggatatgacgttttcttaacaaaactgcaccgtctgttgcaatttctactactactgtgtagtgctccccaaacatctgttgaataatccattctactcctttttggaaatagtggtaaagcctgcataactttaattacataatttaaaaaatattttctcttttcctctttgaagaccatccccattctactagaatgtccctggcctttgccaggaatgctactaatcccttctgcatgttaattaacaacaaccctctgatagaattcttaccggggatgagagcttagtagaagccactcaaaacttgctttgtttttgtctgtctctcttgggcttcatttgcctattagtcttacttactgtgtcttttcagtttgactcttccttaattgggaagatagaaaccagtggatggataatcactttttcctgctggtcatctgttcatgctttactgtctgaatacactttttctgtatttctatttttcctgcctcgtagacaccaaagagcttaaaaaacatgccattgccaaggactctggcaggaaggaggcaatcacctgcgctattcctggcttcatggaatagaagcatctgtgctcctaggaattacgccaccagtgattttagagctcttatgctcttcctgggtgatagaatgggcttaatttgactcaagaatagtacatcaaaactcttaattccatcgagattgatgcatttttggggttttatgctctaaaaggccttttgctgtgcagaaggaagagagaggtggacagaaagggcagtggggagaagatgagactaaaaggtggaaagtccaggtctggatccctccccaccacacacctgctctgtggccttgagagaaacatgtaatttttataagccttagatttctaatatgtaaaatgtatgtaatagttttagctgcactccttccttgccaggttgatataataatcaaataagactggtctctgggtcaggcacagtggctcatgcctgtaatcccagcactttgggaggccaaggtgggtggattgtctgagcccaggagtttaagactgcagtgagctgtgcacttggcctgggtgactgagcaagagcctggctttttctatttatttatttatttttgagacagagtctcactttgttgcccaggttgaagtgcagtggcaatctcggctcactgcaacctctgcctcccaggttcaagcaattctcctgcctcagcctcccaagtagctgggattacaggtgcccaccaccaccctaactaatttttatatttttagtagagatgggctttcaccatgttggccaggctggttttgaactcctgacctcgtgatccaccctcccaaagtgctggacctcccaaagtgctgggattacaggcataagccactgcacctggccttatttatttatttatttaggcagggtctcactctgtcacccaggctagagtgtggcagcgcaatcatggctcactgcagcctcgacttcctggactcaagcgatcctcccacctctccaacgtggttgagggctgcagcgagaaagatgtgaaaggggcatttgggggcgcaggaaggcgggaggtggcaattgctaagggccccgccgtgttcctgtcacagccctagctacagcttagaaggtcacaatggacgttcacctgttgtctttgatgtttaaatcagcaccgacttcccatgaggaggatttttttttcctgtctctcttaaaaaaaaaaaaaaaggcccctgcagtgtgggtgtctgcagtgttacggggattattagttgaggataaccactgggatgtgtttctggaagaagtggtgctgaggagcactcctggccggaggaaagctgtgtgaggaggaggaggagtatggggtaactggctcagtttgccttggctctttctgtcggactcatacagcaaagcatctgctgagacatcatttgtgtctcctgtgacagccagagacagcaggtcttgctctccccagatcatatctgagatgctggctcctgctctctgagctgaaggctgcagctgctgagagaggacgaggcactgagtcaaagcagctgcacaatgttggggaacagctgggtactgaggactcttctccctgtccttctacaggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggagtaagtcctttggtttattacagcaatgagaacacatggtggccaagggtggagggacgtttaggcagagtggccacaagataatctgtatcttagaagtgaggtgtcttcttagtgtttgccttgttacaggatcatgggactgggaggagtccttccagatgatatagatgtaggaacttgagtccttaccatcacagttttctgtaccacaaaacaaggagggcagtatgacacttacattttatggaaatgtagggaaaggcacagaatttggtaaatcaatgaacaaaccactgttactaatttgatctgtgcaatgcagtggatttgaaaaagagagagaagaataattaccagcatacaaggctgcttgaagctagttagtcctgtgctcctgtgctttttttttttccacctgaaacaagacaggctaagatgctaaaatcttggggagctagggggatggttaaggggacattttctttaaatcaccccctttttgcagattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggtgagtgtgctctgcagagatgcccgtggtgggactctgagttctcaggaaacgttgactgttatcaaaatccaggatggctctcgcttcatttgcagccactcaagattaggttgggcctgggtcagttgtggtggatattttaaaatagagaatatggggttaaactacacattccacttcactgagatggttagaatcaccaaggctaagctggatttcacccacattccccaaagaaacacaagccctcatgcgatcatggccaaggaggattctgttctacacaaggaaccgaacttcgtagaactcgtctatgggtcatccaaattggaagggtctttacatagtggggatcttgttgttttgtttctgaggatttattttttttttccttgagacagagtcttgctctgtcgcccaggctggagtgcagtggcatgatctcggctcactgcaagctccgcctcccgggttcacgccattctcctgcctcggcctcccaagtagctgggaccacaggcgcctgccaccacacccggctaattttttgtatttttagtagagttggggtttcactgtgttagccaggatggtctccatctcctgacctcgtgatctgcctgcctcggcctccccaagtgctgggattacaggtgtgagcctccgtgcctggcggtttctgaggatttctaaatgggaaaagagtgctccaggaatagcaagatgggaaattacacgaaattcgacagtgtgtcaggatattgccagcccacctctgtgatactactgaggtagtcgtctcctctctagcaagagcttcctggcgagtcccacggttctgtcagccgtgatgattgcacttttccctgaagacgttttcactgcttggctttaaggccaacatgctctcctgggttttctcctatttcatcagatccttctactcagtctcctttctggcctcttcttcatcatcctgacccttatgtgttgaatcctcagagcttagtcgctgggctaatttttcttccctacactttctccctcatttaaattatctggtcttctggcttcatgatatgtgtgctgtggcctccagattatatgtccataaattctgtgtctccgtgcttggctgatctttcttcttgaaggtttaataaacctctcaaacgtcacatctagatccacacccttgctactctcttctacccgaaacctgattcttccccatttcagtcgatggtcacttcctccaagttgctcgggccaaaacatttctggttctgtcgtcactgtctctttttccttataatcatgtccaatgtgtcagcacatcctgtgagctctgccttcccagcttggccactccctgaccacttcaggccagcttcacggcttcttccttggctcaagccaccatcacctggtgtctggattgtcatggtggcattctgacaggtcaccctgcatctgttattctgattttagcagacaagggattcagctaaaacgtaactcgcatcatatcactcttgtcaacatcgtcttcttatcactttcataatcagagcaacaaactcatggtggcttccatgccccacataatccagcctctcctgcttccgaagattccgcttctcccaacccttgcttattctgccccagtacagtgatctccttgctgttttgcaagaacactgtcatctctggatttttgcacttgcttttcttctggcctagaactctctccccttcagtatccacctgcattattccctgtaccttcctaaattctctgcttaaaggtcttctctgcgaggctgtctttgactattctactgaaaatagaagcactttttcttctcttctcattctcctctgcagtgtagcacatcttatgtgctatgtcattttcttgtttatttattatctatctctgctcccaaaatataaattccattagtccagggacttctgtccatattaatgatctcaaggctgagaacttgttggaatgcaggtttgaataaatacaagtttgaatcagccttgcatccttgtgccaacataatggagcacatttgctgcaggacaagccaatattcccagagctaagagagatgggggaacaaacaaaggattggtcaggtcaaagctggggacactgctacatgtagcatcactgacctagccctgagggacattctggacccaggctgagggacaggctcaaaatagattgaagaatccatgaatgcaatcaacccgttttctcaggctgcgataacaagctgctttagactgtgtgactcaaacacagatttattatctcacaatactggaggctagaaagtccaaaatcaagtctctgatgaatttggttgctggcgagagtcctcttcctgatttgcagatggctaccttcttgttatgtgattgcatggagggaggggaggcaagggagagaagacaggggagaaagaacaaactctctgatatctctcctgtaagggcactcaccccatactgagggccccaccctcacaacttcatctaactctaactacttcccaagggcctcacctttaagtaccgtacattaggggttcgggcttcatcatgggaattgttaaggaagacaaacattcagtatataacaccaccaaattgagatggttataaatggtgcaggacaaatgggtggatttattagttaagttgcaagggaaactttattaaagaggaggaagaacttacatcgaagatgtgagaggcatcctgggcaaatgcaatgtgtagaattgatcaggttagtgactaaatgaacataaggtaaaaaaatttacaagacagttgaggaagcgtaaatgctgactggacatacagtgatactaagaaattattgttaaacgattttggtgtgatagtgacattgtaattatattttagtgtcacaaagtgaattattgatagatgcattaaatgcagtatttaaaataatccatgggtgggaggagtgggtgggcaatagaagaaacaagttgacatgacctgtttaattgtcgaacttgggtaatggacacagggggttcattatactattttctatacttttatgtatgcttaacattttcccaactagatagttaaaaatataacaggaaccacattgggcacttagagcttttttttttttttccccacatttttattgggagccgtgggaggggcctcctctgtcattggaggtgctcacagtttcttcagccactccaggctggggtcctgggggtctgaggctcccagtgacgaaggacacgacgagcaccggctccttggcccaggcattcttgaagaaggtgcggagtctcgcggccatcttggtctcggcggcggcgacggcggcgaggacgcggagcactctgggagttgtggtccctcttttttttttttttttttttttacattttagaagtgtgtggagtttagggaaatgaagagatgagacttttaaggttaacgactctgacagagttatctgaagagtgcaacccaggctttctatttgcttttacaggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaaaaaagagtacctagaaatttttcaaattatttctctaaaccactaaagataaattaaattgtttggtgcattttaaaagtcactttggcaaatgattccattgtagataatttttaaaacgttacctcactctaactgtaatgagtggaatttcatctttgataggataggagattgaaaatcgtggagggaaaggtttgagagtatcagagcctgcgctcctaactagaagtattatgtagaagatgcatcttgctttcagttgataacagcttattttggatttatcccatccgaggaacagttcatctattatacttcacagagcattaagttataaggaaatatttactaattgcttctctacacatggacaactcttaaaccgcatggaattgctcaggatggaaatactatttcctctgtacaattagccatcaaagtagccacactttgctactcaaagtgtagtctatgaactgtcgatataaggagcttgtataagaatgtaaaacaatcacattattaaacataccttttagatgagctgacatttaaaaaaaaccctgaagactatttttataagggaaacagtatgagatttacattctgttgcaaactctgtcttgttagcacttctgagcagcaccaactggagactgggtttctgcatcttggtgaactattaccgactgccttcctgctacaaacactttgataacctatataaataatgtaatcagaaacacatagctgagcttgaaagagagaaagagaacctttgggcattaggacattaaaactggccaggttgctgagaatgccattatttcattcctttttatggctgaatagtatttttccatggtatatatctcacattttctttttcttttttttttgagatggagtcttgctctgtcgcccagtctggagtgcagaggcgcgatctcggctcactgcaacctccgcctcccgggttcaagcaattctctgcctcagcctcctgagtagctgggattacaggcgtgtgccaccatgcccagctaatttttgtatttttagtagagatggggtttcaccatcttggccaggctggtcttgaactcctgaccttgtgattcacccgcctcggcctcccaaagtgctgggattacaggcatgagccactgcgcccagatggttccatatttttccaattgcaaattgtgctgctataaacacgcatgagcaagtatctttttcgtataatgacttattttcctctgggtagatgccccgtagtgggattgctggatcaaatggtagatctactttttgttctttaaggatccacaatgttttccatcgtggttgtactagtgtttgtactagtttacatttcatggaaaaactttctatagaagaaaatgtgaactacagagaaaaaaaaatcaaaatcacaggaagaagatagcaatctacttcattcctggaattgtctgaaaaagtcgtgtaaaatttgtggagatttaagtatatggagaaaaacacttattcattgtaagtaaaataagattgtatttcagcttcatcttgtgtatacttaggagtaatagaaaagagacaaatggggagagaataaaagaaatataggaagaggaaaagagaaaagaatcaggaaattggaagtgaaataattccacacatacttattgaagtctatttaaacaatgcttaaaaatatatggcctcttagaattatacgtttaaaatgaactttgtcgctatgggatttggggcattataacaggaagtgagatgtttgaagacagggtttttgagctctctgggtattaactccttaagtgaaagatgctctgagtgcacaatagacttgtgctgtgttctttaattgatggagatgctacatctcatgtcctcatcatccacagagcctccagatcctggccagaagtctcctcagagcccccttcatatctttatttctcagggtgtaggtgaagggattgagagtgggggtgattatggaatagaagagagaaataaatttgccctgctcttgggagtagctggaagggggctgcagatacatgtaaatcgcaggtaggtagaagagggagacgatcatcaggtgggaggaacacgtcccaaaggccttgtgtcgtcccttggaggactggatcctgagcactgcccgggcaataaagccataggagagaaggatgagagccaggggcaccaacacgaagaaggccaccagcacagccagtatggtgtcattcacagcggtgtcagcacacgacagcttgatcacggccggcacctcacagaaaaagttgttcagcacctgccgcccgcagaatggcaattgcaccgtcaggaccacctgcacgaaggagttgccgaagccactgagccaggccagagccacgagctgctgacagagagcacggtgcatgagaacggcatagtgcaggggcttgcagatggccacgtagcggtccagggccatggcggccaggacgatgcactccgtgcatcccagccagtggaagactgcatattgcacagtgcagcctccatagctgatggtcttctgggaactgcccatgttgaccagcatctgagggactgtcgtggtggtgtagcagaggtccaggaaggacaggtgactgaggaagatgtacatggggctgtggagttgaggatccacccgggatgccaggatgatggcgacgttccccaacatggccagcacataggacagcaggaggaccacaaagagagggagttccagccacggcctgtcagacacacccagaaggatgaaggctttaggggagtcccctaagaagctatggttgtcacttttcatgttgcggcattttctggcacttgtggcaaattgagaaaattggaatgaataatacctgagaagaggaattgatcactttcctccctcttgcatccactcttcctttcccaggtgatagcctgtttgattctccttacctctgtggagacgctgggatgcggaagggtcagaaccaggagccccagtagcagcctctgtgtctttgctctccttcctactcagtggccgcaactaaaccatttaatattcctgaacttctgcatctgtaaaatggggagaaatacctccttcaattgccaagacttggggacgatagagacattaagtatgtgagaagaatacctcacgaatgacaattatgttccaggtagagcgaagcgtgctgcagctcccatcaccgtcagagtgtttgatttctctctacatccacatcgacaaggaattgtccaccttcttaggctttcccattttgggaggtagtggtaggagggaggcaggcggtgacataaagcaagcagaagggctttgtgagcagctgggggctgtattgataggaccaccccccgtcactggctcacgcttgcatccagctcccggattcatgctgatctccgctgtcatgaccacacacgcacaggcagccctgtcactcacactggcagtaaaagcagcacaattctaggtcctgtgagtctctggagtggaagagccaaggtatacgttacttcagcccctgaataggtcatggtagttaatgagaccccagaccatggaattttgagcacagggagaaagctcttgattggcgtgagaaaggtagcccctggaattgtctacggaaagatcagactgccctctagggctaggttttatctgatggcttgagtgacattccaatttcctgcacaatttctttgccgagcagctgtcacctctcagtgatagaaaacagccaatttgatttctgaaaccattgctgttaggaagcaactgggttgccacctgctgattcgtgggtcctttcgactgcaccattggcttctcacctcctacaatcgctcaagcattgcacaccttccagttcctgatggggatgttatgctccatgataggattgaaaaatattattaataaacaataattaattaatcattattcataataaatcctgtaagcagataatttatgaaggatttttattcttgatttggtaccttatgcatagactgtaaaactaacggagatctgctcagcttacatgttgcaacaggtgttccctgctgccccagttgatgttctgaagaactctactgttactggaaaacaactcaaactccagggtttcaatggaggaataagttcagtttttccctcctgcttctctagtttcaaaaccacacacgttttgtcagaaagttgccaatattcttgtgaaacattcaattatcgtatctcctcccagattctatcaacaatacttatgaaataaacttcacagaatgtgatcttatctctaacgagctcaagatgcctgtcaaaacagtgagctgtggccgagcaaagtcaagctagcacatttttaagtctaattattaagaagtaaaggaattatgacatttctctttctgagatttctgattccagagtttcttttcagagcctaaactgggagaaaagggagaagttgtagggatagtgaagaaagaaatgagagaatgaaggaagcaagaaagatagaggggtaaatgtatgcggcaatttataataaagacaagttatttaccactcactgtgagccaggtactgtaataataacttgatgttgccttaatatctcagcaaggtccatgttttcacccctaattgactgagcgactcgggaggacagctggtctaccttagttacacggcagcaaatggtaaagccaggactgaaagccaaactcctgctcttcactactattctctccagaactttgctttaaaaaaagagcagctggtgacatggggagcagcaagggcagtcgcgtaaacgactgagacaaaagaagttcctgggaaggggagatgagggagaggaaggtcacaggatagaaaggggcagggattagagaggagtggttttcttgtaattatagtccactgtacatgtgcacacttacgtacacacgtgcacacacatgcatgcacgtgcacacgcacacacacacacacacacacacacgcacacacacacggtttctcaatggcaaagctggacactgcccagccctgcccctcatgccctggatctgatgcccttctgttcaggtgtttccacacggagctttcgtaggtgtctagcctctgcactccttgaccttctttcatcttcccactacccaagtacaggtgccccctcaaggcacagccttgcttccctggatggacacagtagttcccacaaacatcgccatcgcattcagacggaatccctcaggctgtatctacagttgtcagttcctcactgacctctaaccccctttttgacattgtgaactgaggcatcccaaatttcacctggcagccatccccccagactcaaaccatctccttcatcttaattctggctgagttcccttcagtcaccgtgatgccaagtactgaggttctttctattcatgttctactcctcattcactctagttcagcaccgaagttaaagaattcaacacccacacaatgctgtgatcccaccacaatgttgcatcgttgcaggcacgcactgtctgtatcctcaccactgccgtcctgggcagaaacgcccaccaggacccctcttggaacttgctacctgcctctctgcaggcagtttcaacccctcactcaccctcacacgaagtcatctttctgagactcaggccttaaggcaaagatatctttaggtgtttcaattaccaaaaacgtaagaacccgtcgctcaagagttacctgctgattgtatcatgttcacgctgaattcccgcagtttcttctgggggctgctggcaggctaggctgtgaacacgcaggctgtgatacacccttagatatatatcattccctgtaggatatataatccttatgattaatatttatatctctatatctatatcatctacctcttatccctgacatttgctgctgaaatctctgctgaagcttgacggaacacattgttacctactccatcacacaagatggaaaatcaaatttacagcagtgtgtggaattcctagaaagtagcttatgagatgggcaaacagaaacatggtcataggattttattgcttattagtccaaagggtctctttcttcagtctagaatgcagcctcccatcccacaaccgggatagcctggtccaggccctgttcagctgcggaggccatcattgggattacactcaagagagtcttggggacaaggcttaatgatagcagtattttcctgaactgataataacacggactctttcatcacaaaaagagaaagagcccctttctccttatttaagagcccctttctccttatttgtttgcatttgcagtcctggttcaatggcacgctttttcttaggagtctaacaagtacaatcgagacgttagctggcacaggggcttgagagcacacaagcccagcctcaactccacctcttcatctttattctcagtgtcactcagcagcctctgcaatgtagttagtgtccctgtgcatgcacagtcctttctcatcctgtgccaggactggggaagtgcacatcctcctgctgggaatagcaggaatgtcttgggaatcttacgttcttcccttcccttcatgtcccacctctggtttcaggacagcccggtttctttcctttaactgccctcactaatttaacactattcatcatcttctgtagctcccacagtacaaaggggtttgaggacatgaatatgcctattgccacagtggatctgaggtctaatttttcataacactttaatttgaaagattaaacaaattcttagcattgagaggagaagggaagtaagtgcacactgaatgagcacccaccagttctctgtgcactaggcaccgcatatgagccttcccatatcccatttcaataactctggaaaactgagaggttcagaaagattaagaagttcacctcgttcagggactggggtatgagtccacagggtaagctatttaaaaatccaatgccggttcacatggaggggaaattacttcctcataagcctctggatgtcataatctgtcactctcaaaagtaacaaacagttcccctttaaaaaactttattttatatttacttaaaataaatagagatggggtcttgctattgcccagactagtctcgaactcctaggctcaagtgatcctcccaccttggcctcccaaagtgctaggattacaggcgtgagccacctcacccagcccagtttcccttttacatgcacgacctcgttaaacaccctgtaaacctgaaaaatattaaagacctcgcctaatggaaaaattgtaaatttgctgtatcatttggtaatcatttccaatatgttaattttttactttttagggagattgtaattacttttttttcttttttttttttaattatagtttaagttctgggatacatgtgcagaacgtggaggtttgttacacaggtatacacgtgccatggttgtttgctgcatccatcaacccgtcatctacgttaggtatttctcataatgctctccctcccctagcccccactccctgatgggccccggtgtgtgatgttccgctccctgtgtccatgtgttctcattgttcaagtcccactaatgagaacatgaacatgtcttacatattatgtcattcacagcatgaggaatgcaattaattcacaaaaatgattattgattttgttagcaaatctaaaagcctcatccctcaaatagcttcttattctggaggtaggtagagtcctcagcctcgtcagttattccttctagtgctggggacgaagggaagaggaggagaaggagctgggacccagcagtgatgggcctatgggagggaggatacggctgcacagccctcagcgcgtggctcaggcagggtcagcccctctgcacatgcctccccctaccaccaccacacgtcatcgcctttttatgtggtctgactttttcagatttttcaacctgaagcttgctttctcggggactgatacgattcagctctgcattctctttttctctctttccatggccctgctcagctcactactgcccttgtgactgtgattcagcagcctcaaaaataggaggaagcggaggaaagggactcagcgtccccacacactgtgtgcagcgtccactgttcagatgagtgtcagacagcgtgcctacctccaggcagagcatcctgttctgctcccggctctcttttctagataaaaccacacaacacaattttacacttgctgcttaatacgtggccattgctcatcgacccatccatcctccacctcatgtgcccttggtctccagcatagcccagtgttaatactgcccatcctgcacctccactgcactgtacagatttcagtttgactggagttgaggatgaatcactcacctccagggttcctggctcctacagaagacttgctttaggactgaaggctatattgcagtctgtgttggccttagtcgcggagggacatttaaggatggacttactagaaatgctcttcatattccaggaacacacagcacatttcctctgatgggctgctgggaccttaccatttactggaacccaaccctctgagcaagtctgagagattattctcagtctagaaggagtctgctgtccgttgcaacaggcttgctggggagactcagggtttcccggactctcccttggcagtacgtgaggtcggtggaactgccttaaccttagtcccccagagtgcctataggtaccttgacatggtggaggttacttccgaggataaggctttcaggcaacacaccttgcccgtgtcacgctctctgttcatttcaaaattatccctcagatttaacttgacctcattctctccactgttttctataagggccctgctcattctccccagacgtgagagtaaaaacttgctctcctctggctgtgaaattatccctgatgctttatttaattagtgtctaaggggttagctgataattgaggtggtgtgagagcttggagttcttgcaattaatggcaaatcccagaagaccagagaaaatggatcaataatggggaataagaactctgtgtgtgtgtgtgtgtgtgtgtgtgtgtgtgtgtgtgtgttgaactctttagggctggtgcgtggtgtgtgtgtgtgtgttgaactctttaaggctggtgcgtggtgtgtgtgtgtgtgttgaactctttagggctggtgcatggtgtgtgtgtgtgttgaactctttagggctggtgcgtggcgtgtgtgtgtgtgtgttgaactctttagggctggtgcgtggtgtgtgtgtgtgtgttgaactctttagggctggtgtgtgtatgtgtgtgtgtgttgaactctttagggctggtgcatggtgtgtgtatgtgtgtgtgtgttgaactctttagggctggtgcgtggtgtgtgtgtgtgtgtgttgaactctttagggctggtgtgtggtgtgtgtgtgtgtgtgtgttgaactctttagggctggtgcgtggtgaggtgattactgtaacatcagagtggagtagtaactagagtgtgtgattcaggtaaagcatgagacctgaactggcttcaacaccaggctcggtcactcatgccatgtgtctttgagcaggttacttaacctatctgtgcctcacttgtgttttcttaaaaatacaagaaacattagtattgttttgcacagtctgttacaagggtggaatgaattgtttcttgtaaagcactcagaacaatgagtggcacagagtgatacatgttgagggctttttgttgttgttgttgttgatatattgtctcagcaccctattatatttttcacatggaggggataaaaaaaatctttcttaagacaggccgcaagaagtagtgcacattttattttatttattcttttattttcttatctgtataaatttaagggctactggtgcaattttgttacacggatatattgtgcagtggtgaaatctgggcatttagcgtaactatcacccgaataacgtacattttaccccacgtaatttctcctccctcaccccctgacaccgtcctacccaccctagtctccagggtctcttactccatcctctgcatccctgtggacacataatttagctcccacttgtaactgagaacatctggtatttgactttctgttcctcagttgtttggcttaagatagtgtcctccaattccatccacattgcagcaaagatatgacttcattttttttatggccaaatagaattcttgtagcgcaaattttaattcatgagctacaattcatgtgattaaatgctgctatgggaaccactgtgaatagcagcaccttggtgcagttactctccctctctaggttttgactcgatcgtcttttttctctagctttagatgtctaagtggacacagggtgagtcatggccatgagttagggctctatttttaccttctggggatggagggaggagagaatatgtcccagaagaagatggggcgactgtgctttggcgaagaagtgggagctgtccctgattctaagcatgctctcttgtactctctcccacggagagccagatgaggcaccagggacatcttagacactttttttttttttgagacggagtttcactcttgtctcccaggctggagtgcagtggtgcgatctcggctcactgcaacctctgcctcctgggttcaagtgattctcctgcctcagcctcccgagtctatgggactacaggcacccaccaccacacctggctaattttttgtgtttttagtagagacggggtttcattatgttggccaggctggtctcgaactcctggcctcaggtgatccgcctgcctcggcctcccaaagtgctgggattacaggtgtgagccaccgtgcccggccttagacactgtcttgttatccagctgggataatttccagaagtggagaggcttccatatctctgcagttgggggaagaaaggtggaataaacagttttgtgctgagaaaacccagatgcaattgtagttggaaactcccacgactgagactgacacagggtcccactggaattgtgctaattctcgtcttgatcatctttcttcaaatatctgttctcccactcttattgttggcacccccttttactccatgcagcaaggtactctgtgatgtgatgatattttccaggctttctaacagataggggaagctaatgagataaaattactgggaaagcttggaaaaatattagccaatcctccattctctatttttgtgcatggaacgtagtcttgatggctagcgccctagcagccatatttgatcttaaagcaatcttaaagaagcaagtcacatattaagaatggtggaacaggctaggcatggtggctcacacctgtaatcccggcagtttgggaggctgaggcaggtggatcacctgtttgggagtttgagaccaggctgaccaacatggagaaaccccgtgtctgctaaaaatacaaacaattagccaggcatggtggcacatgcctgtaaccccagctacttgggaggctgaggcagaagaatcgcttgaacccaggaggcggaggttgcagtgagccgaaattatgccattgcactccaagctgggcaacaagagcaaaactccatcaaaaaaaaaaaaaaaaaaaaaaaaaaaaaaaagaatggtagaacattgagaaggagccagggtacttgatatttgatggtcaaagaggtgccgtgaactgttgacctccagtttctttgacataaaagtaataagcttccatcttattcacagcactgatctgggttttatgtcttaggaaactgaactcaattctggcagtgatttcaggaagattttctgagatttcttttgtaatatgattgtgttataagatataataaagcacagatattagtaattccaacctctagaagaatgtgatctaaagcagtctgtgttgacatcaatgtcacagattaacaattgaaaaacaaacaaatggataaatttaatgatcaaatagatgatgataaatacttaatgcagctacagtcagtggacattgaagatgaaggcagccaggagtcaaaaaacgttttatatttccaggcattctagaatgagaaaagagaagacttgctctgcttggtgtgaactgggggggttccctgtggagaaggcaggcgtgatatggattgcctgtatttctagaattacatgttatttcagctgtggttaggatttgagtaaagaaaagaaagaatcacactgatatccacaaggaatatatttaggctgatatttatttaacataagtccaatagatggaagtggtgaaaaatgggtgtttgcagccaaatgaactggattcaaatcccaggcctcacgtattaagcttgggaccttaaatgagttacataagtcttctgaggctcggtttccttaccagtacaatagaaatcataatttctgaccactggattgatataagaataactgaaataatatatgcaaatatattggtatgattcctggtacaaaacttagtaagtggcagtccacactttccttcttgctttctttccttccattcacccatcgacaaatatttaagaaattcttttttttttttgaaatggagtctggctgtgtttcccaggctggagtgcagtggtgtgatcttggctcactgtaacctccgcctcccaggttcaagcgattctcctgcctcagcctcccgagtagctaggattacaggcgcctgccaccatgcccagctaatttctgtacttttagtagagatggggtttcaccatgttggtcaggctggacctgaacccctgacctcatgatccgccctccttggcctcccaaagtgctgggattacaggtgtgagccaccgtgcccggccaagaaattcttatgatgtgccatgtgctgtgactaatggtgagatgtagtgtaaatggaattatttgtgccctcaaggaaactttggagtgatagaagtgttttactaattgtctggaatggtagttgcatggctgcttacacttagcaaaactcatcaaactgagtattaaaatgaataaattttgtcatatgcaaattatatccaaataaagctataagaaagtatttgggcccatgcagagctaccagaatggtgtagaaaaagagacagtaagcaaatcgttgcataaccatgaagtatagctgtgagaaagattaagaaggaaaagaaaggacagcaaagaatgctttgaaaagccatggtaccctggctttccacccatcaaatacatttctaatagatgatgataaatactgaccatagccatcacctcatattatctgtgccagctgatggcaaaaggagaaaagcaactataatctactcagcaaaaattctgaatacaatacactgttattaactctagtccttaagttatgctgtacattagatcttccaacttgttcattctgcgtatgtgctactttgtatcctttcatctacctttctccattacctgaaccccaaccactgttttattctctcgatttgtatatttgacctttttttcagattccacatataagtgagatcatgcagtatatttagttttgtgtctggcttatttcacttagcataatatcctccaggtctattcaaattatggataaatggcagcatttccttctttttttttttttctttggagggtggtgaatacagaggattttattgttgatgaaagtggcattcagtgggaaggggagctggaaaggggttggagtgggaaagtggtcatcccctggagtctggctttccctggccaggctcctctctgaagtcccactgtcaagctatccctctgaagtcaagctgcttctctgacatctggctgcttcttctcttctcttcttttctgccgttcctctgccagtggagcctggggtttttatgggtacagaatggggggcagggcgagccacgggggttttggaaaaggcaacatttgagcagaaaaatggggatgttctcactttgggccatggttctaggcttgagggtggggctttgccagggaccccacccttttctgcctagaatttctctgcctcctgtccctatcaaaaccatagtgaaagagagcatatcagttgttaatatgaagccagaagtgtggagagtggcatctcctttttaaggcagtgagatgcttgtatctatctagctatctagctggccagctcagagtttgtctattcattcatagacagatgcctaggttgtcttcattccgtggctattgtgaataatgccacaatgaacataggaaagcagaaatctttatgaggtggtgacttcattttctttaggtatacacccacaagagggattgctggatcatgtaggagttttgtttttaacttctccagactgtggtccataatggctgcccaatccacattcccacccacagtgtgcagggctccccctttccacatcctcatcaacacttcttatctcttgacttgttgataatagcaatcctaacagatgtgaagcattatctcactgtagttttgatttgcatttccctgatgactagtgacattgagcaacttttcatatacctgttggtcattcgtatgtcttctttggtaaagtatctattcaggccttttacccatttttcattgagttatatattctcttagttttgagttgtaagagttctttataaatgttgagtgtttaccccttatcaggtattttttcccaatccataggttaccttttcatcttgttaactgtatcctttgctgtgcagaatctttgtcgtttgaagctttattactattataccttgttttatggtgtttatgaactagggctttgcagaaatggaagaagtggtaaaccagtgaaaaatgctgtccaagtgtcaaaagtcctttgagcaaaatcgggggctctccagatttctagacttacctttctctctctttgctcaagaactgtttctccggaacactctgtcttcctcagccctgaaaacaaacatatactagtgttcttcaatagagttctccatgcttatagaattatatacatatgtgcaaataaaatatgtgctcctttatatgacaaattatatcatataatataaaagtaaattatatgcataaaagtttaacttttctctatttctcgtctctctacagtatttactttagaattagcatccagactttagaaggacatcacagggatgcatatttaacacagtgatttattcaaaaagaaattcagtggattttcagataaaaagtaaattttataattaaattatatgttacaaatcaagggccaatagtagctgtgaatacatatttcctgtttcacaaaagagttatttcttgtgctgaaaagctagtcaaaggtgaacatactaaaatataagtttggaccttattattaattctttgccaattaagaatgagatttacttttttttgagaaagagatttcttccaggatcctcagtaccatggtttattgagaagtatgctattgcacagcaaggtgtctatagttaagaataatatattgtatatttctggtcaggtgtggtggctcacacctgtaatcccagcactttgggaggctgaggcaggtggatcgctggagctcaggagtttgataccggcctgcgcaacatggtgaggcctcccccacaactcccatttctatttaagagagagagaaaaaagaataatatattgcatatttccaaaaaaaaaaaagctaaaagaggggattttaaatgttctcatctcaagaaataataaatatttgaggtgatggatatgctaattgaatcattccacaatgtatacacatatatcaaaatatcgcattgtaattcataaatatgtagttatttgatttaaaaataaaatggaactttaaaaatgttacagtatttagcttaaaaataagcgatataaattatatgctacattatgtattaaatcaatcataaatgatgtattaattatatataatgtatattattttatgcattatatattatatggcatatattagtatgcaaagaaatgggtaatatcatgtagttttcacgtaccttgctttattactgtgagaaatggagggaaatccctttacgtgggctgggtaagatcatactaatcttttttttttttttttttttttcggagtccccctctgttgctcaggctggagtgcagtggcgcgatctcggctcactgcaagctccgctccccagattcaggcgattctcctccctcagcctccggagtagccgggcttacaggcgcccgccaccatgcccagctaatttttctatttttagtagagacagggttttaccatgttggccaggctggtcttgaactcctgacctcaggtgatccacccacctcggcctcccaaagtgctgggattacaggcgtgagcccgggctgtactcatcttttatagtggcaggactctttcctcctcaagctatacagtggtgaaatcctagtgaattttcttgacatggcagtgatttcagtgtgaaacgagctgccatttcatatcttcatggtttactggttttactctgggctctggttactctgcaattccagttatctgattctgttgaaatcccgtgtgttgctgcctctgcagcctcttcttcctcattccgccctggggaatatgtcagatattcagggcacacagtactggcaagacttgcttactaagaacctatttccattccccccgctccccaccaagttttaagatcagaaacgagttggctactatcctctgtcatctttcatcctaaagtaaaataatttctgaaattcccaaatgctgcaggaaaagtattacaaggaaaccgaaaaaccacgtttgagagatactatagatgctttgcttcaactttcgcgggttacttctccttccccactcccgcttcacaatcacttttcttccacttcacaatgaaaaagtgttctttaacctttcctgaaggtgactaagaagcattgctctatggtcttctctctttatacttttctttctttcttctgtatttcatcttcccttcctttccttctcttttgtttttctttgtgtccctccccattctttccaaaattgtgctatttcttatttgtaggctggggatatctaagatgtataattttatttccattcaaaatttctaccacttagaggagatttcctcttgaatgacctaccaatatctcaagaagtaaggaatttcttttttttttttgagatggagtctcgctctgtcacccaggctggaattgcagtggtgcaatcttggctcacggcagcctctgcctcctaggtttaaatgattctcctgcctcagcctcctgagtcgctgggattacaggcacgcatcaccacgcctggctaatttttgtatttttagtagagatggggtttcaccatgttggtcaggctggtttcgaactcctgaccttgtgatccgccagtctcggcctcccaaagtgctgggattacaggcgtaagccaccgcactcggctgtgaaatttctttacttcctaaacttctgtggtgaataaatgtcttgtggaccttaattagcacgatttcctaaagaagtaacttttaagttccatgcttagaagcaaagcgtgcatgaaaaaagaacgcctgttgccagacattttataacaatgatctgtgtcactacttcacagcagcactaccattgtcattattgtatggtactcctcatggtaccctggctttccacccatcctcagctcaccaccacttaattgtgaggacagctcgtttcccctgactcatttactgtgcttggggaaatcacctttgttctaccctccaaagttatgaaattatctcccaactaggccagagaggcagttactgttgtggtatagttttaaaatgctgagtaccacacggatcaaatacatttccattattagtgtgctcatacttctcatctcatttcatattgcaaaattttaccaggatgggtcatgatgaggagttgtcacataataactcataacaactgaagtgtcagttttatgggtgtttatcacactaatgtcttttagaaagactcatggcctttttttgtttttttgaaataggatgagtaagattgattgtaagagagagagagattcttagacagatgggcagattttctttctagatttcaaaatcagagtgattgtcattagttacaacttgaactaatcttttaattgcagttttaggctcagtactcctacacaagcttgagacttcaatattttgaagaatgtgaaaactagcaaaagccactacatatttcttgtcccagttcttcattcttctagccacaggttttatttggatataacaaatttgcatttttgcccttatactgttaggtcacagagttatgtgtggatgccaaccccattaaaaaaatgtagaatccactcagtttttatatacctgcagtattaattataacaagattgatgagactattatgaagttgtaagcattttcaactgtttatgaaaaacataatgtataacttttaatgagcaatttttctcagtgctctaacaaatacagcttcacattgcaaacactcagagtctagttttaggaaatatatatgaaatcctctgtattgcatcaaaaaatattcataatttctcatgtggcgataactagaagatatgaaattagaataaatagctgaataattcaatagtttgatgtagccattctctaaatatacctcttttctttctaaacaaaaggaaatcattcaccaaatcctcttcctactcaaaggcttttgtgttgacagttttctcaagatttgccattaaacacgattcaactttgtggatatggttccaaatagaattttaatggagatgtagaataattttattccatataatttcaccaccctttggcttttaaattatgtttaaataatatatataaacacacatatatatgcttaaatatatatgtttatatattattgtaacgtaattatatatttaaacccatatatgtatatctaaaaactggctgattaagtaaatataaccttgcctttgggaatttccttacgtcttaaacttctgtagagaataaatgtattgtggaccttaattagcacaatttcctgaagaattaacttttaagtttcatgcttagaagcaaagcttgcatgaacaaagaacatctgttcccagacattttatacaatgctcagtgtcactacttgacagcagcactactattgtccttattgtatggtactccccatggtactccggctttccacccagaagtcagtctgacacaactagcaggttgattttatcttcacactccattgtcatctactatggactgaattgtggctcccaaaattcatatgctgaagcgctaacccccagtgtgactgcatctggagacaggatctttggtaggtaattcatgttaaatgagaaaatgaaggtggcaccctaattcaataggactgtggccttattagaagaggaagtgctctctctcacttgctcacacgctctgtgtttctgtctccctctctctatctttcatattctttcttcctccccaccatgtgaggacacagaaataaggcggtcttttgcaagccaggaagagaatcctcaccagaaaccaaatcctgacagaaacttcatcctggacttttcagcctccagaactgtgagaaaataaatttctattttttacgccatggtggtaatttgttacggcagcccaaccaggcgaatgcaccgccttcatcatgttgtctctctctaccgcattcattcttctatccttttcatttcattaaaaacaaatcattatgtaacataaagtctggatacacagcaaatgttttcatttgttccacattttgaagaacttttaatctcacccaggggagcatatgaactagtttcagaaaacaaatagcatgaatttggaaacataatttcttaaggctgaaaaaactaaaactatgagttaagtttttagaaaatgctacaaaaagtatctttttttaatgcagaaataaaaacacacaaggaagaagtagaataattgctaactataatcttatttagaaaagtgagttcaggctgggcgtgggggctcacgcctgtaatcccagcactttgggaggccgaggtgggcagatcaggaggtcaggagaaggagaccatcctggccaacccggtgaaacccgtctctactaaaaaatacaaaaaaattagccaggcgtgctggtgggcacctgtagtcccagctacttgggaggctgaggcaggagaatggcgtgaacctgggaaacggagcttgcagtgagccgagatcgcaccactgcactccagcctgggcgacagagcgagactccgtctcaaaaaaacaaaaacaaaaacaaaaaacaaaaaacaaaaagaaaaatgagttctagaagagcatttcagcactatattgtcaagcaattaggaagaagcgccttgcactgaacatgtgtttaattctttagattcatagatatcacagcacaacatcttcaattaacttgtaaatgtttatagtcatggaaaattcctgtcagagaaagtatcggccgggcgcaatggctcacgcttgtaatcccagcactttgggaggccgaagcgggcagatcacaagaggtcaggagttcaagaccagcctggccatggtgaaaccccatctctactaaaaatacaaaaacaaacaaacaaacaaagctagctgggcgtggtggtgcgtgaaagcagaatcctggaattaaacattgactaagtttgtgataaactctggggagacctagaggagaaactaaatacataatcttgtaattttataagcattttgagaaagtgtgagtggtagtagcaaatgtaggtaactccaaacaaacatgaaaaatagcatgatttgcaggatgtggctttggatgttgtgggcaccatggacatggttggggcatctggtttatggggatgagcacagtatttgtatccagagtatatatctctggatctgtgtcacagacacactacatacttagggcaagaagtatcagcactttgagcctcagccttcttgcacaaaaaggcaagaaataacattcacctcctaggatttggagatgattgaatgctttaatatatgggaatagaaggcatgctgaaactgattatttcttcactctaaaaatgattattttttgtaaataataaacaaaaaacaagcaaaaccataacagcatgcaagaatcagtgtgggaagagcagaaattatgttgccgtgttccaaatactaccacctacattttaacagttgttgagccctgtgcaatttagttagcttccagctgagcctcgattttcccacttctagagcaagaattatcacagtttatacattatttgcactataacttggtgctaaataaatgggaaatatacacagtcgatgcagaggaaactgaagcacagagagattaggaaagttgcaagagaaagcagagctccaccatgacacagctggagatgacactcgggccaggagccaggacagagctccaccatgacacagctggagacgacactcaggccagaagtcaggacagagctccaccgtgacacagctggagacgacactcaggccagaagccaggacagagctccaccgtgacacagctggagacgacactcaggccagaagccagggcggagctccaccgtgacacagctggagacgacactcgggccagaagccaggacggagctccaccatgacacagctggagacgacactcaggccagaagtcaggacagagctccaccatgacacagctggagacgacactcgggccagaagccagtacagagctccaccatgacgcagctggagacgacactcaggccagaagtcaggacagagctccaccatgacacagctggagacaacactcgggccagaagccagtacagagctccaccatgacgcagctggagacgacactcaggccagaagtcaggacaaagctccactgtgacacagctggagaggacactcaggccagaagccaggacagagctccaccatgacacagctggagacaacactcaggccagaagccagggcggagctccaccgtgacacagctggagacgacactcgggccagaagccaggacagagctccaccatgacacagctggagacgacacacaggccagaagtcaggacagagctccaccatgacacagctggagacgacactcgggccagaagccagggcacagctccaccatgatgcagctggagacgacactcaggccggaaggcagggcagagctccaccatgacatagctggagatgacactcaggccagaggctaggccctttcactccactgcctcataaaagagatgcaaatctatgatgatgcaaagctggcagggaccgctcatgcacatcaccccaacaatcaagaagctgattctgagtaaaaaagataaaacttaaataggatgctgctttaaaattcaattgctccattacaggataggggaaagctggttgggaaattgcatgtgcaataaaattctgacaatctctctctctctctctttttctgcattcagtttagaaggttctatgaaaagttttctttgattacacattttaaataaataaagcaatagagaaattatgagaaaacctaatgaactgttttcaatagtaaaaataccattcatataaaaatctagtaaagctatgcattctatactgttaaaccacctctttttttgttgttgtcgtttgcttgttttttgtttgcttatgtaacttatttgttcctttctttttatttttcaacttttattttagattcaggggagataaccttttcaaattggattttaaattgacacactggagtgtttgggaggggagtctggagacttgttatagaacactctctttgaaggatttattaggattttctctgtgcaacaccattgaaagtaatttgcttttggctgggccaccaacttttgggaatagcgcaaaaagaagactacttcatgaaattcaagagcgagttaaatggacaccttttgccatccccttgttgccataatgttagaattcttacatatctttgagatatcttgtttcgacagacacctaatctaatccattcttcatgcttacctgcttgaataatcttcagaaattgcaatcctcattttatcattcaattattttaaagcccatacggaccctccaaagagcagcatgtgatacctggagccatctctgacttgtcctctatgtcaccccatgcctcctcctcaccaacctcattctcttcaccacttgttccaacgtttaaaaagcacatgctagtttcagatagagaggaggaagaggctttgagatctattgcacagcagaatgactatagtaaataatagtgtactatgtatttcaaaatgactgagggtacatttcaaatgtctcaccatagaaatgataggtaggtgaggtgatggatatcttattagcctgacttaatcatgccacattgtataaatgtatcaaaacatcacataattgtacctcataaatgtatataattatgatttcttaaaccaaactaatagtaataataaatttaaaaaaatgaaagaatgaccaaaaaaagagggggtggggagaagcacatattcaaggctggtttcttggtacatgctcgtttctctgtctttctctcgcattaactggctagagtcctacttatcctttaatacttggatcagtctcatttccttctatgaaatcttctgtgatgtccctgtctttgtttccgaattctgctttgttttcttgtgtcattacagtcccctgctggccctgttttctgccatgggaacattttactcatttgttctatgtttaaattctccttgcctcctcaggacctagttttggtctgtagaaggtatttactaaatgcataagtaaatagattgattccggggttactgatcaaaatatgtgcttctgtaattctattgtcaactattgtcccaaataaatgctcatgctggcctgctcttgtcacctttttacggctcacttacagtcattgctgcctcaattcatttgcaaatacattatttcacctgccatacaaacttatttgcatttttttcccccaattctactcaacactctagacttggttcaaatttgactttttctttagccatttgtctttactactgtgtaagatacaggatggcagaaattttttattctattgtcttgatttttaaatataatacctggtacaatgcttgatgcctattagaggctcaatatgggcttggataattatcattctttgtctctttggctgttggcttttcctatgccactgagttttttttttttttttgagacggagtgtcgcactgtcacccacgctggagtgcagtggcgcgatctcggctcgctgccagctccacctcccaggttcatgccattctcctgcctcagcctccggagtagctgggactacaggtgcccgccaccatgcctggctaattttttgtatttttagtagagacagggtttcaccgtgtcagccaagatggtctcgatctcctgacctcctaatccgcctgcctctgcttcccaaagtgctgggattacaggcatgagccaccgtgcccggccagccactgacttttaaaaaatgtatacactcagtcctaatctgttcctggacctgaaaactactgtggtgattctggaaagggggtcataattgggtctgagaggactgtctccttaatgcttttatttggggtcccatgtttttacctcccattacctagagtagtccatgctctttgggtaagtgagagaatctccttcatcattctgggaattcagtagaacagaaatgattgttaattcctgtgctcaaacccaacctaaacctaagtggcccttccagtcattttaccttgaggttgaagaaggaagagaggtgaggagccagcagtaggaatgttcagacctaggtcaggagatgccgattctcttcagggggtctggaatttaatggccagatgggcaggactaacccaaattcagcgaagagagaaaaaacttgctgacattagaggggacctccggaggtttattcttttgactcctctgagacctgagttactacatgtagataatagttcaggggcttagtaggtgaaaaggagcattctagagggatttctgctccttctaatttattgtctttaaaataatctttgtcttagggaatatacctgagtgagctgaaggcaagaccctgaaacaataaaattgttgtacaacaggattaaaatagagtctttggccacatcatgttttcataggcttcctattaaagaatgtgcagagggacagaatgatatccatcccaggggaatttttgttcaaaattttatagttaattacatgtgaagcaataacctaaaaagaataaaatatctaggaatatagttaaccaaagaagtgaaagagctctacaatgagaattacaaaacacctctcaaagaaatcagagaagacataaacaaatggaacaacattccatgctcattggtaggaagaattaaaactgctaaaatgaccacactgtccaaagtaagttatagatttaatgctaatcttatcaagccaccaatgacattcttcactgaattagaagaaactattttaaaattcatatgaaatcaaaaaagagcttgaatagcaaaggtaatcctaaacaaaaagaacaaagccataggcatcacaactatattgtaaggctacaatcatcaaaacagcatggtactggttcaaaaacagatacaagaaaccaaaggaacaaaatagagagcccagaaataacattgcaaacctacaaccatctgatctttgacaatgctgacaaaaacaagcaatggggaaacgattccctattcaataaatggtgctgggataactggctagccatatgcagaagattgaaactggaccccttccttacaccatatacaaaaatgaactcaagatggattaaagatttaaatgtaaaacctaaaactataaaatccctggaagataacccagaaaataccattctggacataaaccctggcaaaaatttcatgacaaagatgccaaaagacaccaaacaattattgctctttttgcaataagagcaaaattgacaaatgagatctaattaaatgtaagagcttctgtatagcaaaagactctataaacagagtaaacagacagcctacagaatgtgagaaaatatttgcaaactatgtatatgacaaaaggtctaatatgaagaatccataaggaccttaaacaaagttacaagcaaaaaaaaacaaacaaacccaaaaaacaaagaacaaccccattaaaaagtgggcaaaagacatgaacagacacttttcaaaagaagacatacatgtgaccattcagcatatgaaaaagtgctcaacatacatggggcacagtggctcacacctataatcctagcactttggaaggctgaggagggaggatcacttgagcccaaaagttcaagaccagcctgggcaacacagtgatgtagcgggacgagctgcagacaaaacctctcagacaccgagtggtagaaggaagggctttattcagctgggagcatcagtaaactactgtcttaaaatctgagctccctgagtgcacaatttctgtcccttttaagggctcacaacactaaagattttacatgaaagtgtcgtgactgatttgagcaagcagggggtatgtgacaggggccgcatgcaccggtggtcagagtgaaacagaacagaatgggaggtttcacaatgtccttccatacaatgtctgggatctatagataacatcagttgctaggtcaggggtggaattttaactactaggtttaggccaggcaggcccaggcctggtttcgggtctgattttgggtctggtgcctggcgccaggctgcctgcctttggtttcacttccttggttttttcttaaaacaggtactgagtataaaacaatataaaacagtatgagagggtctctctcttctctcagtgagattccatccctacaaaaaatataaaaattatccaggcatggtggctacttaggaagctgaggtgggaggatcacctgagcctgtggaggcagagattgcagtgctcaaaccactgcactccagcctgggtgacagagtgagaccctatctcaaaaaataaaaaaaaagctccacatcagaaaaatgcaaatcaaaaccacaatgagataccatctcacaccagtcaaaatagctattattaaaatgtcaaaaaaataatagatgctggcaaggttgtggagaaaagggaactcatatacgtgactggtgggaatataaattagttcagctcttgtggaaagcagtttggtgatttcttaaagaactcagaactaccatttgacccaacaactattcacaatagcaaagacatggaatccatttaaaagcccatcatccgtagactggagtttttaaatgtggtacatatagacaatggaatactatgtagccacaaaaagaatgagatcatgtcctttgcaataacatggatggagctggaggtcatcatcttaagcaaaccaacacaggaacagaaaaccaaatactgcatgttctcacttgtaagtggaagctaaactttgagtacatgtggccacaaagaagggaacaatgatcaccagggcctacctgagggtgaagggtaggaagagggtgaggatcaaaaaactacctatcaggcactatacttagtacctggatgacaaaataatctgtacaccaaacccctgtgatgtgcaatttacctgtataacaaagctgcacatgtatcactgaacctaaaataaaagtttaaaaaaaccaaaaatacccataaatgttgagagaacaaaaaaagttcagaatgataacatcagtattataccatttatgtaaagttttaaagtgtgcaaaaatactttattatttttgaatacatgtatgaattaaaatgaatttgaatatatgtttgaaaatgataaacataaaatttgttttacctctgtggaaagagggaaataatatgttctcaggatctttgaatatacctatgttttatttcataaaagacctggaacatgtaatgcagatgttaaaattttataaagctgagtggtggttagtctgtccattgttatcttattttgtctatgtatctataaatccaaaatattttataagtttaaaaaatctaccaacataatgtcaaataatcagttttactgacattttcttgaattggctgaaataaacaggttttttgaaaaaaattacatgtgaagcagtatactttaaacattaaacacatcacttcagtagaaaattgagaagttatttggatggatagatttttattttcttgccatgggggcaactttatggtatccttatgaaatactgtatttcacagtacagtttttcttgaactgtactttttctacaatgaaaaccattattttgttccagtcttccaatgttaactattatcaccaccattcagagaacttcagagaggacgaaactgcttagttttactttatgaacaagttattggctaaaatgacttttccccaccatgggggagctggtgatgagcttatgcactcccagcttggagagacaactgtcacaaatacatgttttttatttgtataaatgtaagggatacaaatgcagttttgttacatggatatattgcatagtggtaaagtctaggtgttggctgtaaccatcgtgcaaatagtgtacattgtacccattaagtaatttctcatcccttatccctgtttcacccttctgaggcttcactgtctattattttatttatttatttattgagacggagtttcactcctgtcccccagactggagtgcagtggcctgatcctggctcaccgcaacctctgcattctgggttcaagcggttctcctgcctcagcctcccgagtagctgggattacaggcgctcaccaccaagcccggctaatttttgtatttttagtaaagacggggtttcaccatgttggccaggctggtcttgaactcctgacctcgtgatcggcccacctcggccttccaaagtgctgggattacaggcgtgagccaccgcacccggccattcactattatttcacactcttcctccatgtgtacacattatttagctccacttacaagtgagcacatgtggtatttgactttctggttctgagttatttcactcccacatctaaaaactctccaccaatcttattttatactcacctgatttgattcacaaaagaggccgttccgttcctcggcctgcaggtctctaccacctttttggcattctgtggttcaagtcgagatggttggttgtagagattgcagaagacttacattttatacatagaggagtctgggttcctatggcagtatcaattatgacaactttaagcaagaaaaggtgggaaaaatagcagaggttacaaagaggttgcttgagggagacaaaaggaaagaaagaaagctgttaataaaatatgtcattttgacaatgaagtcagaatccttgcaacaaaagaataatgtatttacttttttcttttctcttttttttatttgaagacagagtctccctctgttgcccaggctggagtgcagtggaatgatctcagctcactgcagcctccgccttccaggctcatgcgattctccttcctcagcctcctcccgagtagctgggattacaggcatgcaccaccgtactgggctactttttgtacttttattagtgacgggctttcactgtgttggccaggctggtctcaaactcctggcctcaagtgatccgactgccttgaacatgagaacacaggttgagccacagcatggtgcagctgctccagtttagacggagctcagcggcagctcctgctcccaggtggatgcagcactgtggactttggatcgctccatccgatagtgttagctagtgttagcggcagcaaagatggcggtggtgctctgtcgtgaaggttgcatgtgtgcgggcggaaccaaggcctgctgatgtcctcctgcctcactttttccctttggagggaggttgcagccaaggagatccctgttggccctgagctgtgctgggctggggaataggttaacacaggtccaatgcttccagtgctttctatacggccatcctcagttttcctgcttcaatgggctgctgaaccttgctatttgtaccctggagctctcccagagttatttttatctgggagtagttaaatcattgttcttgttggggagcaacggctgggaccacgtaatctgtttccttactgaagacttcccattttctcccaatctcttcttataagaacaccagtcatattggtgaattttagggtttagagccctccctaatagcctcattgtgacttaatttcttctttaaagaccctatcttcaaatatagtcacattctgtgttcctggaggttaggctttcaatataaaaaattgagggagacacaattcaacccattagaaggtgcatttttacatgtttttatgtaagaactcttagcatcttagggatgctaagatgatacatagcatcatcttgatatgtagcatcatcatgatagcatcatcatgatatgtagcatcttagggatgctaactcttagcatcttagggatgctgatgctgtaatgtttgcttatagaatagatatctttcttatggtgacactctggatttatttttctgcctttaaagcactgacacatttaagttttgttgtagttttaagtgtaaaatgatgttttatttcatgtgacttttgccattttaaaaacatcatttattgaattaatgtgttctccatcctcattttatgctaatctccccacatatattagtactagttttatattctcaatgatttgtaatgttttttggcaactcaacattattttagtttcagtaaatttatgctgatatttgaaaggaagggttttttttttttttaagagattgctaataccagtaggaagggatgatggatatgaaatagcaacaagaaggaatgtcccatacaagggagtcccaggcatgtgagaggagggaagcccatagcacatagcatggacttcgacaggagtagagcccctctttccactgagacagggcaaaggagcatagcaaccgaggctgcagagagcctgcagagttagaatgggaatggaggaattctctgtcttatgaattctgttttctctaatcaagtaggaggctggctcttttactgagaagtgattgcttcctaagttgtatgtaaatgagttcctctagatattgctatgcaccgacttataccatataaactctatattaatataagtgaagattttggtatgcacaatgggcaattagagtaaatcaatattccctatagttttccacctaattatcacagggagttctgtttgttcattcattcagccattctctctttccatctctccatccatctaccatctaccatctactacctatctcctatctatctatctatatatcatctatctattatctatcaatcatctatgtatcatcatcatcatcatctgtcaactatttatttatctgcaactctactctaggtaaggatgatataatggaaaaggtgatgggtgaggtgcctgttctcacttagtttatatcctgggttggggagactttaactagtaagcaaacaagtaggttcaaaagataatttcatacaatgggaggagttatgagaaaaacaagagtatagtataaatgagttataatctcttacactatttattttgagactcaaaaattttccaatattttattagcagaacttgttcaatctggttcctgtgtccagatgatggacctgttattcttccttcatcacctcttgctccaggcctgaatccacaactgtttctcccaagaacttctttttagtggagaagggatttagtaactaaataatgggtgttgggaatgctcagtgctactgcagtgttaacgtttttaggtgttctcagctaagagctaggaaatatgcatgcatgaacacacacacacacacacacacacacacacacacacttctatatctacataaatctccatgtgtattttttttttttttttgagacgaagtctcgctcttgtaccccaggctggagtgcaatggcatgatctcagctcactgcaacctccaactcctgggttcaagcgattctcctgcctcagcctcccaagtagctgggattacaggcgcctgccaccatgcccggctaatttttgtatttttagtacagacggggtttcagcatgttggccaggctggtctcaaacttctgactccaggtgatccgcccgcctcggcctcccaaaatgctgggattacaggtgtccaccaccgcaccaagccctctgtgtgtattttaaaatcatgaatatatactgatatttccaattaaaattcaataccataagatgtattgtagtcttcctctttccttatatggaatctccctttccaatagtgaaaaactaggcctccagtaacctcaatatatttacttattttctcaatctgtcagtatataacttatctttggcaacctgtgccatgtctttggcactggtcatgttggctaacacccttcagatgctccctcatgttctttctgttcttggaaacacactggctgagcccctagctatcccccagccctaaccctggcaggcataccaagtgaggacccagtaagctagaagccatgtttttaagagacaatatgaagctagaaaagatacagaataatttgttaaacaaaacaccaaaagcagtatttataaaggaaaccatcagtaaataggactgcgttaaaattaagtactgtatcaaaagacaagagtaagagcagggaaaagcaagcccatgatttgaaaaaaaagatatttgtattacacataactgataaaggtttcatagccaagccacatgaaaaatttgtataaatagataggaaaaaaggtaagaatccaatagaaaaacaggctacttaaaaagacattttttaaaagaggctatctaaatagtcaatgaatttatgagaagattcccaacttattattagtcagtgaattgcaaatgaaaacacatagaaggattactaacatgcctgaggcctgaaatttaaaacttgaccataccacatgatggagaaatggagccaagaacgccattcactattagtgggagtataattgttatgacattttagaaaactattgggcattttttttttcattaaatgtgaacatgtgcatttcctaaggtcatgattttacttctggacagacatttaacaggtatgagtgcctgtctgcacaaaaaaaaaccctacaataatgctcacagcagtcttatttgtatcagcccaaaacagaaaatgatccaatatctgtgcacagtaaaatgaacaaataaagtgggatgtattcgtatcatggatattatccacaatgaaatgagtaagagcagcattgaacagaataatccagaaataaaaataaacctgccatttgctttcacttatgtaaatttcaacagaaaggaaaactaatctatagtgttattgagcagatagggtttgagtaggatgacggagaaaggttatgaggggactttgggtgttgttttcttttttttttaacctgaatggtggttagatggttgtgctcactttttgatctaagcacatttctctatgcatgatacactgtaatgaaaatgttaaaaaataaatgccttcaaacacttactagctctatttctttacccattttcttctggaatacctaaaatagtgaatgaaaaaagaatggaggagcagttggcagataggcttaggagaacagaggaggagtgatattacaaaggtaagaacatacaaagtataatatgataatcagtcactccacaaaatcagtgttaatgatcttcttaagagtcacaaagggaggccaagcatggtggtgcacacctgtaagaacagcacttcgggaggctgaggtgggtggatcacctgaggtcaggagttccagaccagcctggccaacatagcgaaaacccatctctactaaaaatacaaagttagctgggcgtggtggtggcacatgcctgcaatcacagctaactcaggagactgaggcaggagaattgcttgaacttgggaggtggaggttgcagtgagctgagactgcgccactgcactccagcctgggcaacagagcaagacttcgtctcaaaaaaaaaaaaaaaagtcacaaaagggttgggcatggtggctcatgcctgtaatcccagcactttgggaggccgaggcaggaggattgcttgagcccaagagtccgagaccaacctgggcaacatggcgagactctgtctcttaaaaaaaaaagagtcacaaaagaaaatgatgttccagtctcgttcccaggtaccatggctgatgacctcttcaaactggctttaagaccaggttctttccactgaccactgtacagaagaatcctcagcttagtccgtatctgtcccctttcacatcctcaagattttctcagacttcaccacacaagaatttagctgtaatttataactattacctatggaattctcactatgtgtgaacactgtcaaatattttatatacagttgtttgtcacttcatcattacaacaatcctttaaattaagttatattgtgcttccactttatggatgaaaaaaatggaagcttatggaggttagtttgtcaaaattataaagttattaagatgcaaaatgtgggttgaagcccaagtttgtttgtttccaaagcctttacaccaaaacaaacacaaattattggacaatttagctaaagtgcttcagcatctccatcggtctctggtgatgtggtgtcctgtggttcctgttagcttacaatcaccctccttcccaactaagcaggttctccaggaacaggtatgaggtgatgcaggtgagttgcttcaaaaccttcctttcttcaggaacatctcaagataagaatataggtagaagaattcatacctcagtctattaaatgatatcattaacatgcccattgagacttctacagggatttttgattttacagttggcaaaaaaatacacctaattcctcatacaaaaccgcacagaaatcccacatggagaataaaattgtgcaacacaacctgtctaatggatccatcttaaacatttcttcatgtcatagtaccacaagaatattactgaaacattacagtctacctaaagagaacttttgagtgtgaagagatgtgggcctatgccagtggttctcaaacttgctgtgcctcggcgccacgtagagggtccatgaaaacacaaattgctggaccccatcccagagtgtctgattcagctgctttcgagtagggtcccagaacgtgaaactctaagaaattttcaggcaatgctcatggggctggtcctcggaccacactttgagacttgctggcctggagattataggtaacttgcccatgttttgtggctgctgagagagttagggcccaacctcagggccaggtgtcagctagctctctgactgccttttcatctgcctcattattgctgttaattactgttcaaggaccaaactatttctaggacttcccataagttctaaacatgtatatgggattttgatcctaaggattttgtgttacataatgggaattttaaatatttcattttcaagctctcccacagatacccaaactcaagaaaacgggcacagatgcaaatgcatgtattcaaataccgagctgcagacctcacacgaattaggaaaagtcactaacgattacaatactgcactcatcccttagtatctacgggggattggtcccaggactccctgagataccaaagtccgcgaatgctcaagtcccttgtataaaatggtgtcatcttgtatataaactatgcacatactcacacaaaatttaaattatctctacattacttataatacttgatataatgcctctccaccacttcatttgtgtggattcaatgtagcactcggtgcatagcaaattcaagttttgcttttggaacttggtggaatttttttcctgaatattttccattcaaggttgattgaatccacagatgtggaacccatggataggagggctgactttatattaaaattgttgataccaaatttgagttattttctgtgaatctcaacctgtttataagcagacacaaagaaacacacatacaaagagttgtagatacttccagaaaaaaagctatgcaaacacatccacaaaaattcacggttaaaacacaaaagctagagagatgaagaagtttagcaatatttgttatctgagtaaaaatacggcttcattatcttcatgctttagtaaattaagccaactggtcacggttcattaataagagacctccaattatttccttttccatttatttttaatttgtattcattaatgaaacactgttaaaggaaattttaaaagaaaatatattctcattaatcttgtccgaacactaactatactttaggtatgtatctacaagttcaaatgataataaattcatagcttattataattgaaaacaagcatgtattacaaaaaaatcctactgtgaatagtagtttctttacttgggaataaatttcacatgtatttttaaaaaaatcataaaaataagagggaatataaacaccaccacttttagggtgctaaattgtgtattaaaaagcttcacataagtcttgaagaaaagataattcatatcccttttctgccatagattgcactgtgaacctaatggacttcattcactcctccaggaaagggaaatactgaatcaagaaacaaattgtaaacatcaatactatagaaggtgttgtgttaaactccaaatgcaaaaattctctttcattttagctagaaatatctattttcaaagttctagaaatgacagaatcccatgcagtaaaaagacaattttattatttaaaaaaaaaaaaaacttaaaatgttaacttggagcctgaaaaaccatagtttgaatctctttactaattatcctccacctcaatagtatcagttccattttatttaatgtaatgggaagggtaagagataagatgattggtgagaggtggttccagtttgggcagccagtggctactagttatttgaccttgagtaagtcagtcaccacagtgtagttggaaattaatttttccttatgtaaaattagaaaataaggtgtttttttcaaactgtatgcaagtttttttaatcaataaatgttaacagctgatattcaagaaaattggagatattctattttctgctacttcttaagaaattcctattttgacttaatacaccaatgccagtttaaaaatgctaaataaaatcttccacacacatgatttttggcagctgtatggaaggctgatgttgccatctagtgtttctgtttgagaggtctcctgtaggaggtgagatgggagagccttggctactgggaagacacatgcacagtgaatgtggggagaggtagggcagagtaacccacacaggactctcctggatgaacaccagcctcctgatgtagccccatccctgcaggaggtaaaaatattgagtggaatggagggaagaactgaagtttcctgtggcctcttaatgtggcaataacagacccaagagtttcctatatcagtgtcccccttacctcattatttcttatattggaggatgtacattctttggggatgcttgcctccccacattttaatgattttaattttgtgagtccaggaccaaatgaagaaattgatctacttctgttttgacatagaacccagaaattaattctcttttcaagaatacctgagccccacatttgggaactttctgtgttgcctccccggtgagttttgtgtttgtgtgtgttgtggggggcggggggcggggggggggcggtggccgggccaatctctagatgacacgagtccctgaggtcttagctctgtgaacaagctgatgtcacttttcctcatgcccctagatgactccaaatccccaaggtgagatggcattgaagttgtcctcctatccacttagtatgaaccaatcaaatgacattgtctatattctcaaagctcttagaactaagtgtgctttcctttatccctggggctggtctgccatctccttgaccctagactacctgtatatatggacgtgagataaaacatgttgacttgaaatgtggcactatgccacaccactcacttagcttgtcattcctgcccacagttcatcatttctcttccaagctctgctacttaaaggcttattaacacttaaatgggacagacattatttttgtgctcaatctcctttcagggttttcagtgtaatttcctctggaagatccagaaactaaaagggacaagaattagctgccttatccatgagaaaactcctggttggtctccggaattgaagtaaggagggttgacagaatcataggtcttctactttctgggaagaacaagggtgagattttaatacaagctttgtcgtggcaatgagatttatatctgtatcttcagtcgtctgtatgcagatatagagttatcttgtaatagttttgattagagtttatatctgttagaacaccagagtaacgggtttctcaatgccaactcgcaatttggaactccattttggaaaagagacattgtatccaactcggaaacaatcaaatgcaccaaattctagcaaagtgtatctaaagtagattaggagtgattatgtgattatccattatccatttgtccattgctagctgagccaatcctagggcctcttctgagcctacatgcacacacaataaaccaatctttttagtctcttgataaaatgatagctgatttgaacagagaaccgtgtaattctgttttcgcacaaatcaagcattgcaaatctctggcgattttgagagtgatcacaagcttctctctggaaactgctcatgatgatggattttattgttaggattgtaatgtgtaggttaatgggagtgctgtaatgagtgatcaactttaaacaactacagctttaagtgggtgagaaataggaacagggaggaaggcagaatgaatggaaacttgggttaatgcatagggctggcactataaaccttgctctgatatgaagctgtagtgcaagcattggctattctttcttcttctctattattgaggttgatcatctctaacatggagattctaatgcctggcctgtccactttgcagggctgctgtgatgatggtctgaaactagagtgtgaaagctctgtaaaagtctaatgtacgctaatgtgaaagggttgtgattgtttatgttgtgctctatacctaagccaggcaaaaatagctctattgcttggcattgttaaatccttttcagtaagcacagagaaccatttggtggattctcctctatatgggttggtacagttttgggcataaccttcagccagagaatcaacccaattcagaccttggcgtctaagttttcaaaattagtaagcatttatagtattatgtgtcaactaaactattaaaggtatttgggcatttctaagagctgtattccttgcaatttcatggttctgaactaaagagctaagaaatgtgagaagacaggatgcattaatttatagttgaatacctgttaggtgaaacagagaagagcctctgcatatttgtcataagggtgagcagtgggacattttggattgaaagaataaagcattgtgaaaaaaagtagttttgaacagatgactacaaggtaaatttgcagttttggttaaggagtcagaccctaagtgataaactttgctgagatcacccaaagtgatcacaactttatcacccaaagtgataaagttgctgagcaatttgtgtagcttgtcattgccactcttgaggtctcctgaacctgggagaaaacttatgataggtctgaggatacagaagtacaagttgttcataataaccaacacctgtaaaatgtgtgtctgtgaaagtctcctttgtgagtactcaggaagcctctgaaagtcttccattctttgacacttggctggctacttctgatagaccctgcctcttttaccctttcatagggctttgcagagggtccggtgcctggaccaatggatgggaactacagaattcccaattgcagctccaacaggatacagctcatagcatgtcagttgtcaggatggacaggtggtgacagcggctgcatagacacatgtccttcaatgtgtttctgtgccctcattcccacagcttccttcttgtgtgttgcccagatgccgtttgctattatcatagcagatacaagcctgggtggatattggctgtataaggcagagtccccatcaaagcccttggcttagactgtggaaatcctcaatagctgaaagtgctcagggtatatactcagtgtcaccagttacatagacatgtgaggtctgagtggggacttagagaagatctagcctctttcccatgttgcacaaggaaaagccaagttagagagagatgaactgaatagcaggccatacatttgcagacctgtgttttacagaggcagaattaaacctatcatcacagtcctttcttgtagggtcaaaaatcactgtgtttcatcttaataaaattacatgccattaaggagttgcctggtacgtacattcatggcttccttaagcatcacccataaatgtggtccttcatgactttgtatatactacctcctctttgtgaaacatatttagctcaatctgccacatgtcaaattcttacttattatttgcaacaaccaaaaacaactctcagactcagcagtctcccttaatacaaactgttctacacaggccctcctgatcacttgggagtgatctgcataatactcagccttttaacgcatcttcttttagagaactttctctttctcccttctttgtcattattcatacacattattcaccaaggagggaagctccagagtcaattcatcccgtcttcctggggcatcaggcacacgactttgcatgtaacaggtttcaataagtctattctaaaaaagcaaagaaagggcaaatggctctcttaacttcacagacctgtaaatggaaattggagagtgccagatcatctgcatgtgcccccttatctaattctttggttgtttctctgtaatagctggtggattatgggaaaggacaatgccagttacctacaggcattcatcctggtgggctcttctgatcggcctggactggagaaaattctctttgctgttatcttgatcttctgcatcctgaccctggtgggcaacactgccatcatcctcttgctggtcatggatgtcaggctccacacacccatgtacttctttcttgggaatctgtctttcttagatctctgctttacagcaagcattgcccctcagctgctgtggaacctggggggtccagagaagaccatcacctaccacggctgtgtggcccaactctacatctacatgatgctgggctccaccgagtgcgtcctcctggttgtcatgtcccatgaccgctatgtggccgtctgccggtccctgcactacatggcagtcatgcgcccacatctctgcctgcagctggtgactgtggcctggtgctgtggcttcctaaactccttcatcatgtgtcctcagacgatgcagctctcccggtgtggacgtcgcagggtggaccacttcctgtgtgagatgcctgctcttattgccatgtcttgtgaggaaaccatgctggtagaagcgattcacctttgccctgggggtggctctcctcctggtgccgctctccctcatcctcatctcctatggcgtgattgcagccgcggtgctgaggatgaagtcagcagcagggcgaaagaaagccttccacacctgctcttctcacctcacagtggtctctctcttctacggaaccatcatctacgtgtacctgaagccggccaacagctactcccaagatcaggggaagttcctgactctcttctacaccatcgtcattcccagcatcaaccccctcatctacactttgaggaacaaggatgtgaaggggaccatgaagaaacttctggggtgggagaaaggggctggggagcctcaacgaggggaacactctagtaatgtagacagtttgctggagttactctcttagatgtgtctgtggccatgtggagaactaatattcaaggagtagagtgaacgcgggtgggaaaatgctttcgagtttgaccccgtcctctgccctctggatgtgaagtggtttccttctgtttgaagttgcctgcttcaggatatctctgctgtatcttgcactttccttgtctttttgatttatccacaactgctggggacttacaaaactaattcaatcacccaaaggcactgggcagtctgcagattatgtcatggatgtcaaataaaaattgagacaacatgagtggccttttcttcaagcccttttatttgcttctgtggcagtttttcaaagagagaggggtcaacatcagtaaagttatagtgccctgtcctggatacaggttggttctgtatgagtggggaatgtcctttgagttgctttttgaaaaagcagaatttgctcagagttatttgcatcttctccttgaccttttcgcatagccaaagtacctacaaaagagctgactctagtcaggaatgcaagcctttgggaagaacagagcaaatgatacacatccagatagaatgaatttgttctccttagcagattaaacagctgtaaatattctacttcaaagagagctgtcctatactcaaattaattaccacccccaacctccacaaataactctgatgaccaatcttataaaatcagtgcatattggaattggacattactaaaagcagtgtttccaaaacttgatcgtgcatcagaacgcttaaggcacaaatttccaagaactctccaaatttcctgaatctacaatgccaggtgtgggtctaggcatctctgtctttaaaaagctccctaggtgttactgatgatagattttgaaatcattgttttagagataataaaaatccagctcctcacattacccaggactcttcctgtagcattctgaatccctggctgccttcactgggtatgaatgatcctgtgcaccaggcatggggaagacagtatcatccatatctggacttggaactgatttatcttctcaccagttagctttcgaagcctagcctttttcatctgtattatggaggtcatactcttcaccttagagggttgtagtagagattaagcaagacaaagtatgttaaatatgaggtgggtggtctctcagtaatactttttttttcatgtaccacaggcattgggcaatctattcttttgtaggtcttatgcaattgttatttagatcttgtttttagtaaaattctgcttcagtatttttccatttattatctgcaagatgcaaaatgttctcttccaggtgtagaaaacaccctttccttgcttctttcagattaggtagataggatccctcacaaactctcagagaactttgctgcctacttttgcaccctaatagaaatgtgggttggggggtgaggtggtgattcagggtaagtgtgcggatttcacattatttgtagataataccagttcaggctttttgaattatggggcagagcgtgtccatagactatcacagaggctaaatctatgagataacaaaaatacccagacagaaatggaaaaaaatttcaaagttgtttaaccaggtgttttggaactattgcataaaatatttcaaaacccattgctccagtcgtcttcctgtataataaagatgatcataggacatgtgaaaaatagatattctttaccctatttgcaaataatgtgactaaaacacagggaggctaagggagttgcttaaattacaaggcaagtgaatacctaagatggcattcattatttgtcaaacatttcccagggagtttttcattccattaactgcttacacatttaggtcctatgtggttaaatttggactttaggactgtttagtatccaaatgctattttttattgataaaaaatttaagtttttcttttaaaatcttttcttttaaagtttttcttttaaaatcatccaagggcattatcctagagataaaagattaaaaaaatttgtctgttaatccaaataccagtccttttctttactccaattctcctggttgagtttttgtggcataaaaactgccaggaaagcacccccatacatctaatgagtatattttcagctgatgtgcaggagggtactggccacagctgtgaacatcatttcccacgtgtttttttctttatattaatgctatttctgtgataaatttttcaacggatcaagttaaggagtattcattaaatgcatataataccctggaaattgtaaggaaatcaaagaaattgacatggctataggggcctgtccactcacagttcctagggtacactaccactcggacccctgtcatttgtcctagcactgacactgcaacagtggacgttttcatccaataacacctttatcttggatacagttagtgatgagttggagtttcagggtatggggagaggaatcaatcaacccatctacaaattgaccattgacttgtgtgctttagttttgtcaactttaaaataataagattcagaaaatatgattaaatgtggagtttatttgagggcaaagcttgagaattagccacctgaataacacagactcccaagaaatggagtcagtactccaaagtggaaaagttaaagtttactgatttaggcagaagcagagaaatttagcagagttacagtagttctcatataaggtcagtaaatacattatagtgatttgattaggtacagctggctacgtgccaaggaaaattgtttaacatgaacactccacaagaaggggtaatggtctcaaggaatcttatctctggtacgatttagtctttcctaatcatttacaggaaaaagcagaagttgcagctgtatgctacatgactcaggccacatagtcacactcctcttaaggctcaaaataatttaaatttccaacagctgaaatttgaattacttatttcacagtttgataaacttggttaatctgatttctctgtagggacttaagaaactgactcaaaggtcctccccccaaattctcatcaattggaaagaaaatagaataaaatactactataataaaattggacaaagtaatgatataacaaacagtaaggtagagatggaatagtaagaaaatatttgaccagagaattgaactagaacataaaattgtgaaattctgatgctctttaaaaagtatttgggaagtacagaaagacaataatggtacctgaaaaaaagaatttctgtctgaaaaaaagtttgtgtatggaaggcaggtagagtaagattgattgtaaatgatgttaaatctggctgggtgcggtggctcatgcctgtaatcccagcactttgggaggctgatcacttgaggtcagaagtttgagaccaggctgaccaacatggtgaaaccccatttctattaaaaatacaaaaatcagccggtcatggtggtgggcacctgtaatcccagctacttgggaggctgaggcagggagaatcccctgaactgggtaggcaaagggtggattccttccttccttcctttccttccttcctttttttcttcttctgtcagcaagtatactatgctaggacaatggagatacatatatgaaagacttaaagaaaaaatgcaacctgatgctgaaaatgtgccgtggaatgaatgaggtggtacttgatcattgaagtttgggtgtttctataggagatgaagtctgttttgagtcttaaagagtgaataagttagaaaggaaaagaatgggaaggaaatgctatacgtaaaaaataaaaagactgtgctggtcaaagagaagacgaaaggtattttgagtttggtagtttgacatgtttgtttgtagggttcttatggggaattgccatggttaaataatggaggcataggcaagaacaaggttgttgggcacactcttctaacaaaataccaagttgaggaacttggatttcatttttcctaacatggagagaaaatgaatgcatttaggaaagagagtggcataagtagggtgtattttagggagatcatttgctgcaatgtaaaatatatctcaagaaagggaagaagaaaagcattttaattaactcaagagagaagttgtaacaatttaattaagaaaactagagtgtgagtgaagaataggaattggattttggagatgttagggaatagaattttcaggatttaggatttgactggaagtgagaaatgagtaagagagaataaacacgacttaatctctggtatgtgattagcttttctggatgtagaaagagcaggttggggggtggctgcagactttaatttcacatgagttgataattaacacagttttctcccaaattagaaggaagcatctcaagaatcagtattttaagactaagggaccaaatcctgtgaaaataatgatcacagattcatcatgtcctctgagccatcctggcacagaaggacgtattaagcttttgctaacacactccaagctctggaactgagccattaaaaactgtgctgttcttatgtctgtgttgggcctctgaggtgaaggtttcttggggattgtctctgtcgtccctaatggaatgagctctgaggcctgggtggatgatgacaaccccagtcagggatgtgtctaacaagtcaatgtgtctggaatctcattgccctgggcaaaggcagagatagtttgatccgttgggtctttcctgatctgcctgacttaattctgtctctgagcagtacatctataatggatcaaaccatataattccttaaaagtccaacagctggtgaattaagtcagtaaatggtccagtttaaattgactttatttttattacccaggttatttgactgagctgatccactcttttacttttgtcattgtagatataattacactaacaatcaaagcactgtttcttccgtcccacccagtgagaacatacggtgtttacctttctgtgcccgacgtatttcacttaatgccctctgattttatctgtgttgccgcaaatgacaggatttcaaatctatatcagtgaggaattttgtttgtagtttcgcttttgttctatgtattactattattattttttcacacggagttccactcttgttgcccaggctggagtgcaatggcgcgatctcggctcatgcaacctttgcctttcgagttcaagtgattccccagtctcagcctcccaagtagctggtaggtgactgagaaatgcttcaaaattagccaaaacttaaaattaagttaaagtttaccttcaagattcaacctgaatgagtcactctgtattgctggtaataaaaaataagtttttaatggtataaaagcaaaccccagagaatgttttttccccagttgacatctaaattaaaaactgtaaaacatttgtatggccttatgcactttttactttagaattccaactttttctagttaaaattcttctaaacagattcctgtgcatttgaaagacaaatgattttttaattgaaatgcttaagcagtttttaagaagttaaagctgttgtgcttattctttaaatagtttatttaatataactacattttaagagtttgatttaatgttaagttcttctcaactttgtttaagaagcagaaagcattacatgagattcttgacagatgctttcaaggaatctctttaaaaaatgttaaaggtagaactatttaacataaaattgaatttttaagtgtttgcataatttgaaaaattatgtctcgcagctttttaaatgcccaactatgatacatattttcccttagtaatatgaggataataattgtagttaccatgggctaactatatgctgcacgacatgctaaattctttatgtatatttatcttctaatctttagaattgtctaaaaagtttggcagttttattgtctttatttttataaccattattcttgatacattatacagtcattttttctgttcttgatttttaatgtatgtttatgtttgttcatgtgcttttatttctaataatgtaataaacatttaaaattagaaaactgagatttaaaagtggactaaattgtccatgggacaccgagctgtaagacgcagagccaggattaaaactggcatctgattctaaaacctgtgatgctaactactgtcattgcagaaaaacttctttgttctacatgaattatctgttgatttctcctctcagtcttatttttttcttatactcattactatttgacatgtgtgtgtagattttttttatagagatgaggtcttgctttgataatcatacatgtatatttttaatttactatctgtctctcttgcttttttgttcactgttctaaaacaattgcaggcatttgtatgtggtttgtaggtattggttgatacttaaatgaatgaatgtaattagtgtattctgtacaccatcagtgcatatattattaaagatgtgatagatttcgtgttttcctctctttatattgttcctatattgcagcagtccccagtctttttggcaccaggtactggtttcgtggaagacaacttttccatggactgggcagggggacggcttcaggatgattcaagtacattacatttactgcatactttgttattattgcactgtaatatataatgaaatataaaactcaccataatgtagaatcagtgggagccctgagcttgttttcctgcaactagacagtcccaccagagggtgatgggagacagtgacacctgaaatgtggtgcttatgtccagtctactccataatcttggttgctgtcactgcaaaaaaccatgcttcacaaagacaggatgttggaaatggaagcaggtgtttcagtgatactattgacaaggaagtgtcagtgctcctgtggagaacaggaatggttttgctgtccttaaagtttacataacatttactattattggtccttctctgtgttcttattttttttctgatatctctcctctcttcttcctcctcttaaatggtacatctaatcctgttcttttattctaattttttttaatgcttttcaatgcttgcaggtctttactaaataccgctataatcatttaactctaattctatttcaatagctaagctgcccatctggtatttccattttattatacttatcacaaacttgataaatctgaaattcggtgcaatagataattttcttgtggtagtttaaaaatatgttcaataattatttgaaactcttcaaaaagtatgagggatcttcaaaaagttcatgggaaatgcatattatgaagaaactatgcatagatttcagaaatattttgcacctaaataaacttgtactaacttgttataacatgtcggaacaggatctaatttgaggaattataataagaaaactaagacaccagtttgaaaagaggtcctattaaagcaacatgaattctgctaaaattaacacaagaacaaacatcaaatttgtggcaattttgggtgatagaatagtaaaatcactggttctttatgacaagtttatgaggacaatgccctccaacatttgcaagtttacaaataaataactcatttgaagaagggatgataagattgaagataaagcctgcagtggcagacaattcacagttcaccagaaaaaaaaataatcttgttcatgtcctgctttaggaataataatagcataaacaacagccaacaccacagccatctcaattggttaaatttacacaattttgaaaaattttccactcaatagtttcaaaaactcttgttcccagatgaactgcagacaacagcagagctttcaactgctattttacgtaagtggaatcaagatcctgaagcatttcttcaaataattgtaagaggaggtcaaacacagctgttccagtgaaatcctcaagactttctagagggcccaaaacaaaaaaaccccaataacacatgctattatgagagtattttgagaaagttagccaaagttttagaagaagaacttccaggaaatttcaccagagaattcttctccaccataacaatattcttcctcattcctctcatcaaaaaaagacaattttgctagggtttcaatagaaaattattaggcattcaccttttagctctgattttgctcccgctaacttcttttctgattttaaaaaaacttgaaaggacacccatttttcttcagttagtaatgtaaaaaagactgtcttgacatggttaaattcccaggaccttagtttttttgtagggatggactaaaggccagtattattgcttataaaggtgtcttgaacttgatgaagcttatgttgagaaataaagtttctatattttatttttgtgttttactttcattttttcacaaacttattgaagtcctttcatagaccctaattctcttcttcttgaaggtatgtgcagcttaatcatcctttcttgtgaatagaatgtgacagaagtgaccatgtgtgacttctgagtctaggtcatcaaagattttgccacttatgggctttcctttttcctaagccactcacgctggagaaaccaacaactatttggtgagaatagtcaagcagcgctacaaaaacatccatgtggagagaacctgaggccttcaattacaaaccccaccaacttgcgggccgtgaatgtgagcaaacttgaaagtggtcaagcctttggatgacagccccagttgaaatctgactgtaaccacatgagctatcctgaggcacaaccaccatgataaattgttcttgaattcctcgtttacagaaactcaattaggtaatacatactgtgagtttacgccacaaagttttggggttatatgttatgaaacaatagatagcaatttcactctttcaacatccattttactttttacacaatcatgcatttttaataatggggatgtatcttgagaaacgcaccactgtgtaatatcattgttgtgtgaacatcataggatgtacttacacaaacctaggtggtagagcctatcacacacctagactatatggtatagcctattgctcctaaactacaaacctgtgcagcatgttactgtgctgaatactgcaggcaactgtaacacaatggtcagcatttgtgtatataaacatagaaaaggtacagtaaaaatatggtataaaagattaaaaaatggtacacttgagtagggcacttacctcaggtggtctgctaattttcatggtcacatgaagattccagtgagatatattttaccataggtgacagccttgactatgtgcactacccatgaaggtcccctttgccttgctcttcctgacttgtcaagtgcatgatgatgtggtaaaccagcacaagaactgaactctcttctctttctattaagttctgcagctatttattctgagtttggtatctagattttgtagaccccatttctttgacattcttggtagaatcaggccatcttcatcccattgtgctatccttgtgttactgttatgttttataatgtgtgaagttattttatagaagaataatctgagggtagaccataggcatagaccctttgagcctattgtttgagccagcctcacagattggacaattagtggtttttcctggattagcatcaatttggatagacactgctgtcagttactatgaaactggttacattttcttttctttttttttttttgtcttaagaaaacatctttaatccatagagcatgttttctctggttttatacccaccagggtcataggcttttttctgctttaagatatggccaaccattgcattagggctgagatattaggtgcacaggattacacacaaactgtactctaaatactcttcattttaggataaaactattggtatgtatatacttttattacaattcttacacttatttctctgaatagcattacttcatcaaggattatttgaacctttaatggccacattaatgaatgttgaccagagaaacattgtttctttgactggcactttagaaaaacaaagattccttgggtccaatgggcagtatttttagttgttaggcagaggactccacatgaaatcctgaattaaacattgctccactaaaatattctgaggctaaagatgaaaatttttacaatcagaagcaacaaaaactagacacattttttagtaaatccttcccctccttgtccttcggttgcctcctggcatgcagatctccctcctgtcccttatgattctgttctctcttcttctgccccaccattgacttttccttcttgctttttgttctgaaattattttcccaactgtcataaattctcagattgtttgttccatctaaagatccacccttaccatgagccagatatgtaagcaactgcagaatttaaatctagtgcatgagttcagagttgtacatgaactaagaagttataatgaacaatttttaaaactaaacaagaaaatcaaatatttatcaaataatttagaattctttagggcacatatgacccagggttacttgacatatcaactggtacacctgttaatttgaacatcaaatactaaatcctgcatgataaaatgtgatttggtctgacctgttaggaaacttgtagaattcctctttccaaaataagtatcacggtcaaaaatctttcataaaaacaataaaattattaaactatagaagaatttggagatagactataaaatttattgtcacaactcagagttaaataaaacaggttttcattaaaatcaaattatgtaaaagttataaaactgaaaatcttaaaaacaaggataattatataataaaagctattataaatactcaacaggaaaccagaaattataattattttgtcatttgttttactatcaactctgattattgtgtttcttaaaagaaacaaatatatcattatgaggtgatcagaagcagacaaggaggttagacattccctcatttattcactcagcaaccctgccacagaactaaacctatgccaagtgcctggtgggcccagcgtgtggtgctgagaaatgattgagtggccctttcccgcattcaaggagcccacagtccgaggatatatggacaaaaacactaaagcaagtacatgtaaaagaagagtaaatgctataataaaaataaagtaagatgttgggagggagggcaggggagccatggcattcgagggacccaaatgcctcactgaggtgacatttatgccatgaccaggatgacaacagaaggccagccctgcacaagtctgggaatagtatttcagggagatgccactcctggtgcagagacatgcaggcagaggtgactttggcagaggatgtgagaaagaggccggtggggttagagggagcctggggcagagaagaggagagggaaggatgactctggggcctgaagaagatagtgatctgcttctctctgacaatactgtccccaaatttagcacctttaaacaacaaatgcttactatctcacaatttatgtggaccagaatctggacaccgctttgctggctgcctccacatggggctccatgaggctggggctgtgttctcagctgaagctgggctgtgggggattggcttccaagcacactcatgtgggtatcggtcaggttcagtgtagactgagagcctgagtgtctcccggggcctgggcactctctcattctctgttgtgtaggcctccgcataaggcagctcataacactagagcttgctttccaaatttgaggaatacagtagaaagacagggagataaatacatactgacagagaaagagaaagacatagagaatgacgagaaaacactggacagagtaagtagaaaagatgagagaaatagagggattgagggaggaaatacagaagaaagtgactaggagaaaatcacagcttttttgataataacatgagaattgcaatagactgaacatttccccaccaaaaattgtgtatgttggaatcctagcccccagtgtaacagtactaggaagtgggaggtaattaggttctgaaggtgaaaccctcatgaacgggattactggctccataaaagaaaccccagagagctccttcctccactacctgtcaggtaaaaatacaacgtaaagtccacagtctgcaactcagaagagagagttctcaccagagcccaaccatgctagcgtcctgatcttcaacttctgtcttccagaactgtgagaaagaacattctattgtggataagtggctcagtctatctttggtacaacagcctgacctaagacagaagtgttatcccatcatttccatcgcattctgttggtcaaaagtgtcattaaccccttagtgttgtcagcctttctgtaagctgcccagcacataggccaaaatgaaggacatgggtctgattctgaatataatgagaaggcactgaaaggagtaatgtcagaggatgacactatctgaattccatttcatctcaaactcttactggtgcagaatgaaaaatgaggctgagaggggaagcgactttccaatatcacactgctggacacaggcctgtttgaggtgtattctatgctacctcccattccttcttatagttcttttatctctaagtgtgtgcattatctacatgggatgccacaccatgagttttacaagttttatctcatacacacctgatgagttccctaggaaggagatgctggcatgttacccaatgtacgtgttgaaaggcccccaaacccacagtaacttttctagtgtgacagaactagtaagaaaaagtaggttcttacccagatctgtgacctcacacctgaagccctggctgtattcaggtctttccagggaactgaggagggctgtgtttgcataattgtgcacaggtaaagagttgacatgcagggatagtgagcagtcagtggcccagcagggccttggggtaggtcttatggaagcaaggagcccagaggatgaaactttgaaaaagtgatcttacttccttggtgacagaccccaacagaacttataattctggtaacccagcactcacatcctagagacagccctgtatccaggtgggaaatgcttggtgggaaatgcttaagagagcacaatgtgctcctgctggatcccaactctcttaggctcttgcttcaggaaggcctaaagtgaaaatctttttggaaatgctggtattggcttattcctcaccccagacgtctctggagattttgcaggggtcgcccagaggtaacatacgttaagtctaaggcaggctcctccagcctaggtctcattagtgctttcattgtcctttgctttagaatgtaaggaaaaatcaggaatttaaaatagcaaaaattgaccaaaactacatttttgtgagatttcctaaggttctgtgttgttgttgttttgtttgttttagacaggacctcactctgccactcaggctggagttcagtggcacaatcacagctcactgcagcctagatctcctgagatcaagcaattctctcacctctgcctccgaagtagctgagggactacaggtgcacaccaccacacctggctaatatatatttttttatttttagcagagatgaggtctcattatgttgcccaggcttgtcttgaactcctgaactcaagcaatcctcaatttttgatacatagctttgctaggtgtaggattcttagttgacagtttttttttctgtgaacaccagctaaagaaagtttaaaaagaagaaatagagaaacttcaagtaaggcaattaaatgaacaaattaagagctaagaaacaacaagatggggtattgaggttgtagttatggcagctaatgatagaatggatccaggcagagagttcaggcagaactgtatttgcagagagtagaagtctgagggtgaaggtgtcctaaatgaggccaatttggaagactttattttattatagaatcaaagacaacgcacgggaacacaccatgccaaacccaaacaggctaagctggtgctctgtgcaaaggtatataggtttacgggaagaaaagctaccattataacatcaagtttttttttttttttaaattaaaagaatcacaaatgtggcagttctagtcagggttaaggttaaagttaaagttatatttcaggtttggttggtggatgtcacaaagcaaaaagtttgttgccaagaagtgggtgttctagtttgtgaaataaaacatcccaatgacaggcacagtagagaagaaaaagggatgggatggcaaacacaagttcctggaaatttatattaaaataaggtttataaaggaggacagtgtgcatctcagtcatcagtgctgcctgcaatggaggtgtttatttctgcccaagataaatacaccaggcctactatgtgagaggtgaaaaggagcctacattatgcttcccacgccagatgccttgacttggggttctgttcccagggaaaaagagcacatctttgaagtagttttggagcaggaggtatcttccaaattccaacgaagtatcttatatttctaggtgaccctgagaccactggagaagaaataaatgaaggccatgaaacttccttgaactagtgggaatccatgagaaaatctgacattatgttctcttctcttggaatagaaatattgtttgacttccgttttgctgaacaagaaacgaggccagaccacccacctgagcaaggctacctgggacaatgacctcacacatggaaaacattggagcccatctgcttccaatctgctgttttccaaaaattagggaagttgttttccctttgataccctctgtttgtaacaatcccaatgccaacactgtcctgtttctacaagagacaatgacaaatatgagcctgaaggaagatgagctgatggcattcccagcttattaccactccttgggggccttatcttacatacatggattcaattcgtagattcagctgggtgagtatctattattcagctgtgttagaagtgactgcttaagacttaggtgtgtggtgaaatgaggcaggattttctcctcataattaccatcttactatcactgagtcatagctaaaatcaggaaattattcaagaagaaatagaaatgtaatgttatgaggacataaatttagagatttgtggaaaggccttcataattttgtggcattttctttgagctggaattatacttgacatttcattataatatattagctataccagactttatgcatttatgtaaaattttatttgcttttattatactgtaagttctgggatacacgtgcagaaagtgcaggtttgttaagcatgtatacacgtgccatggtggtttgctgcacctattaacccaccatctacattaggtatttctcctaatgctatccctctcctagccccctactccctgaaggtccctggtgtgtgatgttcccctccttgtgtccatgtgttctcaacgttcacttatgagtgaaaacatgtggtgtttggttttctgttcttgtgttagtttgctgataatgatggtttccagcttcatccatgtccctgcaaaggacatgaactcatcttttttattgctgcatagtatcccatggtgtatatgtgtcacattttctttatccagtctatcactgatgggcatttgggttggttccaagtctttgctattgtgaacactgctgcaataaacatacgtgtgcatgtgtctttatagtagcatgatttataatcctttgggtatatatccagtaatgggattgctgggtcaaatggtatttctggttctagatccttgaggaattgccacactgtcttccacaatggttgaactaatttacactcccaccaacagtgtaaaagcattcctatttctccacatcctctccagcatctgttgtttcctgactttttaatgattgccattctaagtggcatgagatggtatctcattgtggttttgatttgcatttctctaatgaccagtgatgatgagctttttttcatatgtttgatggccacataaatgtcttctttttgagaagtgtctatttatatcctttgcctactttttgatgggtttctgtttttttcttgtaaatttgtttaagttctttgtagattctggatattagacctttgtcagatggattgcaaaaattttctgccattctgtaggttgcctgttcactctgatgatagtttcttttgctgtgcagaaactcttaagtttaattagatcccatttgtcaattttggctttttttggccattgcttttagtgttttagtcatgaagtctttgcccatgcctatgtcctgaatggtaccgcctggatcttcttctaaggtttttatggttttaggtcttatgtttaagtctttaatccatcttgagttaatttttgtttaaagtgtaaggaaggtgtccatttcagttttctgcatgtggctagccagttttcccagcaccatttattaagaaggaattctttccccattgcttgtttttgtcaggtttgtcaaagaacagatggtggtatgtgtatggtcttatttctgattctgttccattggtctatgtgtctgttttggtaccggtatcatgctattttggttactgtaaccttataatatagtttgaagttgggtagtgtgatacctccagctttgttctttttgcttagaaacatcttggcgatttgggctctttttttggttccatctgaattttaaaatagtttcttctaattatgtgaagaatgtcagttgtagtttaatgggaatagcattgaattcttttataaattactttgggcagtatggccatcttcacgaattaattcttcctatccatgagcatgggatgtttctccatttgtttgtgtcctttctgatttctctgagcagtggtttgtagttctccttgaagaggtccttcacatctcttctaagttgtattcctacattttttattctctttgtagcaattgtgaatgggagttcactcataatttggctctctgtttgtctattattggtgtatagaaatgcttgtgagttttgccgattgattttatatcctgagactttgctaagttgcttatcagcttaaggagattttgggctgagacgatggggttttctaaatatacaatcatgtcatctgcaaacagagacaatttgacttcctctcttcctatatgaataggctttctttctcttgcctgattatcctggccagaacttccaatactacgttgaataggagtggtgagagagggcatccttgtcttgtgctggttttcaaagaaaatgcttccagcttttgcctattcagtatgatagtggctgtgggattgtcataaatagctcttactattttgagatgcattccatcagtacctagtttattgagagttttttgcataaaggggtgttgaattttattgaaggccttttctacatctatttagataatcatgtggtttttgtcattggttttgtttatgtgattgattacgtttattgatttgtgtatgttgaaccagccttgcatctcagggatgaagctgacttgatattagtggataagctttttgatgtgctgctggatttggtttgccagtattttattgaggatttttgcttcgatgttcatcagggatattggcctgaaattttctttttttgttgtgtctctgtgaggttatggtatcaggatgatgctggcctcataaaatgagttaaggaggagtccctctttttctactgtttggaatagtttcagaaggaatggcagcagctcctccttgtacctctggtagaattcagctgtgaatccatctggtcctgggctttttttggttgacaggccattaattactgcctcaatttgagaacctgttattagtctattcagggattcagcttcttcttggtttagtcttgagaagatgtatgtgtccagaaatttaaccatttcttctagattttctggtttatttgcatagaggtgtttatactattctctgatggtagtttgtgggatttctgtgggatcagtggtgatacctcctttatcattttttattgtgtctatttgatttttctctctttccttctttattagtctggcttgtggtctatctgttttgttaatcttttcaaaaaccagctcctggagtcattgattttttgaaggatttttcgtgtctctatctcctttagttctgctctgagttatttcttgtcttctgctagcttttgaatttgtttgctgttgcttctctagttgttttaattgtgatgttagagtgtcgattttagatctttcctgctttctcctgtgggcatttagtgctataaatttccctctaaacactatcttagttgtgtcccagagattctggtacgttgtctttgttctcctcggtttcaaagaacttattacttctgccctaatttcattatttacccagtagtcattcaggagcaggttgttcagttttcatgcagttttgtggctttgagtgagtttcctaatcctgagttctaatttgattgcactgtggtctgagagactgtttgttatgatttctgttcttttgcatttgctgaggagtgttttacttccaattatgtggtcaattttagaataagtgctatgtggtcctgagaaaaatgtatattctgttgatctggggtggagagttctgtagatgtctatcaggtccgcttggtccagagctgagttcaagtcctgaatatccttgttaattttgtctcactgatctaatattgacagtgaggtgttaaagtctccccagtttattgtgtgggagtctaagtctcttattattgtgtgggagtctaagtctctttgtaggtctctaagaacttgctttatgaatctgggcgctcctatattgggtgcatatatattcaggatacttagctctccttgttgcattgatccttttaccattatgtaatgcccttgtcttttttgatctttgttggtttaaagtctgttttatcagagatcaggattgcaacctctgctttttttttgctttccatttgcttggtaaatcttcctccatccctttattttgagcttatgtgtgtctttgcacgtgagatgggtctcctgaatatagcacacagatgggtcttgactctttattcaacttgccagtctgtgtcttttaattggggcactcagctcattcatatttaaggttaatattgttatgtgtgaatttgatcctgtcattatgatgctagctggttattttgccagctactagctgagcagtttctttatagtgtcaacggactttacaatttcatatgcttttgcagaggctggtactggtttttcctttccatgcttcaggagctcttataaggcagccctggtggtgacaaaacctctcagcatttgcttgtctgcaaaggattttatttctccttcacttatgaagctctctttggctggatatgaaattctgggttgaaaactcatttctttaagaatgttgaatattggcccccactctcttctgacttgtagggtttctgcagagaggtccgctgttagtctgatgggcttccctttgttggtaacccgacctttctctctgactgcccttaacattttttcctcatttcaaccttgatgaatgggacgactgtgtgtcttggggttgctcttctcgcggagtatcttaacggtgttctctgtatttcctgaatttgaatgttggcctgccttgctaggttggggaaattctcctggataatattctgaagagtgtttttcaacttggttccattctccctgtcactttcaggtataccaatcaaatgtaggtttggtctttttacgtagtcccatatttcttggaggctttgttcatttattttcattcttttttctataatctttgtcttcacgctttatttcattatgccgatcttcaatctctgataccctttcttctgcttgatcaattcggctactgatacttgtgtatgcttcaagaagttctcgtgatgtgtttttcagctccatcaggtcatttatgttcttctctaaactggttattctagttagcaattcctctaaccttttttcaaggttcttagcttccttgcattgggttagaacatgctcctttagctcagaggagtttgttattgcccaccttctgaagcctacttctgtcaatttgtcaaactcattctctgtccagttttgttcccttgctggtgaggtgttgtgatcctttggaggagaagaggcgttctggtttttggaattttcaggctttttgcactggtttttcctcatctttgtggatttacctacctttggtctttgatgttggtgaccttcagatggggtttctgtgtggcatccttcttgttgatgttgacgctattcctttctgcttgttagttttccttctaacagtcaggctcctctattgcagatctgctggagtttgctgggggtccgctcgagatcctgtttgcctggttatcaccagcagaggctgcagaacagcaaagattgctgcctgttcgttcctctggaagcgtcgtcccagagaagcacccaccagatgcagctggggctctcctgtatgaggtgtctgtcaaaccctgctgggaggtgtctcccagtcaggaggcacaggggtcaaggacccacttgaggaggcagtctgtcccttagcagagcttgagcgctgtgttgggagatccattgctctctttggagctggcaggcagaaatgtttgtctgctgaagctgtgcccatagccgccccttcccccaggtgctctgtcccagggagaagggagttttatctataagctcctgactggggctgttgcctttctttcagagatgccctgcccagagaggagcaatctagagaggcagtctggctacagcggctttgctgagctgtggtggactcagaccagttcaaatttcccggtggctttgttaacacagtgagaggaaagccacctactcaagcctcagtaatggcggacacccctccccaccaagcctgagtgacccaggtcaccttcagactgctgtactggcagtgagaatttcaagccagtggatcttagcttgctgggttccatgggagtcagatccactgagctagaccacttggcttcctggcttcagccccctttccagggcagcggatagttctgtcttgctggcattccaggcgccacttgtgtatggaaaaagactcctgcagctagctcagtgtctgcccaaacggccatccagttttgtgcctgaaacccagggcactggtggcataggcacctgagggaatctcctggtctgcaggttgcagagatggtgggaaaatcatagtatctggggctgcagtgcaccattcctcagggcacagtctcttgtggcttcccttggctaggggagggatttcttccctgaccctttgcgcttcctgggtgaggcaatgctccaccctctttctgctcaccctctgtgggctgcacccactttctaaccagtcccagtgagatgagctgggtacctcagttggaaatgcagaaatcaccaggcttctgcattgatgtcagtgggagctgcagaccagaactgttcctatttggccatcttgtcagccacaacccccccaccgccttttttttttaagatggagtcttgctctgtcgccaggttggagtgcagtggtgtgatcttggctcactgcaacttccacctcccaggttcaagccattctcctgcctcagcctcctgagtagctgggactacaggtatgcaccaccatgcccagctaatttttgtgtttttcgtagggatagggtttcaccatgttgccaaggatggcccggatctcttgacctcatgatctgcccaccttggcctcccaaagtgctgggattacaggcatgaaccaccactcccagcctggaaatcttcttttaagaattgtctattcgtgtctttagcccacttttttttctctcgcactgatttgagttctttgtagattttagatattagtccttttttggatgtatagattgtgaagattttctcctactctgtcagttgtctgttaactctgctatttcttttgctgtgcagaagctttttagtttacttaagtgctatctatttatctttgtttttgttccatttgcttttaggttcttggtcatgaagtctttgcctaagccagtatctagaagggtttttccaatgttatcttgtagaatctttatggcttcaggtcttagatttaagtctttgatccatcttgagtttatttttgtataaagcgagagaggaggatccagtttcattctacatgtggcttgccaattattccagcactatttgttgaacagggtgtcctttcccactttatgttttgtttgctttgtcgaagatcaattgactgtatttagctttaattacggtttctttattctgttccattggtcaatgtcccgattttttataccagtatcatgctgttttggtgactactgccttatagtatagtttgaagttgggtaacaatgcctccagatttgttctttttgcttagtcttgctttggctatgtgggctcttttttgcttccatgtaaattttaggattgttttctctagttctgggaagagtgatggtggtattttgatgggaattgcattgaacttgtagactgcttttggcagtatggtcattttcataatattaattgtacccatccatgagcatgggatgtgtttccatttgtttgtgtcaatgtcattatttttaaaatgctgccatttgaccatcatagaactagaatatgtggactatgaaccacgtgaaagctaaggagccattagacaaggcagccagataatgagttaagtaatgacagcatggaaaatgaataaaagcctttcaaatctctgacaaagtaattgaagaaaaggacttttcccctgtgtgaagtttgtggttgagacattgttgcactgcaacagtaactttaatttttaatgtgcaagaatatatttagaaatacagtttaaaatgttgtttatgaaaaaggaatggtaactaattaatatataataactctgtaccttgatgaggtccttgtaggtccaacagcttcctgtgttaatagatgtagtgtatcattctgttctcgcactgctagaaagaactacctgagacagggcaatttatgaagaaaagaggtttaattgactcacagttctgcaggctgtacgggaatcatgactaggaggcctcaggaaacttacaatcatggcagatggcgaaggggaagcaagctcctcttaccatggtggagcaggagcctggggaggtgccacacacttttaaacaaccagatcttgtgagaactcattcactatcatgagaacagcaaggaagcaatctgccctcatgatccagtcacctcccactaggcccctcctccaattcaacatgagatttgggtggggacacaaatccaacctgttatcacacagtcttttcagtaaacccagcagtgatcagactcaggaagcacatttattatactaaccacacctacacatagttagctgataagactcttatctgttggttgaggggggaggagacccagagaaggaccagaatattgtcatttagggtatgatgtttaggctgttaggtggacagcaaaaatggcagaggaaggcagggtggtacaatgagtgatagatgatgcaatgtgaatcgaaggcctaaaacccacaagaacaggggtgttttgccacctacagtaagaacactcatgtcaatacggcaggaccacttccttcttgtgtgtttctgaaaacacatatgggaactcctaatctctcattccctcttttctaaatgttataagacaatttgtaatactgtgttgacattatggattttggtttagagtttaggcatttaaaagacactggaccctacgtctgcgacagagcaattagcgaacacaggtgatgagtactgaacaacttgagtaaatgattccttgtgtccatgttacaatttccaagctccaattcatgctgacctagtttagttctagatgtgtattctcatgatgagatctgcagatacaacatgctcataatagattcagtttctaaagtgtcccttaaactggtttgtctacaactttcatgttgactgtttttttttttttttttttaaactccagatctaactgcactttatatatggctggtgatcagacagtaacccttttctgagtttagggtctacaatcctttcagattagacctcaaatggacacatcctgtacgtggacagcagagctatggaaaacaagagggatgcatttgtaaccctctgtttacactacaacctaacttcttcagcagctgagtccttgtcaagccaaaaggagtgatagtagaaaattatattcgtacagccaacatttaattgttgacatacagaaaatacttttttttcagttaatttcttaattataggcgagatctatgttcccagcgcagatacttgatgggtgtctatttaataatgtgaatatttagtttgctttcacgaaggagtgcaggtcataagacatacttactaccaaaataactctctacaatgatcctgattattctgcttaactgatctctgggcactgaataatattgactggaaaggcacaaaagaacattccttgcttttctgctctttgtgagtggacatggcaaggaagaaaatcctttcacctttgcacaatcaaagctgcttttggtcttttggataatgtcagactaatcattgagtcaagagattggaccaaatctttaacaattcagagtaaaatgaattcagggctcccctgttctctagggcccccaggctattttccccaaaatgtacaggtattgtgagtaacttattactaggtgtcttgtctctttcctatctaaacctgcagttcacagtgcaaggtcggcacagagtgtgagactgtactctttatgcagtggattttaaatcactggaacaaaaaaatgtaaaatgtggaaatgtgagagctgatcgtattaattgaagctattgttccacaaattttaggagattgtatccagtagcagagaaattggttcatggttagtagattctgacaaaatattttttttaatattatttacttatttctgaaaataacaaaaagcttgtttaaaaaatttttatttttaaaagtctacccagttaactcgcttgactagatcagagtgctactgagaaaaaagttttagctttcttctcttcacaaatatctttacttaacgtcttgcccttcagtgctagataaccagcaggcaagtgagactcgctaaaaactgtgggtggtggaatggatcctccgcactgagaggacagaacaacacgtgccattttctaatcactgcagcctgtgaacctctctaaataggcaaatgaggccaagggcgatggagggtcaatgagagctcgcggggtgacgccattctgctggggttctggagaggccaaagctggagacggtcccgtttgtggtcagcacggccttttactttctggccgtgactggcaactgcaccaacgtcctcctctccctcccactgcacactcccacttcctcagcgaccgggcccttctccacctcctgccacagcactcgcagcttctcccaagtgctagttaaccgcgggggctcaggcaaatccatggcccgcgtgggtgtgcggtgcggccctctgaggcctctggctcctggtctggcctggccgcgccggctccgggagctgccattccgccctgacgtcgccgcgtacacgtacctggggcggtgcagtcaccgctgcctctgccagttcgtgtgtgggacgccggccatcaccgcatttccgcgtggacgccggcagggtggaacgcctggctttccccggccaccccagccgccctggcgcctctcgcgcgacttggcctcggcccctcgggggcagtgcactgctgcgcatgcggtctcagcgcccggccttcccgcgcggctgccgccctttccacggtgacgccgtctgcactagcgccgcacccgcttcaactgcctgcaaccgccgctgaattccctcatccccacgctgagaggacgagaaaggcgccctggggaaggctctcgggaaagcccgcagccgctggacgcgggaggacatggaggtaggcgggaacactcaccccgcgatttcgtgtggtccgcgaagctttttctcttcaggacaacactgcacaatggcatccattaataatacgatggggaacgggggccgcggcgctcgcctgcagtcccagcgctttggcaggccaaggcgggcagatcgcttgagctcaacagttccagaccagcctgggcaatacagcgagaacccatcgctaccagaaatgtaaaaaattagccgggctagtggcgcctgcctttagtcctagttacttgggaggctgaagcgggaggatcgcttgagaccaggagtttgaggcttcagtgagctctaatcacaccactgcactccagcctgggcaactgagcaaaaccctatctctaaaaaaagaaaaaagcgccgagattgtgccactgcactccagcctggacgacagagcaagactcagtctcaaaacaaaaacaaaaacaaacaaacaaacaaacaaaaagcggcagggatgtgaatgtgaatggagcaaggcgttctctctttcaggggtctcagactttgtatctttgcttgcaggtggactgactgccccatgtccttcaaagttaattgcaaaagagttcattgcaagagatgatgtgctggtggaaagatagatgctgctacttctttccttagtggggttttacaggcagataatgactgctttgcagctcatttgtgactctgattccactgagcggtaatgtcattagatcagatacaagagtaaggagacagcatggcagaaacgcacgtgtgtgtctgtggtgagtgttttctggggtacacttgttcccacaggcctttttgttctgaattttccagacccctgtgcagatgacactgttacttcctcaggctgttacctgccccctcaggccctaagcaggtaacatgtatctgcctaagagcagtgtttcctttacatttcaggttatatgtcacttacaacatcaatttaagtgcggcaaacattcgttattctaggttagcataaaatggattagaaaatttcacagaggactatgcatggtagtgagtcagttgtgtatatgtgtgtgtgaaatgtgtttcttacaccgatataaaagtttgaaagtcactgctttagagagtttctgttggaacaagcttccaagcaacccatatgtctgtactagaggaaaatctaggaatatcactttaaggaaacatagggtcgtgtatgggaagatatggactcaaagagtttgtagagcaaggaaatcacagctgcttagcatgggagagtttgccaggataaatgatgatgatatgttgacagtgattatgttaatcatgctaattatgataaaaatgaaacttttttcaactcatgcattttcaccttttgacatttctgaagtaggaatattttaagatttagtggcaagtcatagtttttacttcatattttcctttaaaatttacactaaaaaaaggtgcgcttctctgattactgtaaaaataaatgaaattacatctatttccatgaactacttagttcctgtaatggctagttttgtgtcaacgtgactaggctgtagtacccagatatttggttaaacaccagtctgagtgttgctgtgaaagtatttttttcagatgacattaacatttagattggtagactttgagtaaagtagattaccctccatgatgtggatgggcctgatccaattcagttgaaggccttaagagaaaacagactcaggtcctacaaggaaggaggagttcttacatctgctttcaagctacagctgtaacatcaacttttctcagagtctccagcctaccctgaagagttctgatttgccaacccccatattgagttagccagtttcttcagataagtacccccacctcttcacacacacacacacacacacatcttctgttgattctgtttctctggagacccctaatacagttgtactacaaacttcccagaagttatataaaataaagcacatcttgatcaaatttggatacgtttttgccttttttttacagcctcaaactctttaggttaatgcgtagttttcaaatttcttttctcatgttcaaatagctgtttcttcaagcaggacagtctttccttatattttcagttcagatttcctcattggattattagaggttaaaaaaattatagacattgcaaaaagggaaaaggggaaaccaacttacgtctatactactttatcttctgatttccgaaagggaaaagaagtttgttgcaatcttctgtgtttcttattaagcctctgaattttttcactgctctgtcttatagttttagtatgcttagcctggtgtgtactagacattgcctctggcactacaccacatgcatttagtgtgggcctatataaacttagtcaagcaactgtgttagaaaaaaattttattctgtggtgaaataaatcttagaatttgaatttacattcttgcattttttttttttttttttgcaaggagaaaatcctataggcatctttctaaccatccacccaactaggaattgggaatccaaaaaaattgagaatccactcaatttttatatacctgcagtattaattataacaggattgatgagactgttacaaggttgtaagcattttcaacagtttatgaaaaacataatgtctccctctccctctccagtctccctctccctctccacggtctccctctccctctccacggtctccctctccctctccacggtctccctctccctctctttccatggtctccctctgatgccgagcggaagctggactgtactgccgccatcttggctcactgcaacctccctgcctgattctactgccttagcctgcccagtgcctgggattgcagggggcgccacgacgcctgactggttttcgtatttttttggtggagacggggtttcgctgtgttggctgggctggactccagctcctaaccgcgagtgatctgccagcctcggcctcctgaggtgctgggattgcagacggagtctcgttcactcagtgctcaatgttgcccaggctggagcgcagtggcatgatctcagctcgctacaacctccacctcccagccgcctgccttggcctcccaaagtgccgagattgcagcctctgcctggccaccaccccgtctgggaagtgaggagcatctctgcctggctgcccatcgtctgggatgtgaggagcccctctgcccggctgcccagtctgggaagtgaggagcgcctcttcctggccgccatcccgtctaggaagtgaggagcgtctctgcccggctgcccatcgtctgagatgtggggagcgcctctgccccgctgccccgtctgggatgtgaggagcgcctctgcccggccgcaaccccgtctggaaggtgagcagcgtctctgcccgaccgccccatctgagaagtgaggagcccctccgcctggcagccgccccgtctgagaagtgaggagcccctccgcctggcagccgccccatctggaaagtgaggagcgtctccgcccggcagccgccctgtctgggaggtggggggcagcccccgcccagccagccgccctgtccgggagggaggtggggggcagcccccacccggctagccgccctgtccgggagggaggtggggggcgcctccacctggccgccgccccgtctgggaggtgggggacgcctctgcccggccgccccttctgggaggtgaggagcccctctgcccggccgccaccccgtctgggaggtgtaccccacagctcattgagaatgggccatgatgacgatggcggttttgttgaatagaaaagggggaaatgtggggaaaagatagagaaatcagactgtggctgtgtctgtgtagaaggaggtagacataggagactccattttgttctgtactaagaaaaattattctgccttgggatgctgttatctatgaccttaaccccaaccccatgctctctgaaacatgtgctgtgtccactcagggttaaatggattaagggcggtgcaagatgtgctttgttaaacagatgcttgaaggcagcatgctcattaagagtcatcaccactccctaatctcaagtacccagggacacaaacactgcggaaggccgcagggccctctgcctaggaaaaccagagacccttgttcacttgtttatctgctgaccttccctccactattgtcctatgaccctgccaaatccccctctgtgagaaacacccaagaatgatcaataaatactaaaaaaaaaaaaaaaaaaaccataacgtataacttttaatgagaaatttttctgagtgctctaacaaatactgcttcacattgctaacactcagtctagttttagaaaatatatatgaaatcctctattgtatcaaaaatgtttatcatttttagtaaataaatgaacctccatctactgtttgtcagtagctcttgctctgcagtttggggttggcaacctcctacagaacagatgccccttcaacctatatacactttatctcctttgaaccactgtagttttggtctctgttacagcagcgtaataatcaagtaataatcaagacctatatgaagaaaactggaaatctttcctgaaggaataaaagatctacatgcatatatagacaggaataattcctaacattcattgaggttttactgtgctagtcattatattgagtaccaatttctcattacttaagtctctgcagaaacctttcaagactggtgtttttgccaccctttacagataaagacaacagggttcagagaggtgggtttattgaccaaggattcatagtcaagtgaggcatcaggacccatagcaagtacttaatgacatgatcccacccccgtgcttcagttcctttgttcattatccacatggaagtcttggtcctgcaaacatggtaaattttccagacattaatttaaaaatgtagttcaatactaaccacagtcaataagatactgttttgggttaggaggaaactagctgtgactttaacttggtagagcagaacatagtgacaaccatgaaaagtctaaattagaaaaatagataatgattgatgccttgttctactagatgacaaaatatactatacatcaacagctattaaaagtgttacaaatgtgaatgaaataaaataaatgaataaatattaatagaattgatattcctgaaataaatttgcacatatatgaaattttgaatatggtaaaggtataatttgaagcaaataatgaaaatacagctagcgaaataaattgttttgggacaattgactgaacatttggaaaacaacatctgtcttacacacacacacacacacacacacacacacactctgcagatgcagtgaattgaaaacctaaacataaaatagaaaaccataaaacgagaagataaatacaatctggaagatcgcaggccatttctaagcataactccaagcatgaaggcttatcatgccctttacttcttccaaatagtctgaaaatatgaaattccatacatctagggtctctaagacatttattacctgggcctgagggatctctcagacctcacttcccaccactctttcccttactctctttcagccacaccagcctttctacacatgtagcccttcctcttccaaagccttgatactggctactccctccccttgggatgccctccatacccatgctgtgtgacttcctcctttgtttcaggggagagcgcaagtggcagtccctagacctcatgtcaccttctccaggctcaccctgcatggcagttgatcgtatctcttaaccgacattctcatttgcttgctttgttggtgaatattctctcttcccgaacttttgcatcctatgaaagcagggatatcagttatttattcctgcatcttcagcctccaatacaggctgcatacataaaccatgtttaaataataattcatttctttgaatgaaataatgaacagtcccacaactagaaggcataaaggcatgattgatagtttatttaatacatataacatttaaaacttttgtaccacaaaggaaacaaacaaaacatagcaaaaggataaaacgtcccactagaaaaacgattcaacacttatatgatgacaaagatgtgtagaatcatgtcaactaccgctacaaatcagtaagcaaaaaggtaaaacaatgaaaatttaagaaaaaaacaatttattgaagaaacacaaatagccccaaaacataccagaagatgttaaacctcactaatgattaaatcaatgccaaataaaatgatactgaggtaagatttgcaagtaaaactaaagttactaacaaaatcaaatgttagtgaaactgtgagaatatatgcctttgtacacattattggcaaaagtacgaatttggtgtctgaagggaaatttaaatatgtccacataatgtcaacatgttctataaggaaaaacaaactaaagcgctttttctattctctcactcaacaatcaacacagaagacttctgtgactaaaggtgatggggttaagcccatacaccaagcaaacaatcaatcctatggcagacaccagctgggtgtccttcaattcagttttgacactatctacctggaaataacgccaggtctgctgggtgagggctaagtctcataagacatccccgtttccaataccaattataagcctcaagttctttttacctgtgtgtctgaccagtcaatcagctgtaagtctgggttaccacagcccccttcttgggttcaattaatttgctagagcagcccacagaactcatggaggcatctacatttagcagtttattgtaaaggatatcgcaagagatgcagatgaagagatgcatagggtgaggtatagggaaaggctgtggagcttgcatgctctctccaggttcaccaccttccaggaacctccacgtcttcagctatctggaagccctctgaacccagtccttgagggtttttatggaggcatcattctgtaggcatgactgattaaatcactggccattggtgttctgcttaacattcatcccttcttccctccatggaggttgggggctgggtctgactatcttaattctctaattctgccttggtctttcaggtgcccagctcccatcctgaagctacgtagggactactagccatttgtcaactcattaacatacaagtaccactttaaggaatccaaggattttagtagttgtatgcctggaaacctgttgaagaccaaatatatgcttcagagtatatacatgtgaataccatttgattttttattctaaaatttatcttgagctactagtcaagtttgcaaggatttcaatacacatgaacttattgtagctttgtttgtaataatgaaaatgagaaattccacggtgattaggtttgaaatatacctgtgcacagcatgtgttgagatgagaaaatatctgtgatctattaagtgaatttatttgccaagaaatcttgagcctgctattccctgggttagtttctgaattcttgcattcctttcttaccatgagaagcttgccatgttgagggtgattataatttttaaagtttatattttttactctatctggctcataatacctgacctaaagttctgacagaagctggaagataaactggtgtgtgagaaattaccttagtctgggtgtttccaaggcagaagctgtgtccagtgcacatgttctgtgatcccagagagcaggaaagggcaaggacaaagagggtttggccatgaccaagggtgactggtgctccatccttctggaaactgggagctttgtgaaatgcatcttacttcaggaagtgtgtctccactggcttacatccccacagtcaatgtggcctgggtccttcactctccacatttctcagctgtgcatgctgtggtgatgcatgaccctcacagtgtgcagcatgggaggaaacccatacatgaagtagagggttcacagagcaggtttgggatgatccaggttttctgtcctgtgagaagccatcaaagcctatggttgctgcaagaggaataaaagaaaagatggagcctagaaaattctgacatattcggctgaaaagggacctggcatcgaaagacaagtggtgtccaatatggcatgttagcattttcctcttcatttactataacttaaatccaagtaagatgggacttccctctatttagaaaggtcttctttcactttctttcaggatttactgcctcaagatggttatgttggaggattccaatagttctactggatgtggagccagaaattgtgtggaatgcctggtgtttctttcagttcttggatgccaatctgaggtacaaatcacatttcaagtgtatttccttgggttctggagaggatgtcttcattttctgttaagcatttagggagcagttgggtgagcacatgaccaatcagcctgagcatttaaggcagttggaggagagtgtgagttatggtcatcattctcctctgtgccaaacaggggctgatggatggtcagggcaaagcacagtgctgtcctcatggttctgggagggtctgcgttgtctgctatccccacataaactgatgaggacctgcactcctgtcctgagttgacacccagccttgaggtcaagaagatgacagatatttggggtaacgggtcccagagggtcctactgccacttcctcattgctttctctggaggttctaccaacttgactactgagcttaaacaaagccatgaactggcagatgaaaattacagtgcatccaaactccagagatttttaattagtcttttcaagaggttagggaaagtttttagtattcagattgaagtttttcttcagatcttgaatgtttgaaaatttttttattttagcttttagtggacatataataattgaacatatttctggggtaaacagtgatgtttggaagcacataatgtatagtgatcagataagtgtgattagaatatccatcatctcaaacatttatcgtttcttcgtgctgggaacattcaatatcctccttctagctgtttgaaaatacagaatatattattgttatggtcatcccgcagtggtatagaacactagaacttactcctccaatggagctgtaattttgtatcctttaacaaatctcttctcattcccccacccctgctatccattcccagcctcaagtatcctctgttctacttatttctatgagatcaacccttttttagctttcacagatgaatgagaacatgcagtatttaactttctcaaaaattttatctaatactttaaaagttatgatttcccccatttgtttctgtttcttcggtctttgggttctaaactgagtaaaaaatgtcagtaacttgatttcctaccttcctgactcataataatgttatcatgtgtctctgactcctagagtacctgctgtctgcttttttacttccccttcccccacccccaagcccccaaaattgtataattattttttaaatttcattttagtttgtttttaattcacaaataacaattgtacacacttatggggtgcagtatgatgttttgatacatgtatacttgtgtaatgatcaaatcaaggtaattaacatatccattacctcaaacacttgtcatttctttgtggtgagagcgttcaaaatcctgtcttcacaacatgcatgaacctagaagacattgtgttaagtgaaataagccaaacacaaagggacaaatcctgcatgatctcacccatatttcatgtttagccaactgttaaagaaggaaaaagcatgggccagtttacaaatgaatctgcattatacaccagcaacagaaagaagcaaatggcattaaaccacagtacccctccaggtgttgctgaaagatggtgaggaagggaaacttcccagtggtcaaactacaggcagtttagctggttgttaattttttatagaaggagacaggcacagaagtttggatatgcactgatttaggagcattggataacaagttattattttgctgagagatttgtgaagaataaggctggaaaattaatggcaggcaaatctggagaagaggacattgaagaatttcctgaaaagtgcacagatcatgaagatatctgtctgacataaatgcccatgagagggcatccactgcagagatggatcttggtggtatggtagataagatgactcatctagtaggtaatcagtcaatctcttttgccagcaggcttgctcattgagcctatgagaaatttaacatggaagcagggatggaaactatgaatgggctcagcattatgacatttctctcaccaaggttagcatgtgatttggcactatttccaggcgtctggctggactagtagcatagtgattactctggactcctttgagcatagagtaagcaatgttagtctttatagggacagaataatattgtggggacagttttgtcttccatgcccgaaccatttacatagtgaacaaagccttaatcatcaccatggcatcccctgcaatatcacctgtaaccaggaaacatatttcacagcaaaaggggtgtggcaatagaattgcccttggaattcatgattcatacttcatacctcaatattcagaagcagtgggcttgactgaatgatggaatgggctttattgaatgatggaatggcctgctgaaggtttagttattgaagctgagaaacaatactgtgtaaataagcactgctttcctgcaggctgcagtgtatgccctaaacctgcagtcaccgtaacctgatacatgagtccagaaaccaacaagacatgagagtgtctcgtacatgatgcataataatccagttgaagaatgttgcttcacttcactgaaagtttgggtttggtgtgatggttcattttacatatcaacttggttggactatggtgcccagtttttgttcaaacacaagcctcggtgttactgtgaaggtgtttttttttttttttttttttttttttgatgcgattaacatttaaatcagtagacttttagtaaagcagattaccctttataatgtgagtgggtctcatcccatcagttgaaagccttaagagaaaagactgacctgcttccaaaaagagggaattttgcctccagactttgaactcaagctgcaacatcaacctctgtcaaaatttacagcctgctggcttgccctgcaaatttcagacttgccagttccctaaattgtgtgagcctatttcttaactctcaatctctctcactcttttttctctctctccccctcagggtgtgtgtgtgtgtgtgtattctcttttacacatatttttggttctgtttctctggagaaccctgactaatacagtgaattggaagatcctagtacgaaaggaaagactactttaatgactactttcatattatatacatatatataataaaatcaaaaacaggaactgccacatggttttggtcttcccatgcctttgaatcatcaggcagagaatgaggttactctattgatagaggtgaactctagtgataggttactctattgatagaagttctttaacatctggaaagactagctgttgtaaattaggactcgtttgtcctttagatacactgtatacatagataagtaaaacaaaatgcacaatcataagaaacaatggtgaatctcgcctcactgtaagcacactggcttagagctctctgcacctcccttttcccctccttccctgaaccagtccacaaacaccatgccatcccccccccacaaaataacatttcctatgaattttaacaaaaagttatttacaaaatgtgtcattttactacctctaattttaacatgtatcaggtacttcagaacatctagaagaaacagacatctcaaaaaagcttagcgttgttacctctatatacagaagtaataaaatgcacacaaaacaatggatagaatatgaaaatgtcttggaaatacgacccgtcaggactaggtaggtctcgcccaactgcgacagagcggtcgcccaggacgtggacctgccggccgcctctggaccgccttcctcgccctccacagcctaacggcctccgggcgcatttgggcggcgccatgtttcctccccgcttaccgccgccacccgaaggcgctgagtcccggcggctcggcgcggtcttggtctgggtcggtggggttgggccgggagacccgcggccggcggggtccaggctgggggaggccgccgctgccaccaggtccccgaggtagggtaggaagaggttcgccgcggcttcaaggcctgggccgagcgggggagccacagcgagggttccggagcctgcaaggcggagtcccgggctcagctcaccccaggcgcaggcctgagggctgggagggctccgggggctctggggaacaggccggctccggtctccccgcgcgctctcagcgtcgtcaaagtttattatccacggagcgtcctggaatccacccgcttcggatactgaggaacagctgaacaacaacgcaaggagtttacaaaacaagatgacagtcaacatgtgtatatatagcaaaaaccaacaacgcaattgaacaaaactatgataattagcaaataataaatgtattttcttggtctggaaatggcatgagcacactcctttcagatttccatctaccttgagctcaaacaatattagaagaaaaacgacatcccaagtgccctgtcttccaaggtcactttgctcgatgtaaacttgatcttccttctcagaaggcactggagtctctaaatttgcgccagcttgcctgcagagccacagcagttctctaataccatgtgccggagggcgctcttcacctccgtgttcctcagggtgtaaataagtgggttcagcgcaggagtgactacggtgtagaacagagctatgaacttgccctgctcatgggaggtgctcttggctggctggagatacatgaagatgatgctcccgtaaaacagagacaccacagccacgtgggaagaacaggtgttgaatgcctttctccgcccttctgctgacctgatcttcaacacggcccgggcaatgtggccgtaagagaccaggatgagccccagaggcaggacaacaaagacaaagctggccaggtacatctccatctcattgaggctggtatccacacaagccagttgcataatgaggggcatctcgcaaaagaagtggtcgatgcaattgttcccacacagcggtaggagcatggtgagcgtggagcccaccatgctggtggtcagaccccccagccaggaggccaaagctagcccaaggcaaagctgtggatgcataatgacagtgtaatggagtggcctgcagatggcagcgtagcggtcataggacatggtggccagcaggacacactcggttgcccccagccaatgggagatatagaactggaccacacaccctccatagcttatggttttctgtggtccccagaggttagccaggagctgtgggacaatgctcgtggtgaagctcatgtccaggaaggggaggttggcaagaaagaagtacataggtgtgtggaggtgcacatctgtatgggagaccagaatgatgatgccattgcccaagatcgataccatgtaaaaactcaagacaactatgaagaggacagtttctagtgagggtcgtgtggagaagcccaggaggacaaagacttctggagaactcacattggctatttccatcattgtatgctgggggtggggcaaaaggccacctgtgggaagagcacagggcatacagggcatgagacatgaagcaattacatcagttagcaaacattaaaagtgtattttagttcattttatgttattcttttttagagacacaatttcactgtgttgcccgggctaacttcaaactcttgggatcaagcaatcctcccacctcaacttccttggtaggttgagaatacaggcacgtactaccatgtctggctaaaagtacattttatacccattgttttcaaaagtagccactcaacagctacgtggatggcattgcattaccttcctcacggccaacttggactgtataataaaagactgggtggggggtgttcactgtctggggaaaatggacattcatgcaaaatccttagcactgcttttttaaaatggaaatattatagtaacaacatctatatgcaacctaaatgtttagcaataaagggttagtcaggtagagggtggtcattcatgtgatgaaccactgtacaggcattaaaattgtgccctctcaaattccacaatcatctgcaagtttttgctgtcgttaactatatccagttttttatcccttctcaccacccctgctcctgccactctggcccatcttgccatcatttatcatctgaattttgatctaatactctaactcatctctctgcttctcctttgctccccttccaagtactctcaaaaaagtgttggggctcagaaaatgataccccaccatgaaggcttcagaagcaaaagtttctctttctcctgccttcttgtccgtggcccctcattcttccccgcagttagccatagaaattagaatccctcttccccaaggtgacacatagaaaccagagccccttttcctcaaagccagccataaaacctaaaaatgttactctaactttccctccacctttctgtgttaaaactagccataaataaattatctgacctaccttactggattgtagatcataagacctccattccagagaggtcttattgcataccaagaaaaaaggaacactgctcagagaggccaaaaagaatctcacgatgggtcttgctgggcttcttcactcagtccatcagtattagatcatgcccttcatgttcaatcatatttctacatggctgtccatatggctttgaacctaagcataaaaatgggaagtttctcttgtatctttggattctcatctgaaggctcctctgttatgtaaaactatgatcaaataaatgtgtatgtcttttctcctatgaatctgccatttgtcagttgatttctgtgaaatttcagaggacaaaggtgaaattttccctcactcctacgaaagcaatcacaggattacattaagacatatgatcacatcagtctgctgctcaacaccctcattgtcttggtacaaggcttgcagctgcagtttgctatacttacagtgctttctccccaagacatccacacacccccttcctcaccttcttcaggtcatttttgaaaagtcaccttctgactgaggccctccctgactgtgttatataatattgaaaaccctcacaactcccttctctctctttcctgaattatttttatataaggtgataatcttataacaaataaactactcttatttcttttgtttgctacccgtctcgctccactagatcataaattccatggagccatagttttatcttttgtttacctctgggtccccagtgtctaacccagtgtctgatacacagtagtcccttaatcaatattcatggacgtgcatcatgaaacaggttgctagaaaggttctgtggggtggaagaggcaggactagagtaatatgaaggcagagtggaaggactcagcataaactttcggtagtgttgtcaggagagagctcttggaactgccagagtcatgcagaagggtctggactatcctctgcttttgtacagttggaataaaacgagcacgatttagcaggggcagtgcataaagtcagaaactggacaatttcagtgtgcttccgatgtccctgaagacctttggggcccttctttgcaaaacattaattctagcctgtattttaaaaaggagaatcaatttattatagttaagattcacccagattaggggaacagagcagctgtgaacttaactatcagccttcttaaaatcccagagagtagaatttacctatccctgtaactggaagtcaattaaacaaaatagacatgaacagacatgtgcattcagttttaaaaatacaggtaggttttccattgtgcatgtatagaaatgaggctcagaaaactctaggcatttgttaaaattcacacgtggaagctgtcccattgtggacttactgtgtcagaatactgagacaatcatctggcctgcatatagtaggccagggaagcattaatactatgggagaaggcatcctggagaatacattccaacctcctccaaatcagggaggcaagccgggggcggtggctcatgcctgtattcctagcactttgggaggctgaagtggggggaatcacttgagctcaggagtttgagaccagcttgggcaacatagtgagagattgtctttacaaaaaaataaaataaaatgactgagtgtggctgtgtgtgcctgtagtctcagctacttgggaagctgaggctagaggatggcttcaacccacgagatcaaggctgtaatgaggcatgattgtgctactgcactccagcctgggcaacagagcaagaccctgtctcaaaacaacaacaaacaaaccaatcagggaggtagagttgagacctgtcaaaacgtggatgttttcatcatgtgaatgtgagagagaaaagatgaactgggattgggagagttaggtacaactgagtcatgacagtcaaagtgggtgtactgtatatagagtcaccgcaggtgagctgaaaaacaacaggttaaactgacaactgcattatgacccgtgggtgtaagtatatcccatctgtggaaagataaaaattttgttgactcacagttgataacatgcagaaaatgtgtaaatgatgctgagaggaaccacaaggtcactcatgaggtaatagtttagtagaatttttgaggaaaaagagatctttgtggtgatctgatctacttctagaaatgtttagtaacttatccaaagcccctgggctgcttagtcatactggagctatacccaagatactcagattcttagtacaaaaatagcgttttcagtaaaggaagaggtttgcttacccgcagagattcaccaaaattgtcacaattaaaaactcacttttcaaaatgcaaccctatcccaaacactgtgccattaagacaaagatagcatactgaaagttaaggaaacgtcttgagttcaaattttgtctgagttaactaggcagtcacaaactgtatcgcagaacataggcaagctgctagaatatcaaaggccacatgaggaaatcagatcatttaaacggatcagtgcttatcaattttaactggaattaccagaaagtctgagatccagtttatcttaaataccataaacaacaacaacaacaaacaaacgacaaaattcaaaatgtcacttactaatggtgagctagcagcatcatctctatttatgcagggtggaaatgttgtaaaatgggcaatattttattaaaaagactgataacattcatgaattcaatgcgtgtggcattaaaaaaataggagtttagccaggggattttaaagccctgcaaatagtggaaatctctaagtcggtggtagcagacgtgttagattctgttcaaattcatgtctaaaggacacattattaagtatttaaatcacaatgggattgaactagcagaaagcacttaaaatactttgtaagaaaattgataatcaaaggagtgagaatggctcatggtgtttccagaatgagaaagtatatgcagaccctaaagggtgaagtgtgacataaagtccttataattctaagacattgattgtaacccctggagccttcaggagggagcctgagggtgatggcatatatcaggggagtaaaagtggagggaaaaaagcttttgggatttctttccctattggataattataacttcattgtattacacacacagaattgtttcttttttatgactggaatattattttagtttttatactgccaaactgcttatggagcgtaagaatcaagtctctctatcatgtagtgagggagatagtctgagacatttgctcattctgttaattttgatacatgctgctatagactctttttttaaaaaaaccattgattttattattggtgtatacatcagtgatgagataatgtttttcttaataagttaaatttatcaatttatttttattttggtaaaatacagatagcatataaatttatcattgtaactattttaagtgtgcaagtcagtggaattaagttctttcacaagactgtaccatcacctctatcaagcgtcagaactttttcatcacctcaaatggaaaacctgtagccatcgagcagtcagtcttcatttgccagctctccctagccctgccagccactaatctgctttctctatgtatggatttgcctattttggatattacatataaatggacttatatcatacatgttattgtgtctggtttctttcatttaacatgatattttcaaggttcatctatgttgtagcgtgtatcagtacttcattctcttttaaagaggaataatattccattctatgactctaccaccttttgtttattcatctgttgacagacatttgggttagtttgttgatgaacatttgagttgtttctaccttttggctattgtgaatagagctgctatgaacattcacatacaagtttttgtttgaactccgtttctgattctactgggtatacctgggagtggaattgctaggtcttatggaaattctatgaacaacttactattgaaccagcaaacttttctgctgcagctaaacagtctttacatttctacaagcaatttgtgttccagtttctccacataatcaccagcacttgttattttccactttttacaatcttttttttttcctttatggccatcgtagtggatacaaagtggcatctcattgtggttttgatttgtgtttcccagcagctaataatgttgtgcattttttaatgtgcttgttggccacttacttgtcttctttggaaaaatgtctattcaagtcttttgcctattttttgattgggttgtttgtctttttgtaagtgttccttatatactctgaatattatacccttatgaaatacatgatttgcaaatattttctctcgctctgtatattgtcttttaactcttttgacaatgtctttttgatgaacaaaagtttctaattttgatgaagactaatttatctattttttttgttgttgtttttggttttcatgtcatatttaacaaaacagtgagacttccaaggtcatgaaaatgtacttctatgattacttctaagagtttataattttttgctctttcatttaggcttttgatgtattttgagttacgttttgtatatgctgtaaggtagggtccaacttcattctttagcaggtgtctatccagttgtgttgaactggatatatgtgttgaaaggattacactttctctattgacacccttgtcaaaaatcaagtgacataaacccatagacgtatgttagctagtatctagtctaatgggtccaaatatgaaccgtattctgaagactctctgaattatattcctggccagcacctctatgccaaacttcagattcacatatctaactgcctatactacagcttcatttggatggtgttatgaactgaattgtgccctacacccattcatatgttgaaaccataacccacaatgtgactatatttggagataaggcccttaaggggataattatgagtaaatgagtttataagagtggcagcctaatgtcataagattggaatacttataaaaagagtaagaaatactagctatcttccctccctgcctaccccagtctctttctttccacacatgcacagaggaaaggccagatgaggacacagcaagcaggcagatggctgcgagctggaagggaagcgtcatcagaaaccaaccctgagggtaccttgatcttggacttccagtctccagaactgtgagaaaatacatttctgttgcccgccaccacccagtttgtggtgttttgttatgatatctcgacctgcctaatacagatggctaatgcaaagctccagtgcaacactttagaaaacgaaccctgttgtacacctgacctcctccagctgcagtctcctcttctcagttgatgacaactgagaactctattcttccatttgcttagtccagaagcttggagtccatgtggttccaaacccatggcaccgtatgccaatcactgaaatgatgagttttgtggcagagaatgagtttatttatgagggagtcaagtgagaaagcaggagaacaggtctcaaatcagtctccctgaaaatgggattttagggatatttatgggatagaggagtgaggtggtccaaggtgtaggaaaatgtgattggggtaggaaaaaatgaggtaatcagtaatctgctcaaatatagtcaaacttcatggctcttcatagcacacatgttcacaaaatggtgtcattaacatgatctgagggtggagttttgggcactgtgacatctaaaggtcacccattggatattcacgcaggtccagttggggaccagtggtttcagctagcttgaactggacaagagttgaccctcgttcctgaaaagaacttaagcaatcgttaccacagtgatctatacatgagagatgttatctctgaggaaactggtggcagttttatttttttttattatatattgcttagctacgtgacctttagctatgaaaatcttaaaataaactagaaacaagtgaccgactaaaagcaagcgactaaagccagtgaggcaagttaagtctgggcctaatcaggggagccctcggcctcaaacattgacccctctcatttccacgacctctgttcctcacatataatctgtcagcaaatccttttgactctatttttaaagatatccagattacaatcatttttacaacgaatcaccctgtctcagctagattacttgtattaaaatcacaacgattttacttgaaaacgcttcactgacttcctacctgactctgtaaataccccatgttgtttcataatccatgagtatctactgtctgcgccttccccctccacacacattacctctctgatcccacttcccaccacttctcccattcctccctctactgtagcctcacaggcttcctcgctcctcaaaaacgccaggctctcacttgccatgctgcttttagctctgctggttcctctgcctagaatagtctctctctctctctctttttgatacagagtctcgcactgttgcctgggctgaagtgcagtggcccaatctcagcttactgcaacctctgcctcccgggattacaggcatgtgctaccacgcctgggtaattttttgtatttttagtagagatggggtttcaccatgttggccaggctggtctcgaactcctgacttcatcatccacctgcctaagcctcccaaagtgctgggattataggcttgagccaccacgcccagccagtttccatctcttaacaagtgcttggctgaggcctcacatctgtccttaaccttcacctcagaggcattttccctgatggtgttacttcgaattgtcaaacttatccttttcccacttctgctctatttctctccggagcactgttcagcacgtattgaagcattctacatgcttatttttacttatgtgtcttgttctgtcagaatagaagctcatgaaggcagtggtgtctactttgtttcttctgcatccccagtttccgagcatgggcacgaagatgcagcttaataaaggagtgctgatgtgtgagcagatgtatgaactgaaggtgggggcagtgaccactgtggggatgcaagagcaagtgggggagggaggccttactttattgcaaacgagcaagctttctgcaacgcgtcagaaggattagaaaggataagactgcactccgggttttgcagtttctcttttcttttcaattcacgtagaatacaatcactccactaccaaatatttgtcattcatgcatttcctaaactgtaaccacctgcaaggaaaaaaactcaagagcctttgagaaagttgtaatgtcttgcatatcctcatttttatatgttctctatttctgtttagaaggcattgagttactgagtattaaaaataaaagaaactgctgaaaagaatttttttcaaaaatgacacaaatattcttttaagtgacagttacactactcaagccttttattttttcatccagacatttctttacccatttggtcatagttttgtctaaacctatgctggtttaaattataaatcctgtgactattttcttgcaaaagctttttcaattttttttttcctattgaagctattaaaacaacaaggaaatgcctcttgctagttagagcaatgcattgcttataattaatgtcttttggcaatttcccagcaactgagcttctcagaactcaagtttccatggtatatccttgagcaaagcagtaggtttggcctcccatgtcatatggatcacagttggtggggtagaatattgagaactaattcagctattcattatatgtcggtattttccgcacggtctcatcatggcctatatggagtactcagtctcatccccaaatggctgaaactggggtgcagatggaaccaaggtggagcccaaataaaaaatcaggtctcctgcacacagaaaatgaatggtgttttcaaatcaaactacaagtcaaaaaacacacagacactccaaatttgagatgttggcctgaaacccggctgcttcttgaaatagaaaaacccttaggtgagcagtaatagggatttctatttttaagaatggcagaggactcctagaaaagatggatagaaaaacctggctgagcacagtggctcacatctgtaatctcagcactttgggaagctgaggtgggcggatcacttgaggtcaggagtttgagactagcctgcccaacatggtgaaaacctgtctctacaaaaaacacaaaaattagccaggcatggtggtgcgtgcctgtagtcccagctactcaggaggctgaggagggagaatcgcttgaacccaggaggcagaggttacagtgagccgagattgttccactgcagtccagcctgggcaacagagtgagactctgtctcaaaaaaaaagaaaaaaaaaaaaggaaaaagaaaagatgaatagacaaactaataactaataaatatgctttttgtgttttcataccgcaactaatttattttagaaaaaatgcaagccaagctgggcattgtggtgcatacctgtagtcccagctactggggaggctgaggcaggaggatcatttgagcccaggagttctaagctttagcatgctctgatcatgcctgggaatagccagttcatctcagccagggctacacagtgagaccttgtcttttaaaaaaaggaagaaagaagtaaaaagcaaagaaaatgaaagaaaatgtatgccagtatgatattttcaatgcaaagtaactccttgtagaatactggtggtccaaggagcagcatatggaaaaggtggaaggaaataattgcacagaaaatcccaaagtggatcattcagttcttgtaggtatattttgttctagactttgcatttttaaatgtactttgagtgtccaaatacctcaaatagaagagcgaattgctctctaggttttgggtttatgcaaacctgaaattttcagtatcaataaaatctttaaattttacttgctacatacttcatgaagggagatgttgcttgacattttaattttacctaaactaagcctgaaacaggttattttttaaactacagtatctagtcacccctgtgatgtgaaagctcctcttctacaaagaatgtcatgaatttagcaaacaagggcttctaatttaatgactatttgactagaattattaaaattctacttagtccaaaataaaattaccaagaagaatatgtaaaatacgtaggaaataaaaaatagaatttgccccagataatcagtggaggagtaattgtctacagttagttggcagcaagctgcatgagacctggtagaagacagaggatctgtgtagagctgtagaccagaataatatgaggaagcacatattctgcaaccaaatatctgtccttagcttccctaactgcaggatctaatcaacagcggagtcagcagggagcaccaagctggccttactcagtctcagggctagaatcagtgcccttgaaaacaaggctaaagaaatgcccatcgtttggatataatataagtaattgtctctagtacagtatgtctttcaattggaagcataagaacaagatgttcaaagttgttattaagcatgtgtcaaagcattagttattgatatattagtatttattgttatggtagccccccttatcagttacccacagtgtactacaataaggtattttgagagagacagaacacacattcaaatagcttttattacagtatattgttataattgttctattttttattattaatctcttgctgtgcctaatttatgaattaaactttatcataagtatgtataggaaaaacatagtatatacagggttccgtagtatccacggtttcaggcatccactgaactgggagggtcttggaaattatcccccatggataaggcggaacactgtattatagtaattatcgtggacaaagcagaaagtcaaaagagctggttctaaaagcatttgaataatagggacttatatggagttactccagaaacaaatacccaaactaagattactaaattatatatgaatttatttaactttctacttaaaataaatcaaaactacttgcttctctaccagccataagttattggtagtaacttatcaatttctgcaggttaacctctaatcttattaaaaaaatttttttagagacagagtctcactctgtcacccaggctggagtgcagtggcatgatcatagctcactgcagcttcaaactcctgggctcaagggatcctctaatatcagtctctggagtagctgggactgactacaagtgtgcgtcaccctggtttaacttctaattttatgtgaacaagagaacctttataagttgctaattcttatgtcaaacaattaaaacaatgggcaccagagcattgaaaaacaagctgagttgatcactgataaaggataggaccacatgtcactaaaagaaacacaccaagcaggctgctgaatgaaaacttcatgtgaggttgtagagagagagctcatgatggctgtgctgatgaaaggtcgaaattttgcatgcttggaaggacagaattaggccacagatctgtagacagcttgttaaaccgaattgtatcattcatcagtcaggaaaacatttttagttaggtcctgattctaaaagagttggtaaataagacctctccaagtttttcaacactattagctttgggttttatatccttcgaagtttctgttcatataacagcttctgcccggcagctgcacgtagggaaacacaactctcagctgtgatatattcaggcaagtggtgtcataaagagaaaccttccatttagatttgcaaatatattgtgaccacaaaggtacattccccacaagttccacatgaggatcaattaggctaatgagaaaattcttgtctgggcagggtggctcacacgtataatcccagcactttgagaggtgggtggatcgcttgagcccaggagttcaagacaacatggcaaacatggaaacatggacaacagggcaaaacgctgtctctaccaaaaaaaacaaaaacaataattatctgggcatggtggcatgccctgtagtcccagctactcgggagcccaaggcaggagaatcacttgagcctgggaggttgaagctgcagtgagcaaagatcacacgctgcactccagcctgggcaacagagcaggacctgtcttaaaacaaaaacaaaacaaaacaaaaacaaaaaagaactttttttagtatgaaataataacaacaaataaccaagcaatcttcattttgccttttaccaaatttgaggtaatttttttctatcatacaacaaatacaacaagatttaaatgtagtcaagcaatgacattgaaaacatttgaagccaaatatcccatttggtgaaatgctagctttttcattggttaattctcatcttattggtcattccttaaaaatgaaataattgagtcagatttgagagtttgtttctctaccctgtacttaggtaaggaattggttttggttccaatattatctgcaaatgagcagggactcgctgtcaacaggtatgccctgtttcagtgcacgtgcttggtctggccccatgccttgcaggactgactgagacaagatctcctactcctctggtgggcaactcctgttgtagatttaatattacaaatatgtacaattttttatataggcaaatttgccagctagtattaacaattataagcactgtcaataatactgtcaggatttatttgtaagaatattaactgtagcattattgcaacagaaaaactggacataacaacaaaaaaagaactggttgaaaactatcattatgatgattatgcaaaggggtactttgcacccattagtaatgatgttaagaaaatgtatttaatcatagtcatcctaacaggtatgagagccctcatcgtggttttgattcatatttccctaataattagtgatgttgagtatcttttcaaagacctcttggccatttgtatgtcttctttggagaggtgtctattcagtacctttgcccattttcaaaattgggttatgtttgtttatttagttatttttgctattgagctgtgtgagttccttaaattttttggtaattaaccccttattaaatatacggtttgcaaatattttctcccactccataggttgccttttcattctcattgttacagcatagtatctctagttaaacataaggtattgtgtacttaacaattcgtcaagagtgtagatctcatgttaattgttcttactacaaaaagaaaaaagaaaaaatcacgaagagctacaaggaaactgtcggagatgatagatatctttattaccttgactgtggtgatggtagcataaatgtacgcatatgtccaaactcatcaaattatgtacattaattatattcacgttcttttatatcaatatatcaacaaagctaggaaagaaagaaataaatttttgtttgttcgttttgttttgttttgtctaatgatgggacggtttcgctctgttgctcaggctgatgtgcagtagctattcacgggcatgatcattgcacactacagcttcgaactcctgggctcaagcaatcctcctgcttcagcctcccaagtggatgggactacaggcacatgctaccacacctggctgagaaaatggtctttattttttatttatttttatttttttgagacgagtctcgctctgtcacccaggctggagtgcagtggcgcgatctcggctcactgcaaactccgccttccgggttcacgccattctcctgcctcagcctcccgagtagctgggactacaggtgcccgccaccacgcctggctcattttttgtattttttttagtggagacagggtttcactgtgttagccaggatggtctcaatttcctgacctcatgatccacccgcctcggcctgccaaagtgctgggatgacaggtgtgagccaccgcgcccggctgaaaatggtctttaaaactgtattttatggcatgataacacttatgtgcaaaggatgatcctatttttggaaacttttaaatcaatgggtgcatgtttgttttcacaaagcaaggatgataaatgtgtgcaccagaattcacaagggggctggatgtggtggctcaagcctgtaatcccagcactttgggaggccaaggcaggaggatcgcttcaactcaggagtttgagaccagcctgggcaacgtaacaagaccttttctctactaaaattaaaaaaaaaaaaaaaaaagattagcctagtgtgatggcacacacctgtgttcccagctacttgggggatgaggagggaggatcgcttgagtctgggaggtacaggctgcagctgagccctgatcatgccattgtactccagcctgggcaacagaacaagaccctgtctcaaagacaaaaacaaacaaacaaaaaagcacaagaaggtagttgagggtagtaggattctgggttatttaaatattttattttttcttatttgtacttaattttctacatggcattgagaacttaaatcaagttgaatattgtgcatgtctttgttctcaaacagcagccatggccataataatggcaggatacctacggcttactgagactccctttcacgtagctcctatccattctgcagatggagaacgtgagttccaggagatttgtttaccagaccaatttatgctaggatgggacagaatgggagttagaggtgctgaaaagatggaaacctttcgtgttaccacatttctgtcattcggtgactaaaaactaacatggagctacttacttgagcatttgaggattaatgagcttatttgtgagtaatcagataagagaaacaaagatttatttcagtagctctcaaattttagtagggaacaggaggaatccacccctgagagtttctgattcagcaggttttaggtggatcttgagagtttgcatttctaataagttctcagagatgccggtgtttctggtcaaggacagcaatggcggaacacgcttcttagtgcctttaccgctccatggattggctggagtggcatcacctgggaacttgttagaaaggcaaaatattgatcccagtttgaaagagtcagaatctgcattttaacaggatcctcgggtgatttgcttacatgagaaagtttgggaagcagcactttggtacataggttgtcacatacgaattagataaatcataaatctgaaatggggtgtgtgacattcctgcttgtaatatatttttctcatgtttataatcgataaataaacaatacaaaacttataaataatgataaagcactccagactcctgagttctgctgctggttaacagtcaattaaacttcctcagtcctgatttcctcattgggagaaaaaaagagttggaataggtgagcatatagtttctgatttcagcaaatagattttgtgttggttggaagctgaagaaaatcaaccacctgtggtataaatccttcggcaggagacatcatgaataagcgatttcagtctcctgacagccacggctcagagtcagctgttagctgatctcctgccgctgatattgtggcctcgaaattatcactagaaccagcttgtgctttgtggctctggtgggcagcctaggggaggaagtgggggaccagatgctggcaacaggtcttccaggccctgcattttccccattgtcatgttagtctttgagctgacaaccagaacaatggcttcttaacctaccccaaataattttgataaccttctattctcatccttttttttcctttttctttcccatcttgtctttgaaagtatcagacctctgaggaaaggctattgacatttgatctgattatcgttgctagagccacaaagagaaattttatttctaacgttgtttttttcttttccccaagaagaggctttctctttgtatgtttggaagaggacaacatatttggaatcttgagatctcagatctctgtaatgagcagtttgcctaagaaatcatgaatccagattaatcacttttattccagcaaaaatgcaactctcttattgcattgtgtaatcttattattatgctcacttcggaggaatagggaagtccttaccttgtttcgtcttgcaatactagaatttccttgaaagcaaagtgaacctggagtgatagattcactttcatgtttcagcctgattttttcccactgtatgcccacgcgtgtgtgtatgagtgtgtgtgtgtgcgtgcaggcacacacacgcacactcacattttcctttctgcctcccctttcgagctcttcctgccttctctatcatgcgcaggcccctggcagctcgtggttggcaagagcacgaacccgtggtcagatgcaacgtcctgcctcatgcattttcctcttggtgctttggtcagaacttccccaagtggagtgaaactcaggagctgagaaaccgagtcactgtgaaaagatgggaaattatctcctgcgaaaactcaggtgagtcttgactcttggtgccgcctttcttgggagaaagagaacagagataaggaggctggacataacgcatttgtaatggtgaggtacattgtgcttctagaaggttaagcctgaagacagcatcctctaggagcacacagtgacgcccagttggctccttctcttgccttactctggaacaatgataggttgccagatgtagaaaacaaaaatactggatgctaagtcacattcaaattccagaaaaacatttttttttttagtatgaatgtgcctcatataatattttgggcattataacatgggttgtactttactaaaaagttattcattgtttatctgaaattcaaatttagcagtgcatcttgtatttcatctggcaaccctacacaattgtcacttgaattttcctgcttctctttttcttcatgtgggtgtagagcttaactttccatccatcagcttcgtgggttggtatgagaatgaacagttaggtccttgcaaattatggatgcgggatatgcatttgaatgcctttgactttagtcacaccttttttggtaatgtttagccttacactcttccaatacttcataatttatagaatgtgtacagataacaggcattattgttcttacatcttgcttaatcttaaatgatgggctctacagcatcccactcctctgtccgctctcccagtccccttccagacaatcttgcatatgacgtgactacattgatagacccaaggcaaaactctcatcatatcgctcctgtgctccagtgggtaccatgtagaaatatgactggacaaaaagggtatgacctaacgctaatagacggagtggaaaatcccagcaagtcttgttctgtctgtttagattcttcttgacctctctgtgcagcgttccttacttacgggtatggggcagaggactctctggaatgggggcttatgacctacagtcaaacaaagtaggtcagagaagctgtctttatgaggcagcagattggcttccccacacctgatggttcataccgtctcctttcaccaggttaaatagttcagctgtcccttgatgtcttcatttagtctttcagtaaattgctatttgttaaagagcttaagggtggctgggcacggtggctcatgtctgtaatcccagcactttgggaggccgaggcgggtggatcacgaggtcaggagatcgagaccattctggctaacacggtgaaactccgtctctactaaaaatacaaacaattagccgggcgtggtggtgggcacctgtaatcccagctactcggcaggctggggcaggagaatggcgtgaacccgggaggcggagcttgcagtgagccgagatcccgccactgcactccagcctgggcgacagagcaagactctgtctcaaataaacaaacaaacaaaaaaaaatgcttaagggttcatggatggagaagggccatcaaagttcaggatgagcatgagtctgggcagtagatggaggacaaatgacacaattgtgctgagaggtaaattcaattatttaccctaaagaaaaaatgtttcccttcttttaaagttaagcaatatttatggaaagcctaggtaagacaatggtcttggtcgcaagaaaaaattaaacatggaaggaaaatggatatggaagcaaattttaaaaatggataggccccttcagagaacatcgtacttaatcactctgactcagctttaaaaaaatagacattacgtggctcagataattaaaattgagagagaattaaaacttgtcaaggttgcctttgctataaaattatgaatcttacatgtaatttatgatgtcaagtcatccgtcatttccattacaccacaatggcttctttttaagataaggcaggtgctaatgtgttctaggcagaagcacaaacagcgcactgtagaaataaaaggaaggaaggaagggaattctggtttgggatagcaggaaggaaggacatgcttgaggaattgccatttggattgtgctgtaaatgttaggcagacttacaaagcaggaaaagatggtccaagctgaagggacaacctgtgaaaatgtatgagtttcaagtgtatggtattactgtcaataattggagcatattgttcagagatgactccagtagcagaagaagttgagaatgaagctgggggtctgataatgaagggccttcaaaggcacgtagaaagtggtaagcagtgaacatttataagctggagaaaaatgcaatgtggcatgtattttaggaagaaatgtctatgctcagtgagtatggaggaatgacacagagagaaatagacaataagctcttaaaatataccaaagaagatgcaggggcaaaaggaaaacttcccctttgctccctgaaggttctctgaaatcagctgagaaaaggcagattaataggacaaaaggcaaatttattgatcatcgttttatgtgacacaggaacctcagaatgaagacccaaagatgcaaaggaaactgtccatttctatgcttaggttcaacaaattttggatagccatgtggaaatatgattggacaaaaaggatatgacctaatgctaatagacagagtggaaaatcccagcaagtcttgttctgtctgtttagattcttctcgacctctctgtacagcattccttacttatgagtatggggcagaacactctctggaatgggggcttatgacctacagtcagacaaagtaggtcagataatgtctttatggctggttcttacacagaaagatacagggaaagttagagtcatcttactaattttatggctggctttggggaaaagaggttctggtttctatcaatcaccttggggaagagggattctaatttctatggctagccctgggtaggaaagagttgtcacagagaggagggcaggagaaagagagctgcttctgaggcttttattttggagtatcattttctgagccccaacaaagagatggtaaagagctgaaattcatcaggaacaaccaaaatgaagaggaaattcagtgaaagtaaatgcattcccaaggagtcaccttggtgtgtgtcagtcattgggatcacagatgtggtgtgagagaaggctggagaatggcctctagaacacggatgcagagagcctcctgttgctctgaccctgcttgtcagaggcctgttaccttgggcagtgcctaatttgcagcctgataattggctgcagatgagtctggggaaggtagctgctgctttctagcccctgactagcaagagggtgaagtaaatgtagacatcgcccatgggcagtgtccatcacataccctctttagtctttatttcaaaattgatttagttctttgaagactttatcctcccatataaatttgtacacaaattctgaatttgtgtattatataaaaagtgccagcttgaatttggattcagacaacattgtgaatatagagatctatttgcaaattcttctatgtttatgcagatgtactatatgtatatatattttgagatggagtcttgctctgtcacccaggctggagggcagtggcatgatctcggctcactgcaacctccaccttccaggttcaagcgattcttctgcctcagcctaccgagtagctgggactacaggcacgcaccaccatgcccgtctaagttttgtatttttagtggagacggggtttcaccatattggccaggctggtcttgaactcctgaccttgtgatctacctgcctcggcctcctaaagtgctgggattacaggcgtgagccactgcgcctggtctatgcagatatactattaatacaccaatcaaaacaattatttataattatctttattcaaatcttctttaatgcattctgatagagctttaattttttgtttttattttattctttgttagatagatttctagataccatatgcaacagtaataaatctatgaatgacattttttcctagcctgttattgttggaatgctattgaattttgcaagatgactttgtatccactagccttgttgaatttctcattttttttcatggttttttaatcctactgggtttacatagttaatatatcatctataaagttaaagatttttctattctttttttgttccttacaagtcttataggtacctttatcatgttttatagcatagttatgtcagaattcttaggcatcattttcttgtaactgatcataataatttttttctaaattgttttcatcaaggttgctgtatatttttgacatttatatttggcatttatgtttttggcatattgcctctatcaaaataaggagattctactttttaaaaaaatatgtagagatgagatttcactatgttgcccggtctggagtgcagtggctattcacagatgcaatcagagtgcactacagctttgaactcctggcctcaagtgatcttcctgcctcagcctcccaaggagctgggattacaggcctgcaccactgcacccagctcttctgagggtttttattgttaataaggaccaaacattatcaaatgcagttttaaactattgagataacctcatgattcttctcttaggcttctaaagtagttaattatgttaataaatatttttgctaattacctatcttttaatttctgggataaaacccatttgattgtgatgtgtgcaattttactatagttttagatttagttaacttatattttattgaggattattgcatctattttcatgatcgagttggacctgtgatttttaaaaatttgatttatttaatttgaaatgaaagtttaccaatctcattaaatgggttggcatcattttacatttctctactttctggaacatcttatatatgagagagtatatttgtcacttgaagtttggtaaattgtgtacgcagctgtgtaagctggatttttttgttattgatgttattcatgtgtcagtttttatatttcattttttccaagatattattcattttaagccataatgtttattatacataattcttcatcatgcctgttttatgtctgtaatacttattttgaactttctgttttcattatatttttgtctccattccttatttctttagttggtctttccagacttttgctatcttactgatattattcttttctaagatttggttccctatcatatttatttttacccacaactttcttgtttcctttttcttctcccaacttcttaagataaatgcttactttgtcattattagtcatttatgttttcttatgaatgtattttagcaagctattttcttcacacttcactttatccttcaaatagtcttgtgtagcttgcattattattttattctgtgtttttagaaagttcctttatgattccctctttaacataaggattatttagaatattacttgtgcctagacaggtacacttttggttatagcttattgggttttaattttactgcttgatagttggagaaatcatgtgcaaattgttgattttgggggatgtttactaagactttctttgtagagttatgaagtcataagtcaacatccaacatttagaaagtttaaaaataagaagaaaaaacacagaaggtataaaaaattattcataatcttaattctttggccaagatacatctaaagcttaataaaatacctatttttgaaaacaatagagtattagttgatttattaatttggtcaacaaatttttgtacatcacctatggcctgatattatctgaattcctctggattaagaaaaacactttttactttattcacagtagaatttagtatccagttatattcagtaatattaatggtgtggaattccaattaggtccctactgatgttaaatacttttcctgtcttgttttcaactttaaaatacaaacatcctttagatgtgtaagtcaatgaatcactaataaccccaaggacaattattttaccaaattctttctttattgaccagtttaggaagatggaatcgtgagaaaactagactccaggaaaaggggaaaaaaggagacagttaaattactttttacctgatttacaatctacactattaaataaacattacatccagatttgactgtgatcgtgactattatacaaaatctctacatcagcaactgattctataaaaagcccccacctctgtaaattgatattcctttatatttaacaaatatattctttgcttagtggctttgtgtgttgatatctagcaatgtttcttgaacatatacatatgacctctattcagggaaggcactttctcagcgttggttcgaaatgctttccccgaatactgctggtaagcagaagtgaggctcttatatgcaaagctacctagaagcagaaggatagaccagtgctgcagaagtgacaatagaggaaaagaaaaccatcaaggaaatgctatgtgtggacaactggtggagtagaaagtttgattaaccaagtcacaaacataagctgctaactattgtgttaaccacgcaaatcacctgatttctctaacttcgtcatttagtgtttgcctgattatcataaagatgatgataattgatggcaaaacaccaagagtaatatgaaaaagtcagctttcctgaatgtatgtaaagatcccaatgtcttatctgcacatggatgcccacatgcagcagggcccagagacgcttgctctggttcagtgggccaagactggcagtcctcatagtccacaaaggtgtgtacaagcagatcatcttgcctcaggttgttgcaaaagtgatgcttccctgttgttaaggtctttatagcttcctgggagctctcacctcttctagagatgcaggaagtttgcatgttgggtcacaagaaatcctaagactgacagaatcaaaagtcagactatgggcattctgtcccatcagagtcctggtctctgtggttaatttctgaaatgcattctatctgtgactgcttattgattttgaaggaaagggaagtttgtcaaaaagaaaagtcaggtttggttttaatggtctagaaagttagagaagaaggtgaaaaaatgtggagggcagtaacaatctctcttttttcttatgtgtttccatatagttgcctgggagagaatcaaaagaagcccaagaaaggaaacccagatgaggaaagaaaacggtaagaacagagcatctcagagtttttttgttttgttttgttttgttttttcattgagattacttccagagtctctgccccactagaactaacaccccttagggccgctataatagagttctttggtgattacctgcatgacttggcagcaggttagacattgactctgtctaaataagaaagacagggtattagccacgtgttttgtttctattgattatataatgtgagtgtagaaacataaagatagaataaaggatgtttggttttggttggttatatgtggtggccatatttcccaccttttccttacaagtagccagaataatctttggaaaacatgtctcattatgccttttccttgcccgagaccattcagtcattcttcattgcattcagaataaaatgcaaactcttcaccagggcctacagttccataaggattggattctgcatctctcccatctggttcctcactctctaccttcacccactatcttacatgcattctccttttatttgatgttctttaagccaccaaactcagcctcactttagggcatttctacaagctggtcttttactgcacaattaaaaaaaaattccatatttgcatttggactgattgataacgtctcctcctggagatgctggccctcatgcccttctctgaaagattatggaggaactttgcttctgcaccgcatggttttatggcactagaacctacttatatttgctgtggcctttatctgaacttgtaactctatatgtcgtttgagctctttatagtccacttccttcatagaccatacgcactttaacgtcacttctgtttcacttgctaatgtatatctgttgctcaacccttgcaagacactcaatggaaaaaagaaaaaaaatggagtggaaaaatggtagatatctagatgttgatatcttgcctcagcttagatgaacagaaacaccctgccttgttggttaactgtaggcttttcgtattcttgcactaagctcttttttaatcatttcatctcaatgtcttggtttctgtctctgagatggcttcttcttcttttccatggtatgaaggggcagaggattgaggagatgagccaggtatctgttggtgatgtgaaatgatgtttgcaggcatcagccccctcctaaatgtttgaacgacactttcctgcacaaaggagagagttggcttcatgagtcagccctcagggacagtggagttggctatgcctatcttgtgaccctttctcacgctcccccgactccccccactccccttatggtttgtagctggagaggagatagcaatgatttggtgatattattgaaccaaggttcttttatcagctgctgtgaatcagttctgtatagcgtcttttaaactagacttttaattcaggcattcccattaggcatttaacttacgcataaactagtcatctaaactaggcttttgtttcatcatgtctaaagtgagatctgcactagatgtcattctctaatatttttctgttaaaggaactgaagtgttaacattttcaaataccagcaagcctttattacaatcagacaataactaaatgtagataaattaaatgtcgttagggttttctcatgcaaggaaattttaggagcacgactcatggaattttcactagtcagcatggtgaggaagatctgaaccattttaccattctagtcaattgcagtcaaatatgtgttgcatgtgggctaagaagtcagtttcctttttggctaatttcacaggatgatgtctattgaataaagttggattttctacatcttcctgagtcaattttgattattggattcttatcagaatattattcatttaaacatatttacagaaaggacagtatgagctctttcaagtcacttaacttttaaaatgtaggcttatagaggtatagtacagtaaaattcacccttctcatatatacagtttgataagtttaggaaaaacatactcagtcatgtagtcaccacaatcaagatacagaatatttccaccaccctccctttcccttcaacccctggcaaccactgatctgatttctgttttgcattttttccaggatgtcatagtatcattgcttttatctttattgcattcttatttttgctttccttagttttttaaattgttgctattctaattgttttgaattcaaaactcaataattttgttctcaacttttcttgtttaggaatggaagcatatatgaatacaaactttccctctaaataatattttacctgtatcctatgtgtaattgaaggaaatactattattgtctaatattttgcaacttttaatttattcttggacctgagtagtttttaaatttcaaatattgttttatagtcttgaatataatttaaattttatttgttaccagtatctgtgtggtctgtgttatttctgctttatagattttattaaagtcttctttgtcctatatgttaactttgagacaagttacttacattctctaaattttgggttcttcatatgcaaaatagccttaaaatactacaattttagcttgtgtttatggaaaaagaaatcactgcctatttcatcagcacgatggctgtctggcaccaacactcaatacatactagctggtatctgtgcacatcattatgtgcctagattttgaaaatatattatgtaatattttgttcagagatcataattttgaaatttgtctgctagagaaacattattgtgtatttcagatattcactgtcattatttctcctgcttgttattagctgagagaaattaatctactggtttatttgagttacctttcatgttttctttttctttctttcatatggattctaaatagtttggtgtgtagcaattcatgacagtattaggtgtttgtcggttttaatctttatcatgccatcttctgtccagctttttttttctgaaatgacggccttgctaaaatcttcatcttccgcagtgtgagaaggtccctgtgacgggagatcaaggacacccagggacattgcaggcagcttcctctcggatagggaggatagagggaggtcctgtttcattagtattgcctagtctagttcccatatatctatctatattcatttactaaggctcttatagcgaagtaccatagactgggtggcttaaagaaccaaaattttctttctcacaattgcggagactggaagtctgagatcaacatgttggcagaggtgggctgttttgtgaagtctgtctttggcttgtagatgactgtcttatccctgagtcttcgtattgtcttccctctgtgttacgactgtgttcaaatgttctgttcttataaagacaccagtcatactgaaataaggcccaatcttatgaccttgttttaatttaattacctgtgttaagatcctatctccaaatacagtcacattctgaggttctggggattaggacttcaacatgtggattttaaggggacataatttagttcatgagagatgtcaagaaaatctaagaggattcttagaaatccaggaattcctgccactgtctggacatttccagcggccacagcatgcagaattgttccactgtatttaagagagagtggacaagcagtaggtgctgataatccacagcccggacttagataggtttggattttgtggctggagcctcggaacgacagataactgagtggctgaattccccattcaccagctgctttgttacataacttcacattttacaaagtccaaatgtggttgtgcagtaatgtttgctttatttctttcctaaagacctcgtaggttttagattatctcagtactaagacatttgagaacacatcttctttccttggagagtaatacagttcttggatcgtatctttctcctcacaacttagtgaacgtaattccactctgcagctgtggagctgagccaccttaagccgccttcctgatgacttggttttacatacattttccccatgaaagtttgaaaactcattatttgttccctacccccacccccaaacatgtattattttcttttatacatatgtctttattttaattttttttctcacctttcttgagctatgaatgaaaaacaaaaattgtacatattgaaggtacacaatatgatgttttgatatgtatatacggtgaagtgattaccactataagtacattaacaacttaatatatttattatctcagacagttaccattatttttgtgtgtgatgagaatgcttgagatccactcttttagcgaatttcaagcacacgttgtcactgactatagtcaccatatctcagtgttccatgccatttgttttttcccctgtgaagtcggttttcagatttaagtatttattttatgacttttctctcattctacttttgtttcatttgtttagattttttttatttttattttttatttttttgagaccaagtctcactgttgtcactggggctggagtacaatggcgtgatctcggctcactgcaacctccgcctcctgggttccagcaattctcccacctcagcctcccaagtagctgagactacaggtgcacaccatcatgcctggctaatatacaacttttttgtacagacagggttttgccatgttgcccagtctggtctcaaacttctgggctcaagtgatccatctgcctttgcctcccaaagtgctgtgattacaggcatgagccaccacacctggcctacttttaaaactgatagagcatacttgtacatatttggggggtacatgtgatattttgataaatgtatacaatgtgtaatgattaaatcagagtacttgtgatatccatctactcaaacaccaatcttttatttgtcttgggaacattacaattcttttcttccagctattttgaaatatacaataaattattattaactataattttcctcactgtgctatcaaatactaggagttatttgttctagctaactatatttttgtacccattagctaacttctcttgattctttcctctcccattaatgttgctttaatttaatataaaaatgttattctctataattgttttcctggtttaggccagtccattttccttctccatttattattgttaataactattaacaataataaacatgttatttttctgcttctaaaatattgtttctgcttcttttgttttgcttttgttacgcatttcatctttgtaactttgtgcttagtactctgaatgaaagtagatcatttgtgagataaaattgcgtgtatgcgtgtgtgtttaaggagggtgcagacgagaaacaagctatggctgtgactgaaccaaactgagggcggctcacccggcgccgcaaagccaaaaacatccacacggagggttgcagcaggaccaaggaggcgtctatttgcaggtcaccaagcaaggagaatggatccctcaggcttaagacctgtcctcttcaatggcttacaatcaagggtttttaaaggcaggggtaaatttcaggaaagcagaatttacaggcaaaattgtaaataaatacatggagattatagtttgtttggcctaaaaagctgagataccttgaagctgagggggaagggtgccttacgggtcataggtggaatgaaagattctttgatttgcaattgtttaaggaagcaaagctttgtctgagaatatggagccatgagtaaggaacgctaaggtctggctcctgggcatgactttctcaggctcctcaggaagaaatttagacaaagtatggcgctgggagttcagtcctcagcgcgcccgtgcctgaggtccgtgtgccagaggatgcatgtggtggaggtccaggtttcctcctgcttcccaggctccttatttactgctcagggctggctgggtgcctggaatttccctcgaagaaactcacgactttcctttatttccttgcttggcagtgccagacagacttccaagaggggtctctgctctgttgcaaaatccaggcagtgattgtggcatgtcgttttagaatgcttcctcacaaaatgtttttccctcagcccaggcacatctctctactgtgtacctagctgtccttgaggcaggcagctgattacaagttatatccttttttcatatttccccttaaatttaggagtctgactgacagagaaataaaaggtgatatgctggcaaccccatctcctccctaccgcctttgaatcctctttattgtgtaaattgtgtccctttaaaaataatctctatttctttcatcactggcccacacttattttttttttaatttatttttatttttatttttgagatggagactcgctctgtcaccaggctggagtgcagtgaaatgatctctgctcgctgcaacctctgcctcccgggttcaagcaattcccctgcctcagcctcccgagtagttgggactacaagtgcatgccaccgtacccagctcattttttttttttttttgtattttagtagagacggggtctcaccgtgttggccaggaaggtctcgatctcctaacctcgtgatctgcccgccttggcctcccaaagtgctgggatcacaggcataagccatcccacccggccaccacacttattaatgtctattactgtaaggttttagttagaattcgtaagaccctctcatttgtctttaaggatttatacaccctcatcaagaatagcagaaaaataaatttcaaaactttccattttctctcttgaattgtcctaaatttcattatattatatgtatgttttccatgcgtgtaataatatatgtagtctgataagctaataattctcttagcttcatgctatatggagctttgttttccacttttcattgtctagatttttgtggtttttcaaaaaaggctggagtaagcagccttttaattgtatttaatatttgcatggaaaatctaacaatggccttaggttaagggcaaccaaatgctttttttgaaaggcattttcagctttggagaacctggagtatctcatgttactatctctttccttgtaggcaggaaatgactacatttgaaagaaaacttcaagatcaagataagaaaagtaagtcatggctgtataatatttttcatagtagggaagtgcaaatttaagcatccaattagcagacactcttgagcctattgtaataacagattggagaagaggctgcttggagttcttactctttcataaaactgatcacatcattcttggtattaaagtaatatttgtatattattttttgagtgacatttaagaaacttctgtggaaagaagttaaccaaaattctactgtttttaatttgtatattggtgttctaaaatagggcctttgaatattagcaggcgataagaagtgtatttttttttttgagatggagtcccaccctatcgcccaggctggagtgcagtgtcacaatctcggctcactgtaaccccccgccttccgggttcaagtgattttcctgcctcagcctcctgagtagcagggattacagggagacaccaccacacccagctaatctttgtatttttagtagagacagggtttcaccatgttggccaggctggtttcaaactcctgacctcgtgatccacctgcctcagcctccgaaagtgctgggattacaggcgtgagccaccatgcccggcccctaaaaagtgtattattttgttctcaagaagttgaaagaagctggtggtgcactcctgtagtcccagctacttgggaggctgaagtagaaggattccttgaggccagaaattaagagtccagcctgagcaatgtagcaagagcctgtcttaaaaaaaaaaaaaaaaaagaatttgctctgtttgccatagtatctaggtatagtaatcatgtaattactcaaaatcgacagttatgaataacagggctcagcccctgtggacaagtatacctaaaggaaactctctgtttatttttacccctaactttattgaggtataactgacaaataaaaatggcctatattcaaggtgtgcaatgtgatgatttgatatatgtatacattgtgtaatgattactacatcaaattaatatatccatcactatacatagctaccatcttgtatgaatgtggggacataagggcacttgagatctattcccttagcaaatttcaaatgaagaatactacgttgctaactaacaagcaatggggatggatttcctattcaatccgtggtgctgggttaactggctagccatatggagaggatagaaactggaccccttccttacgccatatacaaaaattaactcaagatggattaaagacccaaacgtaaaacccaaaattataaaaaccctgtaaaacaacctaggcaataccattcagaacataggaatgagcaaatatttcatgatctagacatcaaaagcaattgtaagaaaagcagaaatggacaaatgagatctaattaaactaaagtatttctgcacagcaaaaataactaacaagagtgaacagacggctgggcccagtggctcatgcctgtaatcccagcactttgggaggccgaggtgggcagatcacgaggtcaggagattgagaccatcctggctaacacggtgaaaccccgtctctactaaaaatgcaaaaattagctgggcatggtggcatgtgcctgtagtcccagctacttgggaggctgaggcaggagaatcgcttgaacccaggaggcggaggttgcagtgagccgagatagcaccattgcactccagtctgggcgacagagcgagaatctgtctaaaaaaaaaaaaaaaattggtagtcaatttcagattcacacgtatgtaaattgcttcagcattcacagatggaatcaacatgaatctgcatatttgtgtgtaacttgaaatagttactcgtgttatttctgtacctatctctatagcaagtgttcattttaaagaattgtatgattttcctgtgatagttacataaaatttatatcttaaatttgcagctataatcattctttctttatgcttatcatattgcattgacatagcacatttatgaacattttattaccaaattttgaaatccatcttattcagtacattaatgtgctttatttacagaaagaacatactattgatgctatctcagaacacatgttctttcttgattttttcactcagtcttgagaacttcagttataagatggggcaatgtcatgtcagatgtttagataataggcctctgcagttttatgacttctacattctgtttttttcaccttttccttcaatctgtgatggggcaaaagtctcacagtgctttcctttctttcttttttttttttttttaattctccaggccaagaagtttcatccacttctaatcaggtaagtagaaaacaaaaagcaagacaaaagaaaaacacaaacttttattatgtttgtctgataaatgccaaaatacagatgatttattcaagagtagcatctgtcttcctttatttgtaatttctaaatgtacttttagaaatcattcatattttaaataatttatatggcaattgtaatgcagaaatgaaaggaaataaaaaaccaaaaagtatttcaactgatcgagatgagtagcaagttcttaccgttttggcctcaattctgctgaagtctaattttatttatttatttattttttgagacagagtcacactctgtcatccaggctggggtgcagtggcacgatctcggctcactgcaacctccacctcctgggttcaagtgattctggtgcctcagcctcccaggtagctggctttacaggtgtgcaccaccacacctggctaattttttatttttagtagagacagggtttcactatgttggccaggctagtctcgaactcctggcctcaagtgaatccactggcctcagcctcccaaagtgcaggggtaacaggcattagtcactgtgtccagcctattattttaattttcaaagctattataacaaaaacagatgaaattaagtaaatttatacttaaaaactgaccaccataaaacattaattatttttagctttccacattccctttcaatccttatatccaggaattagcatttgcattgacaagtatggtggaaactataacatatggaaaaaagtttattccttttgatactacctcataaaaattttgttgatttaattagtatatattaatgtttttattttttctttccttcactgtctatgcaattgaaaatgtgcataaactcaattttttcttagtattttatcttataaaaattataatgaataattacttattcattacttactgaggtctgattgttgcaaacattgcatctcagtgtgtgtgaacgaaagtatagaagtgcttttccctggatagttagaggcataatagcatccttcttttctcttttattattcaagtaaaattaaagcacaattagtagaagcttggagtgcagtttatgctgctataatgaggtctctaagacaccagggcttggagcaagggcttttttttttctagaaacatttcttacattatatatattttattatttatttatttatttatttttactttaagttctgggatacatgtgctgaatgggcaggtctgttacataggaatacatgtgccacggtgctttgctgaacctatcagcccttcatctagggtttaaaccccccatgcattaggtatttgttctaatgctctccctccccttgccccccacaccccaacaggcccgggtgtgtgatgttcccctccctgtgcccatgtgttctcattgttcaacttccacttatgagtgggaacatgcagtgtgtggttttctgttcctgtgttagtttgctgagaatgatggtttccagcttcatccatgtccctgcaaagaccataaacttattcttttttatggctgcatagtattccatgatgtatttgtggcacattttctttatccagtctaacattgatgggcagttgagttggttccaagtctttgctattgtgaatagtgctgcaataaaaatgcaagtgcatgtgtctttatagtagaacgatttataatcctttgggtatatacccagtaatgggattgctgggtcaagtggtatttctagttctagatccttgaggaattgccacactgtcttcctcaatggttgaactagtttatactcccaccaacagtgtaaaagcgttcctatttctccacatcctctccagcatctgttgtttcctgatttttaatgatcaccattctaactggcatgagatggtatctcattgtggttttgattttcatttctctaatgactggtgatgattagcttttttttcttatgttttttggctgcataaatgtcttcttttgagaagtgtctgttcatatccttcacccactttttgatggggttgtttttttcttgtaaatttgtttaagttctttgtagattctggatattagctctttgtcagatggatagattgcaaaatttttctcccattctgtagattgcctgttcactctgatgatagttccttttgccatgcagaagccctttagtttaatttgatcccatttgtcaattttggcttctgttgcaattgcttttggtgttttagtcaagaagtctttgcccatgcctatgtcctgaatggtattgcccaagttttcttctagggtttttatggttttaggtcctacatttaaatctttaatccaacttgagttaatttttgtataaggtgtaaggaaggggtccagtttcagttttctgcatatggctagccagttttcctaacatcatttattaaatagtgaatcatttccccattgcttgcttttctcaggtttgtcaaagatcagatggttgtagctgtgtggtgtcatttctgaggcctctgttctgttccattggtctatatatctgttttggtagcagtaccatgctgttttggttactgtagccttgtagtatagtttgaagtcaggtagcgtgatgcctccagctttgttctttttgcttaggattgtcttggctatatgggcacttttttgtttccatatgaaatttaaagaagctttttttctaattatgtgaagaaagacaatggtagcttgatgggaatagcattgaatctataaattactttgggcagtatggccattttcacaatattgattcttcctatccatgagcatggagtgtttttccatttgtttgtgtcctcttttatttccttgagcagtggtttttagtttccttgaagaggtgctttacgtcccttgtaagttgtattcctaggtattttattctctttgtattgtgaatacaaagagaataaaacacaatttgcaattgtgaatgggagtccactcatgatttggctctctttgtctgttattggtgtagaggaatgcttgtgaattttgcacattgattttgtatcctgagactttgctgaagttgcttattaggttaaggagtttttgggctgagacgatgtgattttctaaacatacaatcacgtcatctgcaaacagagacaatgtgactttttctcttcctatttgaataccctttatttctttctcttgcctgattgccctggtcagaactcccaatactatgttgaataggagtggagagagagggcatacttttcttgtgctggttttcaaagggaatgcttccaacttttgcccattcagtatgatgttgactgtaggtttgccataaatagctcttattattttgagataggtttgatcagtacctagtttattgagtgttcttagcatgaaggggtgttaaattttatcgaaggccttttctgcatctattgagatattcatgtggtttttgtcattggttctttctgtttaatagattacgtttattgatttgtgtatgttgaaccagtcttgcatcccagggatggagccgacttgatcgtggtggatatgctttttaatgtgctgctggatttggttttccagtgttttattgaggatgttcgcattgatgttcatcagggatattggcctgaaattttctatttttgttttgtctctggcaagttttcatatcagggtgatgctggcctcataaaatgagttagggaggagtccctattcttctattgtttggaatagtttgagaaggaatggtaccagctcctctttgtatctctggtagaattcagctgtgaatccatctagtcatgggctttttttggttggtaggctaattaattactgcttcagtttcagaacttgttattggtccattcagggattcaacttcttcctggtttagtcttggaaggtgtgtgtgtccaggaatttatccatttcttctagattttctagtttatttgtgtagaaatgtttatagtattctctgatggtagtttgtatttctgtggaatcagtggtagtctcccctctattattttttagtgtgtctatttgattcttctgtctttcttcattattagtctggctagtggtctatctgttttgttaatcttttcaaaaaaaccagctcctggatttattgattttttgaagggtttttcatgtctctatctccttcagttctgctctgatcttagttatttcttgtcttctgctagcttttgaatttgtttgctgttgcttctctagttttttaaattgtgatgttagggtattgattttagatctttcccgctttcttctgtttgcatttagtgctataaatttccctctaaacactgctttagctgtgtcccagaggttctggtttgttgtgtctttgttctcattggtttcaaagaacatctttatttctgcctacattttattatttacccagtagtcattcaggagcaggttgttcagtttccatgtagttttgcggttttgagtgagtttcttaatcctgagttctaatttgatttgcactgtggtctgagagactttttgttatgatttctgttcttttgcatttgctgaggagtgttttacttccaaatatgtggttgattttaggataagtgctatttcgtgctgagaagaatatatattttgttgatttggggtggagagatctgtagatgtttatttggtccacttggtccagagctgagttcaagtcctgaatatccttgttaatcttctgtctcgttgatctgtctaatattgacagtggggtgttaaaatctcccactattgttgtgttggagtctgagtctctttttaggtctctaaagacttgctttatgaatctgggtgctcctgtattcggtgcatatatatttaggatagttagctcttcttgttgcattaatccctttaccgttatgtaatggccttctttgtctcttttgatctttgttggtttaaagtctgttttatcagattgcaccacctgctcttttttgctttccatttgcttcgtaaatcttcctccatccctttattttgagtgtatgtgtgtctctgcatgtgagatgggtctcctgaatacagcacactgatggatcttgaatctttatccaatttgccagtctgtgtcttttaattgggccatttagcccatttacatttaagtttaatattgttatgtgtgaatttgatcctgtccttatgatgctagctggttattttgctcattagttgagcagtttcttcatagtgtcaatggactttacattttggtttgtttttgcagtgggtggtactggtttttcctttgtatatttagtgcttccttcaggagttcttgtaaggcaggcctcatggtgacaaaatccctcagtatttccttctctgtaaaggattttatttctccttcacttatgaagcttagtttagctagatatgaaattctgggttgaaaattcttgtctttaagaatgttgaatattggcccccactctcttctggcttgtagggtttctgcagagagatccgccattagtctgatgggcttccctttgtgggtaacccaacctttctttctggttgtccttaacattttttccttcatttcaacgtcggtgaatctgatgattatgtgtcttggggttgctcttctcaggagtatctttgtgatgttctctgtactttctgaattacaatgttggcctgtcttgccaggttggggaaattctcctggataatatcctgaagtgtgttttccaacttgattccattctccccgtcactttcaggtacaccaatcaaatgtaggtttgatctttgttcacatagtcccatatttcttggaggctttgtttgttccttttcatttttttttctctaacattgtcttcatgctttatttcattaagttgatcttctatgtctgacatcctttcttctgcccgatcaatttggctattgatacttgtgtatgcttcacgaagttttcgtgctatgtttttcagctccatcaggtcatttatgtttttctctaatctagttattctagttagcaattcctgtaaccttttttcaaggttcttagcttccttgcattggcttggaacatgctcctttagatcggaagagtttattacccaccttctgaagcccacctctgtcaatttgacatactcattttccgtccagttttgttcccttgctggcgaggagttgtgatcttttggaggagaagaggcattctggtatttggaattttcagcctttttgagctgctttttcttcatctttgtggatttatctacctttggtctttgctcttggtgacctttgtatggagtttttgcgtggttgtcctttttgttgatgttgacgctattgctttctgtttgttagttttccttctaacaaccaggcccgtattctgcaggtctgctggagtttgctggggatccactccagattctgtttgcatgtgtattaccagtggagactgcagaacagcaaagattgctgcctactccttcctctggaagctttgtcccagcagggcacctgccagatgccagctggagctctcttgtatgaggtgtctgtcgatccctgttgggaggtgtttccttgtcaggaggcatgagggtcagcgacccacttgaggaggccatctttcccttagcagtgcttgagcactgtgctgggagatctgctgctctcttcagagccaacaggtaggcaggaatgtttaagtccgttgaagctgcacccacagcctttccttctgtaagcccctgactggggctgctgcctttctttcagagatgccctgcacagagaggagaaatatagagaggcagtctggccacagtggctttgtggtgttggagtgggctcagtccagcccaaattcccctgcggctttgtttacactgtgaggggaaaactgcctactcaagcctcagtaatggcagatgccccttcccccaccaagctcgaatgtcccaggtcgacttcagactgctgtgctggcagcaagaatttcaagccagaggatcttagcttgctgggctccatggtggtgggacccactgagcaagaccacttggctccctggcttcagccccttttccaggggagtaaacagttctttctcattggtgttccaggcaccactgaggtatgaaaaaaactcctgcagctagcttggtgtctgctcaaatggccactcagttttgtgcttgaaacccagttttatgcttgaaacccagggcccttgtggtgtaggcacccaaaggaatctcctggtctgtgggttgcaaagaccgtgggaaaagtgtagtgtctgggctggatagcactgtccctcaaggtatggtccttcatggcttcccttggctaagggagggagttccccaatcccttgcacttcctgtgtgaggtgatgccccaccctgcttctgttcaccctctgtgggctacactcactgtctaaccagtcccaatgagatgaactgggtacctcagttggaaatgcagaaatcacccgccttctctattggtcttgctgggagctgcagactggagctgttcctattcagctttgttctttttgcttaggattgtcttggctaaacaggctcttttttggttccatatggaatttaaagtagttttttctagttctgcgaagaaagtcggggagcttgatggaaatagcattgaatctataaattactttgggcagtatttccatttttatgatattgcttcttcctatccttgaacatggaatatttttccatttgtttgtttcctctcttatttccttgagcagtggtttttaattctccttgaagaggtccttcacttcccttgtaagttgcattcctaggtattttattctctttgtagcaattgtaaatgggagttcactcatgatttggctctctgcttgtctattattggtgtacaggaatgcttgggttttggataccttaagtgtaagagcaccatcaggtgtataaagaagaagggaaggtagtacactgagttcaatttatgaatgaccgtggatccttgatttcttttctctttgtgcttggcaggaaaacgagaatggcagtggttctgaagaagtgtgctacactgtcattaatcacatcccccatcagagatcctccctgagctccaatgatgatggctatgagaacattgactccctcacaaggaaagtgagacagtttagagaaaggtcagagacagaatatgcccttcttaggacttctgttagtaggccttgttcctgcacccatgagcatgattatgaagttgtgtttccacactaaaatcctcaagctgctttatcaccttccagcaatgaagacaatgcagaatagcagactctggcgaagttgttcaccctgagcagtgcatgaaacattcctttctggctaaagtttagaaatattatcttattatatatccttaggcaactctgatatgtggcatctctgtggcttaggtgaaatcatagaaattgacacaatgacctaaaatattctatgtgtttttgcttgtaaagtttgaggacatggaggtgataaaaaaaactttcttaggacaataatgtaaaatgaaaataaatttctaatccccctgactaactgaatggaccctcttctaggccaaagagacctcagatgaacctgaaagactgaattctggccatgataggaagggaggtgagacacaccttgttataccccttcccttttggagtttatgcacaagtgaccaggatgagtcataagactgatgaaatagactgattgtggcaataagagtcccaattccaacctgactctggtgtagatcacacactgtctgagggattccatctatgagactttgtctacataacagagaccttggtttccacaacccctttattttagctaaagcattcttttctactgacttcttaagtctttagacaaagcttaactctttcaaccaattgccaatcagacaaactttgaatctacctatgacctgtaagctctctcctgcttcaagatcttgcctctttaagctgaaccgatgtgcactttccatttaatgatttatgtctttgcttgtaactcctgtctccctaaaatgtataaaagtaaacggtgacctgaccacctcaggcacactttctcaggacctcctgagagtgtatcccaggccatggtaagtcatgttggctcagaatcaacctctttaaatattttacagaatttgggttttggttaccaataagtctccacaaatatatgtccaagaatcttcaattccaagcctgctcaccaaatttcaaatgccaacatctccccatccaattacctatttcatctttgaggtgtaatctactcaataaactgtgtaagaccagtgaccagaccctttgctaacctgacatttacttcaatttttctttttctatgtactggatatttttgcatataaacttgcagtaatagttcaaaaattaatagtttttgacattggcttttctgagaagagaaattgaaagtgtcacaaaataaaaaaagatgaaatgaagcatatataattgtcaattttttcaattttctagccaacagagaatcgaaggattctgttcaaatattagtaaaaattgaaaataaacttgtgcttatattttgtttgcaacacactagttaatttaacctgtgactagttatctctaccgaaggtggatgtgtagtttctggttttaaaattcaagcaaactggaaaataatccatctaattatgctttctttcccaagaagttttttaatgatatgccagcttcctaatttggagacaaaagccttaattgacaatgcattcattatatatttttttgtatagttacagtatacgagttgagtatcccttagatgagatgcttgggaccagaagtgttttggatttcagatttatttttggattttggaatatttccatacatataatgagagagttggaaaatgggattcaagtctaatcataaaattcacttatgtttgatatacaccttatctgaatagcctgaaggtaattttatacaatattttaaataattttatgcctgaaacagagtttgcgcacattggaccatcagaaagcagaagtgtcactatttcaagtcagtgctcaaaaagtttcagatgttaagctggtgatgcagttcatgccagtgatccgagtactttgggaagccaagacaggtggatctcttgagcccaggagtttgaggccagactgcacaacacagtgagacctcgtttctacaaataattaaaaaattagccaggtgtggtggtgcacacctgtagtcccaggtactcaggaggctgaggtagtaggattgtttgagactgggaggttgaggctgaactgagccaggatcttgccaccacattccagcttgggcaacagagtgagaccctgtctcaaaaaaaaaaaaagtttcagattttggagcatttcagatcttcagattagggattttcaacctgtactgaccttttagtcattgacaagcattaatcaataggtggactccagataactcatttgctgtatacacattttgcctctctattcaacgaattcttatgccctcttgtggtgattttaatgtgcggaagggaaacaatagaaattttgcaattctagaaaagtcattctgtcaaaatatgtcagtcctgtagatattagccaattttaggaaaatgacaaaattttttacttttcgtctgcctttgtagctgttttatgatataaataccttatttgtaataaaattaattttaatttgagtaacaatctggaattatcagagaaggggcaagcaataggttaataaacagtattgattggtagaaggaacgttgaaatccaagagcatcaatgtcttctggtggttcaccataagccacagcagatgtcttaatctttccgagatctagtttttcagcaaagcaggatttaagaaatgtaactatcttatgtggttatgaagaacaatagaatcattgctgtataagtgctttttaacctgtaaattttgtgaagcttatcttttatgcatataaatatttgaacattttacattgtttatatttttaatcagttttactcaagtgtgattatatacaagaaaatgtaaccactgtaagggtagagttataagaattttgtcaaatgtattcacccatgtagtcacctccttatgaagagacagaacacgtacatcctcccagaaagttccacagtgctccttttccctgagtttcaccagtcctggcaaccaatgatctgcttcgtataattataactgttctagatatttgtagcaatgtaccctttccatatttattttgtgtgtgtaaggcttcttttagtcattataatatttttgagattcatctatgtttaatgttctatcagtagttgtacatcttacttgtctcagcatatcaccatatagatatactataatttgttaatctaatcactgatggatatgtaggatatttaagtttttgacattatgaataaagtggctataaatgaataaagcgactacaaatttgaatatctaggtgtgttagtttactggtgctaccataacaaaggaccacagagtgagtggcttaaataataaacatttattttctcacaattctgaaggttagaagtccaaggtcaaggtgttggcagagcgggtcttttaagggaaaaagcctaaaaactttgagttggtttctctatgggaaaatcttttcaatgcatctctcctagcttctgggggtatgctgacaatctctggcatttccacatttattgataaaatggatacatgccaagggatgagaaatacatgtgacaataatcaggggtcttctacctcagtggaatttctagggtcaagtggtgtaaagcatgttgagatttccttctgtgatgaagaataaattgttgtacctcgtttcctttatgcccagaaaagcagcataatgtctagtggcccctttggatcttggcagcagcgtattcttcatttgggtgtgttactctagctcattgactaagaaacttgctagctttgagtggggactcagaataagagcaggctctgcaacaggtccaggctgctgtgcaagctgttttgctacttgggccgtaggatccagcagctctaatggttcttgaggtgtcagtggcagacagggattctgtttagggccaggccctttgccagggccctctaggtgaatcacagcgaagactcttagaattttggagcaaagccctgccatttcttcagacacctaagcttcttttgaaaactgcattgggcttgctcctgggccttattaaagattgaatgcttaaccatgggccaccaagttaccatgtgacctgagctgcccctcataaaggggatgtagtctgacctgttaagctataaaacggggtatgtgcagagcacttcattgtaaaattgaaagcatacatatgagatcaggctcaagcaggtcctgaaaacactagtaaattacataaagaagtgacccaaatgtccgtggtccccactcatgctacactaccttacactgatggcctcatggtgagtttcctatggtcaatcaacaggccctacagaaaccttgggcctggttcatagacggttttgcacaatattcgggcactgccaaaaaatgaacagctgcagcaccacggccctttctgggacatccatgaataatagtggtgaagagaaatcctccctcagagtggaacttcaaatagtacatctggttccttgctttgcctggaaacagaaatggccaaatgtgtgatttttttttatcaattcatgggctgtggccagtggtttggtggatggtgagagacttggaatgaatatggttggacaattggtgacaaggaggtctggggaagaattatgtggatggacctctcttaggctaaaaacctgaagatattgtgttatgtgagtgctcaccaaagagtgacgtcagcagagaaactaatagtcaacagtgtgtggatatcagtcagcctctttccccagccaccccgtcatcacacagtgggctcctgaacaggtatggtggcagggatggagattatgcataatttccattcttcaaggctgacctgactacggtcactgctgattgcccaatctgccagcagcagagacaaacattgagcccctgatatggcagcattccccagggcgatcagacagctaccaggtggcaggtggattacactggaacacttctgtcacggaaggtagttcttactgaaatagacactctggatgtgaatttgccttctctgcacattacggttctgcaaaagtaccgtctgtggactcacagagtgccttatccaccacgatgttattttacacagctttgcttctggttaaggaactcacttcacagaaaacagagtgtgccaatgagttcatgctcatgaattatgaattcactggccttaccatgttccccatgatcctgaagcagctggcttgtaagaatagtggaatagcctttggaagactcagtagcagtatcagtttggtggtaaaaccttgaaggattgagacaggttctctataatgctatataggctttgaatcaatgtccaatatatggtgtttccaacatagtgaggattcatgggtccaggaaccaaaggatggaaatgggatttgcatcattcattattactcttagtgatccactgacaaacaatttttgtcctcacgatcttaagctctgcttgcctagaggtcttggttccagagggaagaatgcttaggtcaggagacaaaacaacgtttctgttaaactggaaattgagacggccacctggccactttgagctctttgttcctctggatcaaaaggtaaaaagggaaattactatagtggttggggtaattgatactgaccaaaaaggacaaattggactgctactccaatactccacacagtactgtcatgctctgtgattaaagtcaggggacaactacaacaacccaattcagacaggactattaatggcccagacccttcaggaataaaggtctgggttgacccaccaggtaaagaactacaaccaagatgcttgcaaaggcaaaggaacatagaatataaaagaaggcagctacaaccatgcgactagttacagaaatgaggactgtattgttatatttcttctttgttttgttgtgaatatgtttgtataaatgcatgtatgtatagacatatataaacatttatatgtatgttacataattattttatgtattacatatacatatatgcatatatatacacacagtaagcaaatatctttgatttctttcctcttttatcctcttatgatgtaagataagatgtattacttttacatcacagtatgtaagttataggatatcaaagagaaaatagcacttgtcagtttccttatttgaagattcagtatggtttgaggagttgtgtatgagtgtcaaggatgaactataagagttaattttatgtgtcaacttttctaggctatagtacccagctaggtcaaacatgagtctagatgttgctgtgaaagtatattttagatgtgattagcatttaaatctgtagaccttgagtaaagcagattaatctccttcataaaatatgtgggcctcatccaaactgttgaagacattaaacaaagcaattatcagccaagaattttgtatccagtgaaactaagcatcataaatgaaggaaagatgcaatttttttccagacaaacagatgctgagagaatttgcactacaagaactgctaaaaggaaatctaaatcttgacacaaatcctcaaaatataccaaaatagaacctccttaaaacataaatgtcacaggatctataaaactacaacacaatggaagaaaaaggtattcaggcaacagatagcacaacacatagaatagtacctcatatctcaatactaacattgaatgtaaatggcctaaatgctccacttaaaagatacagaatggtagaatggataagaattcaccaaccaagtttctgctgtcttcaggagactcatctaacacataaaaacccacataaacttaaggtaaaggagtggaaaaagatatttcacacaaatgtataccaaaagcaagcaggagtagctattcttatatcatacaaattttaaagcaacataatgaaaccctgtctctaccaaaaataaaaaaaaaattagctgggtgtggtggtgggcacctgtaatcccagctacttgggaggctgaggcagaagaataacttgaacccaggaggcggaggttgcagtgagccaagattgtgccattaccctccagccttggcaacagagtgagactctgtcaaaaaaaaaaaaaaaaaaaaaaaagaaaaggcaaagaaggacattatataatgataaaaggacttgtccaacaggaaaatttcacaattctaaatatatatggccctaacagtggaactcccaaatttataaaacaattactagacctaagaaatgagatacatggcaacacaataatagtgagggaccttaatactccactgacagcactagacagatcatcaggatagaaagtcaacaaagaagcaatggacttaaactataccctacaacaaatggagttaacagatatttgcagaacattctacccaacaactgtagaatatgcattctattcatcagcacatggaacattctccaagacatacagtgtgataggccacgaaacaagcctcagcaaatttaagaaattcaaaattatgtcaagtattctcttagaccacagtggaataaagctggaatttaactgtggggaaaagagagatcagattgttactgtgtctatgtagaaaagcaagacataagaaactccattttgatctgtactaagaaaaattgttctgctttgagatgctgttaatctgtaactttagccccaaccctgtgctcacagaaacatatgctgttttgaatcaaggtttaatggatttagggctgtgcgggatgtgccttgttaacaatatgtttgcaggcagtatgcctggtaaaagtcatcgccattctccgttcttgattaaccagggacacaatgcactgtggaaagccacagggacctctgcccaaaaaagcctgggtattgtccaagatttccccccagtgagacagcgtgagatatggccttttaggaaaggaaagaccttacagcccccagacccacacctgtgaagggtctgtgctgaggaggagtagtgaaagagggaggcctctgtgtggttgagacaagaggaaggtttctatctcctgctcatccctgggaatggaatgtcttggtgtaaagccgaccatttgttctattctgagataggagaaactgccctgtggctggaggcgagatatgctggcagcaatactgctctgttactctttgctacactgaaatatttatgtaaagtgaaacataaatctagcctacgtgcacatccagacacagtacctttccttgaacttattcatgttacagattgctttgttcacatgtttccctgctgaacttctccccaccatcaccctgttgccctgccacactccgttcaccaagatagtaaaaatagtgatcaataaatactgagggaactgagagaccagtgccggtgcaggtcctcgtacattgagtgccggtcccctgggctcactgttctttctctatattttgtctctgtgtcttatctcttttctcagtctcttgtctccacctgatgagaaatacccacagatgtggaggggcagacctccttcattaactccaaaaggagctctcaaaaccatgcaaatatataaaaattaaataacctgctcctgaatgatcattgggtcaacaacaccgtcaagacggaaatttaaaaaattctttgaactgaatgataatagtgacacaacctatcaaaacctctgggacagagcaaaagtggttctaagaggaaagttcagagcattaaatgcctacatcaaaaagtctgagagagcacatatagataatctaagtcacacctcacagaactggagaaacaaaaacaatccaaactcaaactcagcagaataaaagaaaatagaagatgagagcagaactaaataaaattgaaacaaaaaaagaaaaatacaaaagataaatgagacaaaaatctggttctttgaaaagataaataaaatcgatagaccattagtaagattaaccaagaaaagaagagaaaagatccaatttagttcaattagaaatgaaatgggagatactacaactgataccacagaaatacaaaagacttttcaaggctactatgagcatctttactcatataaactagaaaacctagaggagatgggtaaattcctggaaatatacaacctcccagattaaaccaggaagaaatagaatcttggaacagaccagtaacaagcagcaagattgaaatggtaatttaaaaattgtcgaaaaaaaaagtccaagaccagacgaattcacagctgaattctatcacacattcaaagaattggtaccaatcctattgacactattccacaagatagagaaagagggaatcctccctaaatcattctatgaagccagtatcaccctaatagtaaaaccaggcaaggacataacaaaaaaagaaaactacagaccaatattcctgatgaacatagatgcaaaaatcctgaaaaaaaaaaaaactaacaaaccaaattcaacaacatgtcaaaaagataatccaccacgatcaagtgggtttcataccagggaagcaggaatggtttaacatatgtaagtcagtaaatgtgatatgccacataaacagaattaaaaacaaaaatcacacgattatctcgatagacacagaaaaagcatttgacaaaatccagcatccttttatgattaaaacccccagcaaaattggcctagaagggacatagcttagttgtctaaaaattgcttgccttttcatatttttgacctatttgtatttcttccttttctttttttctatatctgtcacatatatatttacaatacaggtttttatttgtctcttactgatattttaaaatgccatggttattaaatctttgctttttgtcttataaatatttcccacattttaaaatttgtgtttaatatttgaaatacagttgaaaatttgctttcgtaggggaggagaagttatttttatctacctttcttaggtttactggtggggctgactccggtaacaaaagaaaaattcacaagagaaacatgaacaagtttattaaaatgtatactgcagtatacacgagagatgctcagtatacacgagagatgtatacacgagagatgtatacacgagagatgctcagggaatgagtaattcccaaagaggtaacctaggcctccagcttatggagcagcttcaaagaagaatggtaaatttttagaggataacaagacaaaggaaaaggacaagacaaaggaaaaggacaagacaaaggaaaaggacaagacaaaggaaaagtttctggggacagcaaattgtgggaaggctaataaatggcagataaaagctagttgggaggggttgtttcatagattcctctgatgccatctcctggctgttaatttttgtctttcttggtgtggggaggaggacacaattgtcttttgtacatctatctcctgcttttaggcaaattgaggaaaggcaggtaacgttttctttatctgcctcctcccagttgcactcagttcaaaacaatttttatgttaaagagatatatttttgtaagcaatgagaaaaggactccctattttataaatggtgctgggatagctgactagccatgtgtagaagaataaaactggactcctacatttcaccatacacaagaaattaactcaagatgaattatttacatggaagatgccaaactgtaagaatcctacaagaaaacctagggaatattattctggacatcagccttgggaaggaattgatgactcagtcctccaaagcaattgcaacaaaaccaaaaattacctaattaaattaaagagcttctgtaaagcaaaaggaacaatcaacagagaaaacagacaacctacaaaatgggagaaaatgttcacaaactatgcatctgacaaaggtctaatatacagaatccataagaaatttaactcaaaaagcaaaaaacaaataaccccatataaaaatgggcaaacgacatgagcagacacttctcaaaagaaaacacacaagtagccaacgaatgtgaaaaaatgctcatcatcactaatcatcagagaaatgcaaatcaaaatcacagtgaaataccagaatggctattattaaaaagtaaaaaaaaaaacaaaaaaaccagatgctggcaaggctgtggagaaaacagaatgctgttggtgggaatgtcaattggttctgccactgtgaaaagcaggttagagatttctcaaagaacttaaacagagctaccatttgacccagcaatcccattgctgggtatatatccagaggaaaagaaatcattctaccaaaaagatacatgcactcatatattcattgcagcactattcaccatagcaaagaaatggaatggtagactgaataaagaaactgtggttcctatatgccatggaatactatgcagccataaaaaataatgaagtcgtgttcctttgcagcaagatggatgcaactgggggcctttaattaatgcaggcacagaaaactaaacactgcatgttcttacttataagtgggagctaaacaatatgtacacatgaacataaagatgggaacaacagatgcagggactgctagagggcagagaaagggagaagggaaaggactgaaaaagtaactgctgggtactatgctgtgtctgggtgacaggatcaatcatacaccaaacctcagcatcatgcaatatacccaggtaagaaacctgcacatgtacaccctgaaactaaaattaatgtttaaactatttttaaaaagagacttctttttggatggcatattttggttttttccactttcagtttctttttaaaaaacatgttttaatttttatgcaattggtcctaacagtttttgatttacacaatttgttgcctgcttgggacataacattttagtacatccatatgttcattgtagattcaatctttaatcaataaaattgtcctgttttgtcagttttgttgttatctcaaaattaaattatattgaatttttctaatttaatttttaaaaatgttttcttttctttctttaattgactgtattgtttgtttcaaacaggctgtataaatttgagtttagtttttttttaccctagcctatgacatgcctttttctattaattggagcactcatcccttaagtgattgatgtatttatttcactcatatttataatcatctatgagcaatcattgtgtgcctatactgacatgatttgtcttaattctttaactttattttcattattttactatttattcctttatttgttacttgaatttacttttttttaagagatagggtcttactctgttgcccaggctgaaatgcagtggcatgatcatagctcactgcaacctcgaactcctgtgaagcgacacttctgcctcagtctcttgagtagctgggactacaggtgcgtgggaccatgaccagccaatttttaaattttttttggagagtcagtgtcttgctatgttgcaagggctggtctcaaactcctggcctcaagctgtcctcccaccttggcctcccaagtcgctgggatttcttttattatttaagtgccattgttgttctttcttctttgcccttttcttcataaactattttcttttagccttttagggatccagtatttgagaagtaatttaggctgcacattagttctttttttttttttatcactgttagtaactgatggagtgacatatttaatacccatttttaaaattttgattcctttccaatgtacacaaataggtcttgtgattattaaaacctttttctttttttaattattattatactttaagttttagggtacatgtgcacaatgtgcaggttcgttacatttgtatacatgtgtcatgttggtgtgctgcacccattaactcgtcacttagcgttaggtatatctcctaatgctatccctcccccgtccccccaccccacaacagtccccggtgtgtgatgttccccttcctgtgtccatgtgttctcattgttcaattcccacctatgagtgggaatatgcggtgtttggttttttgtccttgagatagtttgctgagaatgatgatttccagcttcatccacgtccctacaaaggacatgaactcatccttttttatggctgcatagtattccatggtgtctatgtgccacattttcttaatccagtctaacattgttggacatttgggttggttccaagtctttgctattgtgaatagtgccccaataaacatacgtgtgcatgtgtctttatagcagcatgatttataatcctttgggtatataccctgtaatgggatggctgggtcagatggtatttctagttctagatccctgaggaatcgccacaccaacttccacaatggttgaactagtttacagtcccaccaacagtgtaaaagtgttcctatttctccacatcctttccagcacctgttgtttcctgactttcaatgatcgccattctaactggtgtgagatggtatctcgagactccctttttctgtaacttgaaatacattaatataaaaggggaaatttattttaaaggaagggtcaaatttatttcctgcaaaagatgatgatgtttcctaatgtctgctcttgctcttctctgcttcggaaagcattgaagaacagctaagatatttgaaggatgtgtattgcatttatttataatgcacatattcggaaaataaatagatctaagtcactggatgtaaagacatagcttctaagcatttaacatacaatacttttttgggtaggcaggtgacattgtcactcatttaaccctatgtgatgtgttatctttctcagctatgcctcagccttggggaacacactttacatatggggatggtgagacataccaatgagagcaacctagcaggtttcatccttttagggttttctgattatcctcagttacagaaggttctatttgtgctcatattgattctgtatttactaactattttggggaataccaccatcattctggtttctcgtctggaacccaagcttcatatgccgatgtatttcttcctttctcatctctccttcctgtaccgctgcttcaccagcagtgttattccccagctcctggtaaacctgtgggaacccatgaaaactatcgcctatggtggctgtttggttcacctttacaactcccatgccctgggatccactgagtgcgtcctcccggctgtgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcatttcatctgcgaggtccctgtgctcatcaagctggcttgtgtgggcaccacgtttaacgaggctgagctttttgtggctagtatccttttccttatagtgcctgtctcattcatcctggtctcctctggctacattgcccacgcagtgttgaggattaagtcagctaccaggagacagaaagcattcgggacctgcttctcccacctgacagtggtcaccatcttttatggaaccatcatcttcatgtatctgcagccagccaagagtagatccagggaccagggcaagtttgtttctctcttctacactgtggtaacccgcatgcttaaccctcttatttataccttgaggatcaaggaggtgaaaggggcattaaagaaagttctagcaaaggctctgggagtaaatattttatgattattaaaaaaaaatttaagtgacactgtgatgaattttttttttggtaaaaagtagcatcttttaataagaggattttttatgggctcttctcacattttcttttgattaaatatttgtacgacattttgcattatgtaaaatactatggaatatatgtctacatacatacatgaaacatatgtctataaagtcgcaacttggccattacccagtagcagtataaggtgagtcctttagtcaatctatgcttcagtgcctttgctgcagaatatatcatttgtgtagtacatttgaaactacttttaaataaatactttactggattaagataggcatgaacatattcaagaaatgtttatgtcagccagcttttttttttggttgctaataacgcattaatctctgagccttcctgtagatggacacatagcttattcccttccaagaatgtagctgagatgcatgcgtgttgatcaagctgtaatgaggcaaatttttaaattgcaccctatatgccatcctcttaacatgtggaagagatgtgtagacatgcaaatacaacacaaagacaaagggcacactttaaaggtgatgtggaaagtagatgaaagcccagttctctggttgtgtagttgcatcaagaaatagtttgaactgcctaacactggagtctcagtctacagaaaaaacacagctgtaaaattttctatggctcacatggatacacaaataataacacattgttattatatctgcatttctgtatatgaaacattttcataattttgagatatatcttccagataaaaccttaaccaaattgtttaaattatttgcactaaaatactgaacttcatttcccatggcttcactctaaatggcccataccattctttttctggaaataaggaatttttgcattttgagtctagaaaacgttgtgtgaactcatggtattatacttcctatttcactgcattatagcaggcattgggttgtatactctgtagtaggaaactatgtcctctgttcaaacttacatcaaaataaataaatgaattcagtgagatgaggaaggatattgtagaagggtcttttaagtccaaatgtggtgatcattttaaatatagtattaaacgttagagaatgagttgttgtttataactcttcagaagcagaggcataattagtaagataatgcactgtatgtcttctgtcctttgagtgtctatcctttcagtgtccctcagttgtttatttaccagtttgttacatttttgatgtgcaagtactgaatatcacatgcagtgctagttgctaagtatagggagaaaactagaaataaacggtatatacccaccctgaactcattgctgttagaaaagatgaacctaaaaaacaaaaatacaaaaattagctgggcatggtgacacgtgcctgtaatgccagctattcgggaggctgaggcaggagaatcgcttgaactcgggaggcggagtttgcagtgagctgaaatcgcgccactgcactccagcctggcaacagagtaacactccgtctcaaaaacaaaacaaacaaacaaacaaaccccccaaaacaaaacaaaacaaactgcaaggtaaccatgaaaatgaaactggaataaggtctatgaaaaaaatagtgtgttatgcaattgattatcaaggagctaactgaaggcttcctgggaaagtggcatttaatttgccacctcagtaaagctaagaagcaaccctggaggactaaaggggagaggatgggtaaggaaaggaaagagtttcctgtagaagactttgcctaaggcaatgctgtcaagatatcagctggagctttatcttgaccttccaaatctggttaatatggttctgtatccaaccaattatagtgcctgctgttttccaaactctcccaaacttcccaaaattttctgagggcttttatttttagagtaactatgatcttttgctctttataaaactctcatgagtttagaacactttaaataagattatgttttaagcagagataacacagatgtgacagagcatgcactgaaagcatttgaatcttccttatcgttcttttttctttatgctggcccttcaatccctttccaggaacaccacattcttctccaatattagaagcaacaatctctcttcctgcaatattttgacaccaacaagtaccctgactttgaaaaatccaatttgtaagctgacaaacttcaaaaatatgcttacaaacataggcagatttctcttgagtactaccaaatggtactatggtactatggtactttgtcaagtgacaaagttcctccttatgttgccaaaataaaaataatgctctatcattgtttgctgtggatttttagtaaattatgcctaatgcttttaaactatattggataaaatatttgtagagtaagtaggatctgtagctataaaaattttatattggaacttcactttctaatcaatgatactttttcaaaagaagacttgcataaagtgggatttctatttatgtttattttgtcacctttcatggagacatatacttcatacattaataagtttgcttatcaaatgtaaattaagcttgccctgggaactgggatcggaatattggaatcgtagattatagtgcaacaaggatgcaattaaacaggcactaacaataaaatgagttaagacttgggttaggaaaggaacagtgatggtgaagtacatgcaatataagaatatcccccatttttggagatgaaaatttttttttctttttttaaaaattttactttaagttctgggataggtgtacagaacatgcaggtttgttacataggtatacatgtgccatggtggtttgctgcacgcatcaacccgtcagctaggttttaagcttcacatgcattaggtatttgtcttaatgctctccctcccctttcccccaatcccctgacaggccctggtgtatgatgttcccctcctagagtccatgtgttctcactgttcaactcccacttaagagtgagaacatgtggtgttcggttttctgttcctgtgttagtttgctgaggatgatggtttccagcttcatccatgtcaaaggacatgaactcatccttttttattgctgcatagtattccatggtgtatatgtgcgacattctctttatccagtgtttcattgatgggcatttgggttggttccaagtctttgctattgtaaatagtgctgcaatagacatatatgtgcatgtgtctttatagtagaatgatttataatcatttgggtatatatccagtaatgggattgctgggtcgagtggtatttctggttctagatccttgaggaattgccacactgtcttccacaatggttgaagtaatttacactcccaccaacagtgcaaaagcattcctatttcttcacatcctctccagcatctgctgtttcctttttttttttttatttttgagacagagtcttgctgtgtcgcccagcatgtagtgcagtggtgcgatcttggctcactgcaatctccacctcccgggttcacgccattctcctgcctcagcctcccaagtagctgggactacaggcacctgccaccacgcctggctaatgtttcgtatttttagtagagatggggtttcaccgtgttagccaggatggtcttgatctcccgacctcatgatctgcctgacttggcctcccaaagtgctgggattacaggcatgagctaccacacctggcctgtttcctgactttttaatgattgtcattctaactggcatgagatggtgtctcatcgtggttttgatttgcatttctctaacgaccagtgatgatgaactttttttcctatgtttgttggctgcataaatgtcttcttttgatggggttgtttgtttttttcttgtaaatttaagttctttgtagattctgggtattagacctttgtcagatggatagattgcaaaaattttctcccattctgtaggttgcctgttcactctgatgatagtttcctttgctgtacagaagctctttagtttaattagattccatttgtcaattttggcttttcttgcaattgcttttggtgttttagttatgaagtctttgcccatgcctatgtcctgaatggtattgcctaggttttattctagggtttttatggttttaggttttaggtttaactctttaatccatcttgagttaatctttgtataagatgtaaggaaggggtccagtttctgttttctgcatatggttaagccaattttcccagcaccatttattaaatagggaatcctttactcattgtttgtttttgtcaggtttgtcgaagatcagatggttgtagatgtgtggtgttaattctgaagcctctgttctttttcactggtctatatatctgttttggtaccagtaccatgctgttttggtaactgtagccttgtagtatagttggaagtcaagtagcatgatgcctccagctttgttcttttggcttaggattgtgttggctatatgaactcttgtttggttccatatgaaatttaacatagtttttttctaattctgtaaagaagtcaatggtagcctgatgggaatagcattgaatttataaattactttggatagtatggccgttttcacaatattgattgtttctgtacatgagtatgaaatttttttccatttctttgtgtcctctctgatttccttgagcagtggtttgtagttctccttgaagaagtccttcatgtcccttggaaattgtattcctaggtatttcattctctttgtatcaattttgaatgggagttcactcatgatgtggctctctgcctgtctattgttggtgtataagaatgcttgtgatttttacacattgattttgtatcctgagactttgctgaagttgcttatcagcttaaggagtttttgggctgagatgatggggttttctaaatatacaatcatgtcatctgcaaatgtagacagtttaacttcctctcttcgtatttgaatatcccttattttcttatcttgcctgataaccctgaccagaacctccaataccatgctgaataggagtggtgaggggggcatccttgtcttgtgccagttttctaggtgaatgtttccagcttttgcccattcagtatgatattggctatggatttgtcataaatagctcttattagtttgagatatgttccatcaatgccgagtttattgagagtttttagcatgaagtggtgttgagttttatcaaagtccttttctgcatctactgagataatcatgtggtttttgtcattggttctgtttatgtgataaattatgtttattgatttgcatatgttgaaccagtcttggatcccagggatgaagccgacttggttgtggtggataagctttgtgatgtgctgctgtatttggtttgccagcattttattggggatttttgcatcaatgttcatcagggatattggcctgaaattttctttttatgttgtgtctctgtcagattttagtaccaggatgatgctggcctcataaaatgaattagggaggagtctctctttttctgtggtttggaatagtttcagcaggaatggtactggctcctctttgtacctctggtagaattcagctgtgaatctgtctggtcctgggctttttatggttggtaggctattaattactatctcaatttcagaactcattattggtctattcaggaattcgacttctccctggtttagtcctgggaaggtgtatgtgtccaggaatttttccatttttaaaaaattttctagtttatttgcatagaggtgtttatactattctctggtggtagtttgtatttctgtgggatcagtggtgatatcacctttatcattttttattatgtcatattacctaacttcaaactatactataaggctacagtaaccaaaatggcatggtactggtacataaacagacacataggccagtgggacagaatagagaacctagaaataaattcacgaacctgcaactatctgatcttcaacaaaatcaataaaaataagcagtgggaaaaggactccctagtcaataaatggtgctggtataactggctaaccacatgcagaagaaggaaactgtacccctacgtttcaccacatacaaaaattaaatcaagattaaagacttaaatgtaagttcaaactatagaaatcctagaaaaaaccctaaagaacaccattctgtacatcagtcttggcaaagaatttatcactaagttcccaagagcaattgcaacaaaacaaaacatttacaagctgaacctaactatactaaagagcttctgaacagcaaaaaaaaaaaaaaaaaaaaaaaattaccaacagggtgaacagacaatctacagagtgagagaaaatattcacaaactgtgcatttgacaaaggtcttatatccagaatctacaaggaacttaaatcaacaagcaaaccacccccccaaaaaaatccaattagaaatgggcaaaggacatgaacagacatgtctcaaaagaagacatatgagcagccaataaacatgaaaatgtggtcaacattactaattatcagagaaatgtaaatcaaaaccacagtgaggtaccatcttataccagtcagaatactgattattaaaaagtcaaaaaacagcagatgctggtgaggctgtggagaaaagggaacgcttatacactgttagtgggaatgcaaactagttcagccacttcgaaagcagtttggagatttctcaaagaacttaaaatagagccactatttgacccagcaattccactcctgggtatatacccaaaggaagataattcattctatccaaaagacacatgcacctgtatgttgcaacgctatttatactagcaaagacatggaatcaacctaggtgctcaagcagaggattggataaagaaaatgtggtagacatgtgatatacaatgaaatactaggtagttacaaaaaataataaaaatgtgtactttacagcaacatagttggagctagaggccattatcctaagtgagctaatgcaagaacagaaaaccaaagattgcatgttctcacttataagtgggagctaaacactgaatacacatgaggtaggaattgaacaatgagaacacatggacacaggaaggggaacatcacactctggggactgttgtggggtggggggaggggggagggatagcattgggagatatacttaatgctagatgacgagttagagggtgcagcgcaccagcatggcacatgtatacatatgtaactaacctgcacattgtgcacatgtaccctaaaacttaaagtgtaataataataataaataaataaataaataaagttaggaacaatggatactggggaccaacagatgtggagggaggaagtgggctattggctgaagaaccacctgttgtatatcatgctcacttcctgggatggaatcactgggaccccaagccttagtgtcatgcattttacacgtcatgccttttacccatgtaacaaacctgtacttgttccctttaatgtatgataaaagttgaaatgattagttattagaatggtgagttttttgttgtgtatattttatcactttatattttattttacatatatgcttatatacatataatttaataaatattttaccactacatatacttttttttttttgatatggagtctccctctgtcacccaggctggagtgcaatggcacaatcttggctcactgcaagctccgcctcccgggttcacgccattctgctgcctcagcctccagagtagctggaactacaggcgcctgccaccacgccccgctaatttttttgtattttttagtaaagacaggtttccatgttagccaggatgctctcaatctcctgacctcatgatccacccactttggcctccaagagtgttgggattacaggcgtgagccaccgcgtccggcctacatatacgttttaaaaattaaaaacaggctatgaattcagaggggaaagagttcaggaaggaagtctaaaaaatacagtgattatacaagaggttgaacatatgaaaaactaacaatttcaatatgtcaaataacctcccaagtgactgtagtacaaagatcaccagactcagaagaatagttttgaatttcagtcctaactcttttatacctagtagataaagttattgacagttacatcaaagatgggcctaaatttctagcttgcataattggataatagtgacattattcacttttacagcaaacaaaatggagagagcaagggtttagatttgaacacagtgcatttgaggtgtctcacctagtggagatggtagtttcaaaataggatacatgaatctagtcctcagtagagaaatctacacataattaacatagcaataagcatatagtttccgataagagaaaatttaatttgttagaagatcagtcccgctggactgggactgatgaatccaaccattaagggcttaagagagtaagaagagattgcaaaagagacagttattctaggcatttgttatgatagctttaatataaagtatctcagttctaagagaatgatgctcaaggttagaaatccaaagtacgggcaaagagattctctttaaaggggatgacgaagatcttctctatggtaactagagtgaaggaggagggacacagaagacttaagtgggttttcttttcgctctttcacgttggacaagtttgatggcttctatttcctatgtgaagtacgaggtgccagaataatactgaagaaaggaatacttcacactggggaaatatgtgtattattgttccttgatgatccaaagaagctagtcagttcctccactaattgcctactggggatgcaggtttttcccagaagacgtggtaaaaacaaatcatggcaattttgtaaatttgcaaaattcactgtttctgcttccctttttctccaagttttcattgccactaacataatttcctcaggataaactcaggcgagaaatataaatcttgaacagattgttttttgaagccagttgtcttgtgggtcaacagcaggctggacacaaaataacaaagctaagaaaatgttatatgacttgcatcctgaagatgtgaaaaacaccgacacctttaaatattcctgagtgtaagtaagaattcaatctggtgtaatctaaattgaatgcaatcatttcttaaagaagttcataaaagttaataggtagaaactttattgctttcattactgttggatttgctgtatcgttaaagtaataatgttgcgtgacacaggtaaactatctggacttctgctttcatttatcgaatataaagatagggcaatttcttgttagtcttcgtaagtacaagttagtatcatgcaattaattagtataattagcattttggggataaattttacttatagaaacaacttagttgatagatttagcacacactcaattccacaaaaacacaactataacacaagtggaacactcaattcgaggtaatttcagccttctgtaaaaaaatcactcaagagaagtactgcagaggaagcttcctcaagtagtgcaccactgctaacctttgaaattgtaagctcttcgccagctgaaacagagggatagttgaattacaatttaaccaaaatgattgagggtttaaattattgggttggatttcattgagtagaaataaaatgttttccagaggaccactgtttctcgactctattaacactgctgtaatttctgtgtttccttctcatgaagtaattgtattttagtaaaatttgatggttagcaagaatatgtatgggtagaggacacttacttaaacagactgagtgctttactgatcaggtgggcaacttccaatctggtcttaaaacacgtgaacagacactaggaaatctgtagccattggtctcatattttcaccaactggtcaagtaactatggaagaccagagcatctggaagatggactagaccagaaacgcatcggtcttaagttggattctccagattgagagaggacacgattatgatttttcagtcgtctgtcttaaagctttattcaggcagatggttagaataatgaacaagggctgagtggcatggcagcacacaggtatttaaggggttggcttgtggttaaaaacctgttttggggggaattgcaaggacttggcatgcaatggtgcttggtgaaagctgaggtaaatcagcacagatgtgagctcatatcgctgttgagggttccatgaacaaaaggctcctgcagttttatggatccagggaccatgagaaagggtaagggctagatgtggaaaagtacggataggggaaagctgcctccccacctcagtgttcggcacagccagcgcgttgaagactctggagggagttgcagtcaagggttcgctctgacctctctggcttgtcatgttcttttgcataatcacatttatatcttaagcgtctttattccttgctcatctttattccttgcactttgtctggtgctgtaggcagagccttcttgtaaggcaggagaaggggagaaacttaaagacaactttcctatctttgactcagtattcagtactttaccacatgtagccctttccctttctcacgctccctggtttggggatccataaaattgcaggggcctttcgttcatggaaccctcgacagtgacatgaccttcgcatctgtgctgatttaccttcaccaagcaccactgcatgagaggtgaggtagcgggatgggaagggattaggaggagctgatgcttcttccagtgttatacactggaatgcattatcatagtcagtgattagaggcttcacggtaactttcattttggttccttgctgctttagggtcctctgacaccttatagctcagctctctccccaggtcagctgatccaccaatattaaccacttcttttcccagtatcttccgtccaggaagattcaacagagtctgactgggaaataggacacatgaaaaatgcattcatttcttcatcaagcatttattgacacattagtatgcatttgatatcatataaattccataaagtatcagtagaacatgacccctcagtttaagaagtaggttatggtttagtagatacatacggtcataaaacattaggtcagtatggtattggagttttttattgtagaggtaagtttagggtacggaatgaacacaaaataagcctcaccaaggttgggtggagggatgtatgagagaggagtgctaatcagagtcaaagaggactttgtatgttcgtgagaaatactgagtcttaaaagtgtgtagataactgcctggtgaagggggttggagaagattatcattgtcatgggaagcagcataagaaaagccatagctccattatgcttagcaaactaacgcaggagcagaaaaccaaataccacatgtcatcacttataagtgggaggtaaatgatgagaacacatggacacatagaggggaacaacacacactggggcctcccagagagtggagggtgaaaggagggaaaggaacaggaaaaatataactaattagtactaggcttgatacctgggtgacaaaataatattacaacaaagccccataacaaaagttcacctatgtaacaaacctgcacatgtatgcctgaaattaaaaggtaaacacacacacacacacacacacacacacacacacacacacacacggcatagctgaatgtaagggctcagcttgctttctgccatcttctctaaatgtgtttgtgatcattctcttctctatacttgtactaatatgtatatttttctatttattatttattttgccatacttaatgtaaagattctcaattatagggagaatataaattagaaatgtctaaaatggtaaaaaaaaaaagtgtctgagtttagcacaaactaacatttctacaggcattctgcaaacattccatctggctctggtgcgaggaaagaacccacagctggctctgaagggaatgtaaatatgcacattagacacaatcaccttactcaaatgttatgctaacattttacaacaagcaggaagaataaccttggctgatgagattctgaaacacattttgatttgggagtcttggtaagttatacaacaattagtgagaataggaattgtcctgtgatttcacgtatccctactttcctcattctgaaagaaaagcacgaaatcatcttatatcctcagtttacctccctttccatttaaaagtcagtattaggttaattttgtcattttcattccattaattttcttcccattgactttcattcagttaatgttgtcattttggtaattctcaggctattcacatgacacgaacctagttaatatcatgagaactattgaactatccctacctgaactccctcacatcaatatcttccctacccatcttcctatcaatgcaccaatatttccaaaatggaaacagaaaatattactctcttgtgtgctcagagcctttaacaacatcttactgcctgcacagcaaagctaagaactttatttcacccagtgatttctacagtttgactccaagtattttattttctaagcataccttcagcactcacctttttgaatcttttttaaaaaaaaactatacttaaataaaacagtatttatcgtgttgtacatgataaatatatacaattttaatttgtcagttaaaaataaatgaataaagaaataaaaacaaagtaagtaaagaaataagaacaaaacaaacaaaaaactgttttaaaatttcaatagctttgagggtacaagttttgaggattataaatcatgctactataaagacacatgcacacgtatgtttattgtggcactactcacacttggaaccaacccaaatgtccatcaacaatagactggataaaaaaattgtggcacatatacaccatagaatactaagcagctataaaaaaggatgagttcatgtcctttgcagggacatggatgaagctggaaaccatcattctcagcaaactatcacaaggtcagaaaaccaaacaccgcatgttctcactcataagtgggaattgaacaatgagaacacatggacacagagaagggaacatcacacacaggggcctgttgtgggatgggggactgggggagggatagcgttaggagaaatacctaatgtaaatgacgagttgataggtgcagcaaaccaacatggcacatgtatacctatgtaacaaacctgcactttgtgcacatgtaccctagaacttaaagaataataaaaaaatccataataatagtggtattatgtgatcagcttttgattaaatactgactcattcattccatagtattcactgagcccagctgtgggtcaggccctttgataggtcctgaggacacagcagtaactttagctggctgaagtggtggaaagacagttggagtggccacaggtaactccatttacccttttgcacaagaaaattaaatacacgtgtcctaggtgccaaaggtgcttatggagtcaagtatatgagctgcctttagggaaatattaagcctaactctgggttgggctttatccagccccataaacttaaaattgagtaatttggggcacgtattttaaacatttttcatctgtagaattagaacactactacctacctcatattttggagcatattatgtgaaaaaggcccagaaaaaaactatatttttttaaaaaacagtatttatcttgttgtacatgatcattatatacaattttaatttgtcgattaaaaataaatgaataagtaaagaaataaaaacaaaacaaacaaaaaactatattttaaaatttcaatagctttgagggtacaagtagtttttggttacctggatgaactgcctagtggtgaagtctgagattttagcgcacctatcacctgagtagtgtacactgcacctaatatgtagttttttaaatcccctactcccctcccactctctcaccttttcagttcccaatgtccattataccactgtgtgtgcctgtgcatacccatagcttagctcccacctgtaagtgagcacatacaatatttgccatttctgagttacttcacttagaatagtgacctccagctccatccaagttgctgagaggcattatttcatttttttcatggtttagtagtattccatgatgtataacccatttactttatcctctcatcggtttatgggcacttaggttggttacagatccttgcaattgtgaattgagctgcgataaacatacacatgtgcatgtctttttgatataatgacttcttttcctttgggtagatacccagtagtgggattgctggattgaattttagatctacttttgtttttttgaaaaatctccatactgttttctatagaggttatactaatttacattcccaccagcagtggataagcattccctttttaccacatccacgccaacatctattgttttttgactttataatagtggccattctggctggggtagggtagaatctcattgtggttttaatttgcatttccctgattattagtgatgttaaacatttaaaaaatttgtttgttggtcatttgtatatcttcttttgagaaatgtctattcatgtcatttgcccactttttgataggattatttgttttttcttgctgatttgcttgagttccttgtagattctggatattagtcctttgtcagatgcataatttgcaaaatatttctttttgaatcttcttacaaagacaagtgaatcattcacacattctcttccgacattctccagatgactttgagttttcttcaacagtctcataaattactttcatttttgtttataatttgttttgtgtttttgacattttgaaagttaaggaattttatttatttttatttttattttttgagatggaatctcactcactttgtctcccaggctggagtgcagtggtgcgatcttgactcactgcaaccgtccacctcccaggttcaagcaattctcctgtctcggcctcctgagtagctgggactacaggtgtacaccaccacacttggctaatttttgtattttattacagatggggtttcaccaagttggtcaggctggtctcgaactcctgacctcaagtgatccacgtgactcagcctgtcaaagtgctgggattaaaggggtgagccacagcatctggccaaaacgttagggagttttaatatatttatctcagggttccttcaaacaaattttatatttataagaatactgcaatgcatctttaactcttataattatatatattcctttgagtatatgtatttttcttcactagtaaggactattagccaacttggttaaataatgcctaaataaataaaaaattttaaaactaatttttattttttggcagttcaatcattgaataaacttttatgagatgatttgaatttatatcatatattttggttccttaaatatgtcttttcattttccaccagttagtaccaatgtgacacatatcaaaaatgattttctatctccttcataccaatcatacccattttaaaggttttaaagtctttgttttaattagttttatctaaaaagtcttccccatctgattgtgcttacaatcaaatctgagtaaggtatttcatatgcagataatttattgacagttgaaaatcagggagatactgttcaccgtattttgagagaaatttatttttagtggtaggtcattgtggattttttgatatgcatgtaaatatgcactttgattggctttaataatcaatccccagacaactccaaagttgtaatcattcataatttttaaagatgagcctttgaactggaatgaagaaacatggattgatgttccaagtcagcagcacattagtgaaaaatgaatagtttagggtgaaaaatgaatagtttgggaaagttggtctccatgatcctctcagctcatgtgttctgttattctaaatttaattgttttggatgtacccattccattcctgccttaggtgcggatccccctggagggatgggattgggcaatgagagttccctaatggatttcatccttctaggcttctcagaccaccctcgtctggaggctgttctctttgtatttgtccttttcttctacctcctgacccttgtgggaaacttcaccataatcatcatctcatatctggatccccctcttcataccccaatgtacttttttctcagcaacctctctttactggacatctgcttcactactagccttgctcctcagaccttagttaacttgcaaagaccaaagaagacgatcacttacggtggttgtgtggcgcaactctatatttctctggcactgggctccactgaatgtatcctcttggctgacatggccttggatcggtacattgctgtctgcaaacccctccactatgtagtcatcatgaacccacggctttgccaacagctggcatctatctcctggctcagtggtttggctagttccctaatccatgcaacttttaccttgcaattgcctctctgtggcaaccataggctggaccattttatttgcgaagtaccagctcttctcaagttggcttgtgtggacaccactgtcaatgaattggtgctttttgttgttagtgttctgtttgttgtcattccaccagcactcatctccatctcctatggcttcataactcaagctgtgctgaggatcaaatcagtagaggcaaggcacaaagccttcagcacctgctcctcccaccttacagtggtgattatattctatggcaccataatctacgtgtacctgcaacctagtgacagctatgcccaggaccaagggaagtttatctccctcttctacaccatggtgacccccactttaaatcctatcatctatactttaaggaacaaggatatgaaagaggctctgaggaaacttctctcgggaaaattgtgattcctatggacatgatttgcaaggaattcattataagccaggtagcttattcagcttctatttagtcaaacccatagttctaaatttcacatgaactatattactgctcacttattttctcttcataagggactttttccttttttatgtgtaactaagtaaaatgtttatatgtttatttgagagcataaactattgaaaagagagctgtggatggttgtaaattgtgatcctcaccacaaagcctctattttatgtctgatacttattcccagggattcagaaaaataaattattaagtatttaccatgtatttatctaggttaggagacttttcttcagttttaataaaatgttcagtttcctgccaaacactttacatttacatcgtaatgtccttcattatagctttatgttgaaaataagcaattcctgcatgtgctcgtagttcaaatttattggtcagtaggatattgcataagctatttttaaataaccgttccaaatacattttaagaatttataaggggtaacaagaacaaaatacgctaaacacattatttttcataacttagagtgtgcatctctttttgtgttctgaggccactttatccttgtgcaggagccatgctcatcttctctgtattatttcaatgttagtatatgagttgcagaagtgagaactgaggtcactttatacatggtaggtacaagacttttgaaagaataaaataatcaaataattttcttctataccttttcatacattcaatcaatgagaataattggacttcaaaagacattattattttctttttttaaaaatacagcttcattgaggtataattgatatacatatttaatgtataaaatttgaggagtatgggctaggcgcggtggctcacacctgtaatcccagcactttgggaggctgaggcgggcggatcacgaggtcaggagatcgagaccatcctgactaacacggtgaaaccccgtctctactaaaaaaaaaataaaaaaaaattagctgggcttggtggcaggtgcctgtagtcccagctactcgggaggctgagacagaagaatggcgtgaacccgggatgcagagctttcagtaagccaagatcgcgcactgcactccagcctgggcgacagagcgagactctgtctcaaaaaaaaaaaaaaaaaaagaaaaaaaaagaaaaaaaatttgatgagtatgatatatacatacacccttgaaaatatcaccacaaagtaatacacataaccattacatctagaagtttccttgtgcttcttatttgtgcttgttataacacaacatatgatcaacacttttaacaaatttttcagtgcacaatactgcactgtaaactataagcactatgctttataatagatctcttataacttattcatcttgcataaatgaaactttgtacttattgaacaaaaactccccatgttcttgtctctcatcccctagtaaccatcattctattctctacttctatgatggtaactattttaaatatttaatataagtgaaaccacacactacttgcccttctctgactagcttttttatttagcataatgtcctccaggttcattcatattgttgcaaaggggtcaattcagcaagagtatataacaattgtaaacatatatgtacctgacattgaagcacacagattatataaagcaactattattagagttaaagagagagataggtaggctccaatacaacaatagctggagacttcaacaccccactttcagcattggacagatattccagacagaaaatcaacaaacaaacattggacttaatctgcactacagaccaaatgtacctaatagacatttacagaacatttcatccaagagctgcagaatacacatgcttttcctcagcacatggatcattctcaaggatagaccatatgttaggtcacaaaacaagtcttaaaacaccccaaaaattgaaataatatcaagcatcttctctgaccacagtggaatgaaactagaaattaataacaagaggaattttggaaactataaaaacacatggaaattaaataatatgctcctgaatgaccagtggatcaatgaagaaattaagatggaaattgaaaagtttcttgaaataaatgataatgaaaacacaacatatcaaaacctatgggatacagcaaaaccagtactaagaggaaagtttatatccataaaagcctacatcaaaaaagaggaaaactttcaaataaacaatctaatgatgcattttgaagaactagaaaagcaagagcaaaccaaacctaaaatctgtagaagaaaagaaataaaaagatcagagcagaaataaatgaaattgaaattaaaaaggtcaataaaagaaagttggttttttgaaaagttagacaaaatttatgaaactttagccagactgagaaaaaaaggagaatgtctgaataaacaaaatcagaataaaaagagacattataattgatgctgcagaaattcaaaggttcattagtggctacaatgagcaactatatgctattaaattggaaaatctagaagaaatgaacaaatttctagacacctaaacaacctaccaagattgaaccctaaggaaattcaaaacctgaacaagccaataaccagtaacgaggtcaaagctgtaataaacagtctcccagtgtagaaaagctttaggacccagtggcttcattgctgaattctaccaaacatttaaagaaggactaacagcaatcctactcaaactattccaacaaatagaggaggagggagtacttccaaacttattccatgaggccagtattacactgataccaaaaccagacaaagacacatcagaaaaggaacaccacaggccaatatctcttatgttattgatgcaaaagtcctaacaaaattctagcaaacaaaattcaacaatacattagaaagaaagattattaatcatgaccaagtggggtttatccaagggatgcaaggatggttcagcatatgcaaataaatcactgtgatatatcgtatcagtagaatgaagaacaaaaacccatgtgatcacttcaaatgatgctgaataaacatttgataaaattcaataatccttcatggtaagagccctcaaaaaactgggtatagcaccatggaatactatgtagccataaaaaagaaggacttcatgtcctttgcagggacaagggggaagctggaagccatcattctcagcaaactaacacaggaacagaaaaccaaacaccacatgttctcactcataagtgggagttgagcaatgagaacacatgaacacagggaggggaacatcacacaacggggcctgtcggaggcatggagggtaaggggaaggagagcattaagacaaatacataatgcatgtggggcttaaaacctagatgatgggttgataggcacagcaaaccaccaggcacatgtatacctatgtaacaaacctgcatgctctgcacatgtatctcagaacttaatgtaaaatttaaaaaaactgggtatagaatgaacatacttcaacataataaaagtcatgcaaaatggacccacagctagtatcatcatgaatggggaaaaactgaaagcctttcttccaagatctggatcacaacacagatgcccaccttccccactgttattcaacatagtagtggaaaacctagctagagcaatcagacaagagaaagaaataaagtgtgtcaaattggaaagggagaagtcaaataattatccttgtttacagaagatatgatctcatatttggaaaaacctaaaggccccaccagaaagctattagaactgataaactcagtaaagttgcagaacacaagagtacaaaataagtagcattctacatgacaacagtgaacaatatggaaaagaaatttttaaaatcccattttatgtgtagtgtcacataaaattaaatacctaggaattaagcttagccaaagaagtgaaaaagctctgtaatgaaaactgtaaaacactaatgaaggcaattaaagaggacaacaaaaagtggaaaaatatttcatgttcatggattggaagaatcgatattgttaaaatgttcttactactcagaggaatctacagattcaaagcaatccctatgaaaataccaatgacattcttcacagaaatagaaaaaaaattataaaacttatatggacccacaaaagacccagaataaccaaagctatattaagcacaaagaataaaactggaggaatcatattacctgacttcaaattatactatagtgctatagtaaccaaaacagcatggtactggcacaaaaactgacacaaaaatcagtggaacagaatagagaacacagaaacaaattcacacatgtacagtgaactcattttcaacaaagatgccaagaacattcactggaaaaagacaatctcttcaataaatggccctgggaaaactggatatctacattcagaaaatgaaactagacccccatctctcatcatatacaaaaatcaaatcataatcaagacttaaatttaagacgtcaaactataaaactactacaagaaaacattgaggaaaatctgtaggacatttgttgggcaaagatttctctagcagtaacatcccacaagcgcaggcaaccaaagcaaatgtggacaaatgggatcacagaaagtcaaaatgcttctgcacagcaaaggatgcaatcaacaaactaaagagacaacccacagaatgggagaaaatatttgcaaactacccactgacaaagggttaataatcagaatacataagaagctcaaacacctctatagggaaaaatttaataatctgatcaaaagatgggcaaaagatttcaatagatatttctcagaagaagacatacaaatggcagacaggtatatgaaaaggtgttcatcagagaaatgcagatcaaacaggcatatgaaaaggtgcttatcagagaaatgcagatcaaaactgcaatgagatatcatctcaccccagttaaaatggctcatatccaaaagtcaggcaataacaaatgttggtgaggatgtggagaaaagggagcctttgtacactgttggtgggagtgtcaattgctacaaccactatgaacaacagtttggagtttcctcaaaaaaacaaaaattgagctacaatatgatccagcaatcctgttgctgagtatatacccaaaagaaagaaaatcagtatatcaaagagatatctgcacacctatgtttgttgcagctgtctacaatagctaagatgtggaagtcacctaaatgtccatcaacagacgaatggattaagaaaatgtggtacatatatataatggagtactattcacccatagaaaagaatgagatcctgtcatttgcaacaacatggatggaactggagatcattatgttaagtaaaataagtaaggcacagaaaggcaaattatagcatgctctcacttaattttagatgtggaatctaaaaaattccagcacatagaagcagagtgcaggattgtggttacctggagctggggactgtggggaatgggcaatggtggtaagaggatataatgcttcagctagacaggaaggataaataataagtatttgaggtgatagatatgttaattagcttgattcaattattccataatgtgtatatatgtgtatactacatatatggtagcaacaattttatattgtatacaattgtaatttgtcattatctgacaaaaataaataaaaatttaaaaaggatagtgttaaactttgcactataacaatagcttaaaacatgaaaaaattatataattgaatgttgataagtcatgtttacattattaaaaagcagtgatgtgcagagaaaataacttctggctcatgtctggtttgcattagatacaagttgaattaacctgtattttccttaccatggaatatccagatttattgggtgaacatggtaaagactgaaaaagttgccttgggataagaagtaaaggataaaataaatcacataaattttgtgtatttctgcaaagtgaaacataatatgaataaaataattggaaacggtgccattttcattttagttgaggagcagacaattctaaagacataattttcaaaactatgatcatgaagctgcttccaaaataaagaaaatagtaaaacttgtggatttgcctaaatcagagtcttagaaatctgtcttttgagaattcagggtgaagacacaagctatgtgtacaaggcacttaaacaaattataccagctttccatttaggagaagaaaactgaaaacccagggccatgatctccatatagatggagaatttacatatttattaagataatcaaattgtggaataaatggcttgcttccagtgattaaaaattatctgcaatattttgaccatattttttacgaattgcagtgaagaattataaaatattatttgaccactctataaatagcatctaaacagatataatctttaatacactataggacatgaataacctcctccaaattagttttccaggatctctaaacagaatatttcaaacttcaggcttatgatttaaaaattttaattcattttgcaactaatgaactggaaataagagtcttcattgtgaagcatctccatatttctaggtttctgatcaatcagaaggacagaactctctggaaaagtcattaatactttttctcatgtccaacaatccatacatttaggtaagagttttctaacttagtaagaaaaatacgcaggtcttatttagcttagcccattcctgtgaagcaagttgtaggtactctggtgaagaaataatatacttctcactgatacaaaagccattactattggagtttcacgatgtaagattgcatgccaaaagcacagatcttgataaagattagacaaaagcaatgtgacatgggggccctgggaaaggagaatgaggagttcaagtgacagtttatagttccaggtaggacagagcaaacacatttcacctggtgggaaaagataaagcagctacctgagaattctaggaaatatacagtagcaggtagatcaaagtccaaaatttgaaatactatcaaacctgtggtaagtttactatttttttcctcttgtcttcaggtgacttaacctatgatgcaggcccaatcatggaagagcatctttatgtaaatccaaaattattctaaaataagaagtttatataaggactttagcatttagaaagatggagttgaagtactgtttctttttcctcctgccaagttcaattaaaatccttggacactgtatataaaacaagcataggaagattctggaaggtgaagggaataaggcagaccagctagggactggcttgttgttttcttcctcctgtataggaaggaggtctagcctaggtcttggaaaatctcacagtccagaaatgctgaagggcacagatctaaagaaaaagcccctataacacccaagtctctccagtcaaaggacacgaaaagggaaggcaggcaagacagaaacttctagacaataccttctccactccagccaaacaccacagaaaagacagagtcctacctctagtcccaccagaaacattaaaatggggagcctgggcatccactcttacctgattttgcctctcccgccccttgatgggctggagtcagcagaagcctgctggagagttatcgttgccacagcccaacgataacaagcccatccactatggtgtcactggaattacgtggaagcagtaacacagcacatttgcccattgcatccacagtgatatcccgcagagagctggaaatcccaccctgccaacagcaatgaggagtcctttctcctcatgtaggagtcaaagaggtggtgtttggagggagcaacaccactttgatattggggtgaagataagatattggggtgagaaataagaggatgtgcaggagtgttattcgcagcaagcaagatcttgaaaggtatattattccccaaacagtacttctccattttgttggcatagcaattcagaagggcactttggaagaggagctgggtcattcgtgacttcttagtgctcctgtagaacacaggcggttcgtgcttgttgatgtgactgaaggccctagagttctcactgtgccagatcacaggggccatcctggcactgagtgggcctgtggcctgtgtccacagggaacaccctgcaggttgggtccatgggtaccagcctggtgcttgtggccacgggggaaactggcctgcagttggtgggcttagagcctgtatctgtagggccagcctggatactgggtctgctggtgttggaatggtgcccaaggccatggtggacggcctggtgctgtggtcttcaggtgccaatctggcactggagtaggcctgaagcctggggttatagggttgggtctggcactgaaacagtctgggtcctgtggtcactggggctgccctagtggtggagcaagtgatggagaacctcaggcaggtctggagtctgtgtctacgggggcttccttggcacaggaatgggcctggaggctgggtgcatgggtgctgacatggtgatttgacgtgttgggttagcctgtttacgaggcaggcctaaagactatggttgtgggagctggcctagtgcagggggatctctggagcccggggcttctgaggctgacctggcagtagagcaagcttggggactgtgtttgcaaggcagcctggagcctggtgatgcaggggctagcatggtgctgggttttactggggtaagcctggtgttggggtctgaggcaaagcttggtgctcactttcctttgcccacacagaggttatctctctccatacattactgcttggcattgggaatgaggcgatgtgggtaagatgacactgtccttcctatcctcttcattgcatgttttaaaatttctgtgctgcaatatctcatctggttttcttagttcttgtgaaggtccttttgggcatgaataattgtttgaactgatgtttctgtgagcagatgagagttggaaagtcctattccaccatcctgccagtgccatttgtagaaataatttcttcaacaacaaaagaaaaaaccaaaacaaaaaaattttaaaagtggagaattctgtaatctcagaactttgggagttcgaggtggggcggatcacctgaggtcgggagtttgagacaagcctgatcaacatggagaaaccccatctctactaaaaatacaaaattagcctggcgtggtggcgggcacctgtagtcccagctactcgggaagctgaggcaggagaatggcgtgaacccgggaggagcttgcaagtgagtggagatcatgccactgcactccagcctgggcgacagagagagactccgtctcaaaaaaaaaaaaaaaaaaggtggagaattaatagaaaaacaacattgaaattagtaagttctatttgtcaaaacactataaagagaaatataaaactacaaacttgaaaaatatctacaactaatttcatcaataaagacttagtatccataatgaaaaataattcctgcatactaataaaaataaactcaattttaaatgaggaaatatttgaatagcattccacaaaagaagcaatccagtgaccactcaatccatgtaggcgtgaggaatgacatgaaatgagacagaggattggagcattcaagcatatgggccaagtcaagaaattttacctttaataccaaagaaatgcagagaaaggtcttaagacaagggtgacaggttagttttgtttttttgttgttgttatttcattttgttttttttttgagacaggatcttgctctgttgttgagagtggagtgcagtggtgtgactatggctcacctccatctccctggctcaatagatcctcccacctcagcctcccgagtagctgggactacaggtacatgcccctgtgcccagtgagatggtcttaaactcctgggctcaagctatctgtctgcctcagccccacaaagtgctaggattacaagcatgagccaggatgcccagctggattagctttgtgtttaaaatttgccattcatatacaaaattgacttgggatagaaagggctatgaaaaggcacaaatatacctatttgggaagaatattaggataaaaatattaagaatgaaaatctagttccagaatctctggttgggtttatacctattgtccaagcataagtatcgatcgtttcttctttcactctcagcacaagcgctctatctaatcgagcctctgggcgtgtggaaggttatattatgcaattaattcgcattcttttatcccacatcacagaaaagaatatttctccttgttgctagtcactgaattaatcaaagctctgcttttctttttgctcgccaaggacatatttacaagaaatcttgtctccagagacctccgaattataaagagtttctctcattaggatctcacttattaatcaccatttcattacaaatattgaatcacagctaaatggaaaccagatgtggcactcatcaagtttatatttttgaatcagggagaagataaagacatttgcagttgcaacttggaggctacagccacattgttagattagggcatttttcaattttatctgatatgttcaggtaaaccaaggctccttctcaaagaaacagaagtttgaaattttgaatgactggagttgctcaatggcccagttcaacaaaaatcagctcatagcatgcagtaagttcaataccataagtggaaaataaaaccataaataatgttatattatttttcaattaatagattgcactgatatatttccataccatcttcttatctgatttatagattaagcacaacacattttagaatacacagttatttctttttttggggtgatagcagttctggatctgggcatgagcaatgcacatccatgaaagcaggtaaaagaaaagagggagtagtataatacgagttttgatgtgtggtgaattggatgagtctatatttcctttcagtggtgaaaggtgtgtgtgtgtgtgtgcgtgtgtgtgtgtgtgtagtctcgatgtatggtgggattggatgagtctatatttcttttcagtggtgaaagttctgtatgtgtgtgtgttcaatgaaaaggatgtgcacatttaaacatgtttgcattgactgaattttaaaaaattcataataaaagagtcaattccaatgcctgtcaatgcataatagttctcactttagagtccttgatatttctcttcctgattagtgtcaccacatcattcctttaaacattttgataaaagagatatcaattaatggtgccctggtaaactgtaatcagaatagattcccaagatgaagttggttcttttacttggtcacaagaagcatttttctttctatttggttgtacctgtccctttaacaaccagctatttaggcgatcaatgtcagaaaactagaacaaatagaaacacattttccagtagagagacattcagttgactccattttggttttctttctcggtttaacttttgatttacccaagaaagaccaggaaatcagtgattgcctagagtgaaaactgccagaagaagagattatatacaaagaaggataaggaatattttggatatgatgaaaatagtctgccctggttgtggtggtggtttcataggcatatacaactgcgaaaactcctagaattgcatactttaaattgatacagtttaccctacataaattccagctacattatttgatatgggtgaaaatccatttcagagtttggcttaaacactatagaagtctgggaatgaggactcccattttactggactagaccaatccaaagcaaaattaaaaaaaaataaagtgagtcgcagatgctaggaaagatcattgtagaaattgctcaatatttttaggtgtcttgaatacataattgatattctttttctttgaatctcaacattgaagacagattctgaagaccagcaaaaagactagactgatgtaaatacacatttcctagctaatccatacccatatcctaagcatacgataaatacttctgtacctctgccttttcctatgtggctttcttcaaaaatatcagtctaaaaatcattcagtaaaatagttctcaaaacctagctcagacactgttctctgcaactcttctataacaacacaaaataagaccaatctcttttctcgatacatccactattaccctttctcaacatgcctgctattgtttataataccagattccacttagtattttacctccctacgttctctatttgattgtttaagttttgaattcaagaactgtttcttatgaaatcttttactataagagccaaccattgtgctttttacgtgaggtgtttaccaaatgtctcctgatacttttttgaaaggctgtgactataacctcactaaatagttatgacataaggagcctttttttcagattactaataccactttgattttattttcataaaactgaaaagaactatgacaaaccacttgcaatgctgttctttaacacataatgagcaaataaaatgcttcaaaataaatatgtatattcagttgatgggaataatactcattttttgtccaagtatgcacactttattcttttgttaatactatatattttctttgttgattatgtcagtgaggttattcattctccctttttattttgcattttggttgtcgtcttttatacacctcacatactatgatgtatttattgagaatatgctttgtataaagcactattctgtgtaattgagatttagggttagaacgatagtatccatgctgcatatgagtaaccttataattaattatcacaaattgaaatatcactgggggtagccatatttgatatttctataatccattttttttctctctttaggaagaaatggaacgaccacaagtgattttaaccaaactgaagttgctgaatttttcctcatgggattttcgaattcctgggatattcagattgtacatgctgctctattcttcctagtttacctggcagctgtcataggaaatctcctaatcatcatacttaccactctggatgttcacctccaaaccccaatgtatttctttttgagaaacttgtctttcttagatttttgttacatctctgtcacaattccaaaatctattgttagttccttgactcatgatacttccatttctttctttgggtgtgctctgcaagccttctttttcatggacttggcaactacggaggtagccatccttacagtgatgtcctatgaccgctatatggccatctgccggcctttacattatgaggtcatcataaaccaaggtgtctgtctgaggatgatggccatgtcgtggctcagtggggtgatctgtggattcatgcatgtgatagcaacattctcattaccattctgtgggcgcaatagaatacgtcaatttttctgtaatattccacagctcctaagcctcttagaccccaaagtaattaccattgagattggagtcatggtttttggtacaagtcttgtgataatctcctttgttgtaattactctctcctacatgtacattttttctgtcatcatgaggattccttctaaggagggtagatcaaaaacattttctacctgcattccacatcttgtggttgtaacactctttatgatatctggcagcattgcctatgtgaagccaatttcaaattctccccccgttctggatgttttcctgtctgcgttctacacagtcgtgcccccgaccctgaaccccgtcatctatagtctgaggaatagggacatgaaggcagccctgagaaggcagtgtggtccctgagaaggcagtgtggtatgctagatgaagaatttgattacggaccagactcttgaactcttgctctaatcaggcaatttgtaaactctctgggtttatattttcaattgattgctgagctctttcttgatttttaaattaaattcagctatagtttaccatactaaccatatttgggtgaattcaaccttagaatgcactaaaaggtacttcggggtgttcaaaacattagaacttgtgcttttattcatttttatgagttgtagatctcaaaattttataaattatattgtactcagtaatacaacatattaattaatataaaagtgaattactaatataaatgaattactaccgtatgtgtatattaattacagcagaacaagatcatatggattaaaaacaaccaaatggaaaataaacataaggtaacagtgtgtgctcagaatttcttcagcattataaaggatggtcaaataggctagagaccagtgttctgggagcatatctattgggtgagatgaaatatatgcaataatatcacaaactataaaggttcacatatgtttatggtgctgtgtataggaaggttcacagaggagaaatgtcattttcattaaacacaatattatgttaagctaactaaaatcttcttccatttttcctctgcataggaaagtatgaactgaaagttattatgcattattcccagagtgcttttatgtgtattctatctatataaatattcatctataaaatgcatagcatcattttataaattaatacttaaactataatataaatagcatcctaccttagttatcctttttaaagtcctttaaattgtatttttagttgacaaataaaaataattatatatgcctatggggtaaaagtgatgttttaatacatgtttgcaatgtggaatgattaaatcaggcaatgtaatatatcacctgaaacatttgtcattcatttgtggtgacattgtttaaaatcctcttttaactgttttgaaacacacaatacattggtatgaactagattaatcttgctgtgcaatagatcaccagagcttatccttcctgtctaactggaactctgtgctctccgaccaacatttcccctttaccagtctaccatcacccttgcctccatcttctggtcagcaccattctactctgtatttttatgagtttgactttttcagattccacatataagtgagatcctgtggtatttgtctctctgtgactggcttatttcacgtaacatgatgtcttctctaggttcatccatattgtcaccaatgacagaatttcatgttttttttcaaggctgaatagtattccattgtgtgtgtatactacattttaaaaatccatttgtccatggtggacacttagattgattccatatttcggctattgtaatgccgcaatgcacatggaaatacagacatgcctttgacctactgattccagttctttggatagatgcaagcgtacctcattgtattgcacttcatttgctgaatttcacaaatattgcattttttataaatcaaaggtttttggtaactttgcattgggcaagtctattggcaccatttttctgacagcgtgtgctcacttcacgtctgtgtgtcaccttttagtgattctcacaatatttcaaactttttcattattgttatgtctgttttggtgatctgtgatcagtgatgttcaatgttactattgtatttgtttcggggagccatgaactgttctcatataagatgataaacttaataagtgtgtgtgttctgactctccgttgactggctgtgtctccatctttttttcctctccttaggccttgcaatttccttagacacaacaatatgaaaattaggtcgatcaataatcctacaaggcctctgaattttcaagtgaaaggaagagttgcccgtctctcactttaaatcgaaagctagaaactattaagcttagggaggaaggtatagtcactcaaattatgaaaaaatgcaacatctaaaggaaaacattgataatgataactattaaatgtaaggctttattctcacccacagtcatcttaaagtggaaaaaatcccaaactacatacccatagaacctaattgccaaaggattggcactctgaatgtgaaaatgacttctttaaatcaggatcagatcaagaacatgtaaaaatatgcattgtacttgaagagtgcattatcctggaagtcatctcacagcagagaaaacataatttgtccagtaacacaggcaagctttctaaaatatttgacagcatcaagtgttggtgggcttaggaacgacttggacacacacactgctgttagtgaacactttgatccatattttgttatttatacagtaatgttaaacatggattgcattcatcatggttcttagttgaaacgtataaaattacaaatagcctattgaggcatatggagtttaaaacgtagactactgccattacatgcacagtctacatgtgagagcttgggctgtacattaccaggaactgaatatattttaaaaaggctctcaaaacaccacaaatggtgatgaaacccaacagctgctgctgtacttgtgggtataagtatatttgagaaaatctctgattttccagaagaatcgaccacttccactccaagcttgcaagaaacccaacattccttcacatatgtgacttcttcccacagaagctccactactagttttcttgatggaaactgggtcatatacaagcagggagatggagatatgaaagaaccagtacaagatatgcttcaaatctatagcttccctgaagactataatacagactggaaagagtttaaaataaggactgagtgagcttacttatagcatctatctcatgcattacatctgtgcctcagcaattccacgtacaggcatacacctcggaaaactctttcatacatgagaaagcatttttaagaatgtttattgaagcactaatttgctttagaaaaaagcagagatataactgaaattaactttcactggagaatatattggtgtaaattaattaaccataacttcagtatttacttttcaagatttaagaaaaccattaaacttggatgaatgcatcttctccatatctgtcaatttccccaccacagttagtgtgtgtgtgtttgtgtgtgcgtacatgtgtgtatctgtgtatacacgtgtgcatgtgtgtttgtgtgttcataagaactagaagacatctttaaaattggaatatataaaagttataaaggccctcatttgagcatttcctgagcttttcacttatcccttagtagaaataccatctcctttaacaagagttattgattctaagaaaaaaagaaatttcgttttgtctactgctgatttatcttgcagatataaaaactggcaaaagtaattcatttatttgtatatcattggtttaatagaaggatagaaggaagtgaactggctagtatctttcatccaaaaatcttgacactggaaaacaatttcctaaatttgtcttgaattttcttcctcagatgaaaaaaccataactgtattagctttacaacttataattactttgtaaatatatttgattattttctgtcgaagtagcacgtgtgtgcgtgcttgggtgtgtgtgtgtgtgcactatgactcagagtcaaagtgaatgtatttatactaaatggatatgttcattcatagatatttattgattgataactgtgcactaagctaatcagggagaaagttaccgtagcagagagaagaaacaattttttccactgatgaaataataaataaaccaattcaaataatgcataatttattgtctggaattgtagttaaatgaagaagcatagagaaaggtaagaggatagagaatgaagtagtattggattccagttttttaaatttttgatttaatttttatttttatgggtatatagtaggtgtatatatatgagatacatgagatatcttgataaaggcatgcaataaatagtaatcacatcagggtaaatggggtatccatgacctgaagcatttatcttttgtgttacaaacaatccagttataatatgttagtagttttaaaatgtatgattaaattatttttgactacagtcattctgttgtgttaacaaacactaagtcctaataattatttctatttttgtacccatcaaccatcactatttcctccccacttcccccaactacccttaccagaccatgcttctactctctagctccaagagtttgattattttaatttttagcttccacaaataaatgagaacatgtgaagtttgtctttttgtgcttggctcattttgcttaaaatgatgaactccagtttcatccatgttgttgcaaatgacaggatttcattcttcttatggttgactagaaccccattgtgtatagttaccaaattttctttatccattcatctgttgttggacacttgtgttgcttccattgtgtaactattgtgagcagagctgtagcaaacattgtagtgcaggcaccttttcaatacactaatttcctttcttttgtgtacgtacctaggagtgggattgcaggattgtatggtaactctatttttaattttttgaggaactgtcaaactgttgtccatagtgattctactaatttacattctaacccacagtgtacaagggttctctttgcttcacatccttgccagcatttgttatagcctgactgacttttggataaaaaccattttatctggggtgaggtgatatctcattgtagttttgatttgtatttctctgacaatcagtgatattgaggaccttttcatatacctgtttgccatttttatgtcttcttttgagaaatgcctattcagatcttttgcccatgtttaaatcagattattagatttgtccctagagagttatttgtgctctttatatattctgtcagatgggtagttttcaaatattttctctcagtctatgggttttgtcttcactttgttgattgtttcctttgctgtgccagagatttttaacttgatgtgatcatttgtccatttttgctttggttgcctgtgcttttgaggtattagtcaataaatcttcaaccagtccaatgtctgagagcattctccaatgttttcttttagtattttcatagtttgaggtcttacatttaagtctttaatccattttgatttgagttttctatatggtgagagaaaggggtctagttttattcttctgcatacgaatatccagttttcccagcaccacttattgaaaatggtgttctttccctaatgtatgatcttggcacctttgtcaaaattgagttcactgtagatgtatagatttatctctgggttctctattctgttccactgatctatgtgtctgtttttataccagaaccatgccgttttgattactaaagctctgtagtataacttaaagtcaaataatgtgattcctccagttttgttctttttacttaataaatctttgctattctgggtcttttgtggttccacatagattttaggactttttttcctatttctgtgaaaaatgtcattggtattttgataaggattgaattgaatctgtatattactttagatagagtggacattttaacaatatttattctcctaatccatgaacgtgaaacatctttccagtattttgtgtcttctccaatttattgcatcagcgttttatagttttcattgtagaaatcattcacttctgtggttaattccttggtattttattttatttgtagttattgtctggtctggtgttgatgaaattcgccagctcttgtttttctggaaagtcttcaattcttcttcatatttaactaatattttccctggatatggtattccagaataaaagtatttttccttctgcactgtaaacatgtcataccattctcctggtctgtaagctttctgttgaaaagtcagttcctagatgtatttgagcttcatggtatgttatttgtttcttgtctcttgctgcttttaggatactttattttgaccttcggaagtttattaaataccttgaggtagtcttatttgggctaaatctgattggtgttctataaccttgtacttgaataatgatataggtttgggaaattctatgttattacacctttgaataaactttctactcctatctctttctctaccacctctttaaagccaataacttttagagtagcccatttgaggctactttctagatcctgtaggcatgcttctttgtttcttataatttttccttttgtccccgatatggttaggctttgcatccccaccaaaatctcatcttgaattgtaatccccacatgtcaagggagagacaaggtggaggtaattgaatcatgggggcagattcccccatgctgttctcatgatagtgagtgagttctcatgagatctgatggttttataaagggctcttccccctttgcttgactcttctccttcctgccatctttgaagaaggtgccttgcttccccttcctccatgaggcctccccagctatgttgaactgtgagtcaattaaacctattttctttataaattactgagtctcaggcagctctttatagcagtatgaaaatggagtaaactatctcctctgttttcaaatagcctgtcttcaagctcactaattctttttcctgcttaatcaatgtgctattggaaaactctgatgcattcgtcagtaggtcaattgcatttttcaactccagaatttctgcttgtttttatttcaatctctttgttaaatttatttgacagaattctgaattccttctctgtgttattctcaatttttttgagtttttttcaacacagctattttgaattctctgtctgaaaggtgacatatctatgtttctccagaattgatctctggtgccttatttagttcatttgctgaggtaatgttttcctggatgatgttgatgcttgtggatggatgttcatttgtgtctgggcattaaagagttagttattttttgtactgctcactgtctgagcttatttgcacccatcctttttgggaaggctttccaggtattaaaaaagacttgggtgttgtgatctaagctgtgttggctttagggggcacccaaggccagtaatcctgtggttcttgtagactcatagagataccaccttgatggtcttaagtgatatctggaataaatcactggattaccagaaagagactcatgttttcttcgcttactttctctcaaacaaatgaagtctctctctctctctactctgaaccagctggagctaggaatggggtgacacaagcacccctgtggccacaagcatcagagtgctctcgatcagacctgaaaccagcacaggactgagcctggctcgtggcctgctataaacactacctggctacttccaatgttttctcaaggccttggggctctataaccagcaggtgagaaagccagccaggcctgtgtctttcccctcagggcacagacttcccacaggcccctgccaagtccagaggtgccattcagtagccagggactagagtaaaatccttagaagtctacctggtgttctattgtactgtggctttgctggcattcaaaccacgagatgcagttctatcccctcttccccccattttccacaggcagaggagcctcaatctgtgaccactaccaccacggcccacagggagtattccaggatactgaaagtatttccttaaggccaaagggctctttagttaccttgcggtaaatgctgcctaggataggacttacttttcagggcagtggactctcgtttggcccaggatagatccagaaatgccatcgaagagccaaagcctggactcaaagaccccaaggacctgcttggttctctagccccctgtggctaaaccagtgacaaagtcccctttactttttcctctgcttttctcaagtagaaagggtttttctccatagcccctatagctgggatggtgctgagttttacctgaaggtagccagtctcagagtctcactgaagggccacaagatactacctgggtatttctcctagttattcagggtccaagggctctttagttagcaagtgatgaatcctgccaggactgggtaatttccttcaaggcctcaggtttccttctggcctagggtgtgtctagaattgtcattttggaactagggcctggaaagggggcctcacggctttgactgatggcctatcttactgtgactgaggtggtatccaagatgtaagacagagttctctttactctcttcaatcctcaagcagaaggaagcagtctgttttggagccatgagctgtgcagcctaaggttgcgggggtgatgtaagcactcccttggccaccccagatgatgtctcagtatgtcatatgccctccaagttccctggttctgagcccagttcagcactaggacccacctaggagttgcagtctttgcagtctatactgccttacaagtttttataggatcccagagcactttagcctaccatagcgacatttgccagaactcaagttccaacagctggcatgtgttattcccttctagctagggctgatttatctgcttcctttgtggaaaggtgttagctgagttcagtccagttttgctttctgctgtggcaggacagcactgagttcaatacaacgtctcacagttgctgtgctatccttcttacagcacacagattctctcttcacaccacatggccactgccaagggactggagagaggtaatatcaaggatttaagactttctttcctaccttcttcagtgtctcttttattaatgtgaggttaaaaccaggtattgtgagtgctcacttgattttggttcttataaaggtggtttgttttgtgtagatgtgaaactggtagaggcaggggagaaaattagtagagccctttatttggccatcttattcttccccctcagtttctagtttagatggcatgcatggaactgctttttggtaatgtatttgagcagagactataacacatataagtagagattgtcctccccccgcagaaaaaacttacattttatcccattgtggatttttatgactaaaataatcttagtatagatcagtatacttttaaaaacactggtaactattcattgtagtcaatacctagggagatataacaaacagagatgatctgtgtcctcagcaaagcttaaaatttacactgtgagtccacataaacactttcaattaatttgaactatgcatttatttattcatcacttgcatgtatcgaataaatgctctatatattctgcagcactggtactttaagtactgattgatacccttgttaatataaaaataaattcctctgctttcatggaacttactttctggtagaagaaggcaaaatagtcatataaggatattaatgcaataaaagtgcaaagagctatgaagtaaataaaaaagctatgaagtatatagtagaataaagaatataaatcctttgggtatgtacccagtaatgggaatgctgggtcaaagggtatttctggttctagatccttgaggaatcacgacactgtcttccataatggttgaattaatttacactcccactaacagtgtaaaggcattcctatttctccacaacctctccagcatctattgtttcctcactttttaattatcaccattctaactggcatgagatggtatctcattgtggttttgatttgcatttctctaatgaccagtgatgatgagcttttttttcatatgtttgttggctgcataaatgtcttcttttgagaagtgtctgttcatatccttggtgcactttttgatggggttgttttttttcttgtaaatttgtttaagttctttgtagatttgagatatttgcccttggtcagatggatagattgcaaaagttttctcccattctgtaggttgcctgttcactctgacgatagtttcatttgctgtgcagaaactctttagtttaattagatcccatttgtcaattttggcttttgttgtcattgcttttggtgtattagtcatgaagtctttgcccatgcctatgtcctgaatggtattgcctaggttttcttctagggtttttatggttttaggtcttatgtttaagtctttaatccatctagagttatttttttgtataaggtgtaaggaaggaatccagtttcagctttctgcttatatctagtcatttgtcccaacaccatttattaaatatggaatcctttccccattgcttgttcttgtcaggtttgtcaaagatcgggtagttgttgatgtgtggtgttatttctgagggctctgttttgttccattggtctgtatacctgttttggtagcagtgccatgctgttttggttactgtagccttgtagtatagtttgaagtcaggtagcatgatgcctccagctttgttctttttgcataggattgtcttggctatgtgggttcttttttggttccatatgaaatttaaggtagtttttttttttttccaattctgtgaagaaagtcagtggcagcttgatggggatagcattggatctataaattactttgggcagtatggccattttcatgatcttgatttttcctatccatgagcatggaatgtttttccatttgtttgtgtcctctcttatttccttgagcagtggtttgtagttctccttgaagaggtccttcacatcccttgtaagttgtgttcctaggtattttattctctttgtagcagttgtaaatgggagttcactcatgatttggctctctgtttgtctgttattggtgtataagaatgcttgtgatttttgcacattgattttgtgtcctgagattttgctgaagttgcttatcaagcttaaggagattttgggctgagatgatggggttttctaaatatacaatcgtatcatctgcaaacagagacaatttaaattcctcttttcgtaattgaataccatttatttctttttcttgcctgattgccctggccagaacttccaatactatgttgaataggagtggagagagaaggcatccttgtcttgtgcctgttttcaaaaggaatgcttccagtttttgcccattcagtatattggctgtgagtttttcattaatagctcttattattttgagatatgttccatcgatacgtcgtttattgagagttttcagcatgaagtgttgttgaattttgctgaaggccttttctccatctattgagataatcaggtggttttcgtcattggttctgttgaagtgatggattacgtttattgatttgcatatgttgaaccagccttgcatcctagggatgaagctacttgatcatggtggataagctttttgatgtgctgctggattcagcttgccagtattttattgaggattttcacatcgatgttcatcagggatattggcctgaaattttcttttttgttgtgtctctgccaggttttggtatcaggatgatgctggcctcgtaaaatgagttagggaggattccctctttttctattgtttgcaatagtttcagaaggaatggtaccacctccactttgtacctctggtagaattcggctgtgtatctgtctggtcctggactttttttggttagtaggctattaattactgcctcaatttcagaacttgttattggtctattcagggatttgacttcttcctggtttagtcttgggagggtgtatgtgtccaggaatttatccatttcttctagattttctaatgtatttacatagaggtgtttatagtattctctgatggtagtttgtatttctgtgggatcagtggtgataacacttttatcatttttttgtgttgtatttgattgttctcttttttcttattagtctggctagtggtctacttatgttgttgatcttttcaaaaacccagctcctggattcattgattttttgaaggctttttcgtgtctctatctcattcggttctgctctgactttagttatttcttgtcttctgctagcttttgaatttgtttgttcttgcttctctagttctcttaattgtgatgttagggtgttgattttagatctttccttctttctcttgtgggcatttagtgctataaattttcctctacacactgctttaaatgtgtcccagatattctggtacattgtgtctttgttctcattggtctcaaagaacatctgccttcatttcattatttacccagtagtcattcaggcacaggttgttcagtttccatgtagttatgtggttttgagtgagtttcttaatatcgagttctaatttgattgcactgtggtctgagagactgtttgttgtgattttcgtcctttctcatttgctgaagagtgttttacttctaattatgtggtcaattttagaataagtgctatgtggtgctgagaagaatgtatattctgttgatctggggtgtagagttctgcagatgtctattaagtccgcttggtccagcgctgagatcaagttctggatatccttgttaattttctgtctcattgatctgtctaatattgacagtggggtattaaagtctcccactattacagtgtgggagtctaagtccctttgtaggtctctaagaacttgctttatgaatctgggtgctcctatattgggtgcatatacatttaggatagttagttcttattgttgcattgatccctttaccattacgtgatgcccttctttgtctcttttgatctttgttggtttaaagtctgttttgttagagattaggatttcaactcctgtttttttgttttttgtttttttgctttccatttgcttggtaaacattcctccatccctttattttgagcctatgtgtgtctttgcacatgagatgagtctcctgaatacagcacactgatgggtctcgactctttatccaatttgccagtctgtgtcttttaattggggcacttagcccatttacatttaaggttaatatcgttatgtgtgaatttgatctgccattatgatgctagctggttattttgcccgttagttgatgcagttttttcatagtgtcgatggtctttacattttggcatgattttgcagtggctggtaccagtagttcctttccatgtttagtgcttccttcaggagctcttgtaaggcaggcctggtggtgacaaaacctctcagcatttgcttgtctgtaaaggattttatttctccttcgcttatgaagcttagtttggctggatatgaaattctgggtagaaaattcttttctttaagaatgttgaatattggcccctactctcttctggcttgtagggtttctgcagagagatctgctgttagtctaatgggcttccctttgtgggtaactcgacctttctctctggctgcccttaacatgttttccttcatttcaaccttggtgaatgtaatgattatgtgtcttggagttgctcttctcgaggagtgtctttgtggtgttctctgtatttcctgaatttgaatgttggcctgtcttgctaggttggggaagttctcctggataatatcctgaagagtgttttccaactgggttccattctcctcatcactttcagaaacaccaatcaaacctggatttggtcttttcacatagtaccatatttcttgggggctttgtgcatttcttttcactcttttttctctaatcttgtctttttgctttatttcattgagttcatcttcaatctctgatattctttcttccgcttgatcgatttggctattgatactggtgtatgcttcacgaagttctcatgctgtgtttttcagctccatcaggtcacttatgttcttttctaaactggttattctagttaacaattcatctaaccttttttcaaggttcttagcttccttgaattgggttagaacatgctcctttaacttggaggagtttgttactacctacttctgaagactacttctgtcaattcatcactcattctccatccagttttgttcccttgctggcgaggagttgtgatccttcgcaggagaagaggttttctagtttttagaactttcagcctttttgtgctggtttctccccatcttcatgaatttatctacctttggtctttgatgttggtaaccttcagatggcgtctctgagtggatgccctttttgttgatgttgatacactccctttctgtttgttagttttccttctaacagtcaggcccctctgctgcaggtctgttggagcttgttggaggtccactccagaccctgtttgcctgggtattaccagcggaggctgaagaacagcaaagactgctgcctgttccttcctctggaaactttgtcccagagggacacccaccagatggcagctggagctctcctgtatgaggtgtctgtcagcccctacggggaggtgtctcccagtcagaatgcactggggtcagggacccacctgaggaggcagtgtgtcccttatcatagcttgaaggatgtgctgggagatctgctgttctcttcagagctgtcaggcagagacgtttaagtctgctgaagctgctcccacagccaccccttcacccaagtgtctgtcccaaggacttatagatgccttttttttcagagatgtccaaagaggaggaatctagagaatgccattgtcttaaatagcattttcagggttgacattgtgcagtagctgaaatttaggcaaaagcttaaaggaggtaagggaattggtcctaagctatttagtggaagaatgttccagacagagaaacatgtgcaaagtccctaggtaaaagccgcctggcatgttccaagaacgaggaagagattggcatagctggaggggagtgagtgagggccagggaagtggaacacgcaggtgaagaggcagctgagtagcagatcaccatggaggaaagaggggcccactgcagggctgtgaggagtgatgtgatctgaccgattattttacagtgcccttctagctgccctgtagaaggtcgaaggaagaactgggaaggaccattgtgggctgttggaacaatcctggcaagagacaatggtggctctggctggcatgggagggtgtgggaggggcttacctgatgctctgtgatggtttgtgtctctctcatgagggtgtgtgcatttcctcaacacctggcagcagcggaatgttggatctatttaagataaatattaacagcctgattattataggtgttattattccaacaataaccagtaccctaattctcttattccagctcagtgtccaacaattctgtccagttctgacactagccggagttagcgctgaccccaggggttaagggctcagttccccaagaccacctccacttcatatgcaggccagaaatggggtcctcaggctatttacacttctgcctagctcactaaaaatgtgagggttggtagtttgtttcaaactatgactccatcactcctgtccccaggtttgagaattttctagaatggctcattcctcaggaaagcgctttacttacagtcacagtttatcttaaaggatacagtttaagagcagccaaatggaagagatgtacagggtaaggggtggggtggggatggaggttccctgtcttctctgggggcactagcacctcaatgtattcaccatcctggaagctcagcctcgctgtttcaggagttttactgaagtttcattacataggcatgattgatggcaattggtggtgattggactcaatctccagcccttgtcccctccctgcagatcagggggtagggctgagagttcagccctctattcatgtggtcggttgccctggccaccagcacccatctagaagctatgtaagggccatctagagtcacctcttagcattaactcaggtaagatcaaaaggggctgtttatgaataatggaagaaactcctatcactcaggaaattccaagaatttcaggtgcctttttgccaggaatcaagggcaaagaccaaatagataaacattttgaccctaacttttgagacagggtcatgtcagagctcaagcgatcctcctgcttcagcctcccaagtagctgggactaaggtgcatgcactcatacccgggtaattttttttttcattttttgtagagatggggtctccctttgttgtccagcctggtcttaaattcctggcatcaagggttcctccagcatcagcttcccaaactgttacaattacaggtgtgagccactgcatctggcccaaatatatatttttgatgataacacaatgggagtatcaaaaattcagatgggagagcagagtccattgttcagaagaacagcagatcagtgaagtccaagtgtctgaaaaccaacccaggcagggaagagtaggtgggcagttggagggccaagaaaactaacagcctgatgtggctgatgaaggacggaagtggatgtgggctttcagccatgagcagttggcaataacttagaagtagagcctgggtgcggagaaggagcaagtagatttgcaatttttcaacctctcctaggtttcaggagttcatgagtgtaaataagttcatgaatgtccaggcatattcacatgcatagctccatgtctccaaatcttcacttgcttgacaagatcttaatcccatgtttctcttgtctccttaaattcctcctcagctatttctgggtgtccttggaatggtgatgtctcaacatgggcttgggaacacgtttgctcctcttctttccacttgagtccaggggccttgccatggcctctgcacttggtgctctttgaaagacatgattcctgtgcacccaacagacccctgtgaaacaggaataaaaatgtctcataggatgtcagtgaagattcaataagatagtgtttataaagcactgagattaaataagaatgtttgattcctactaaaagctcaattaatggctggggttattattattactgttcttattgttaggcatggttttgaattcctcaccatcctaattgccacttaaaatgaacaactgtctttgtggatacaatttcagaggcagcatggggactaacttttccagaacatgaacctagtgcctcctacagtggtagaaattaaaatcctgtgtgaaaacacaaatatgcttgggagagttactgattgccaagaaagctctttagtttcctttctgtgtgaagaagcaagcagggctcaaggggccctaccaaggccatggagaatggtaagtgctgctcacagccacccagtctgcgttctcctttctaaaggaggtctaaagaggtgggagtgaatcagtttagtttgcaaacacacacacacacacacacacacacacacacacatatgaaaatatgcaagacggaatcccagggccactttggggtgagaccttccccatgagcaggaaggatgttgaggaactggagcagagcccaggcgggaagaagaaccaacaaggtcacgtggcagcttgatctggctgggaactgagctctgcagtgtgcttgggaatataaacaatggggacagaaaagaaaaaaaaaagatttcattagaaatgtaaaatcaaccaggagggcagctctgtcctgctggggcataaagccatggtggaggcccaggaaagttctgttgatggaaaacagtatctgggcatttggcagcaacagatgacttagatatgttcccttgatttcagtactctcacttttatattgaaattatgctatttgatttctcagcacctggtagagtgcctgcacaaggactgtgcagttagcatttgctgaacttcacagaattggggatggggtggagaaaagagcagagcccatcacgagagggaggtaaagttgagataaagaagtttgagatgctctagacaccctttgcgtacttcacctttttttctggcattagccttgagcattaagatgcaaagtaaaagcgaaggaaaaggaagaggcctggagtgaggatagtgcatggagctcatcctcatgaaattcttctctggttgctgttcccatgaggttatgcgatgcctgagcccaggaactgtgctcctgggtcctgataccagtgcccagcccatagcgggggatccccattttatgataagaataaatgagcacctcccagatcggtgacttgctccaccccacaataaccccgggaggagggtgtggtcagtccagctgtacaggtgagaaagtgagctgggagctgtgacttatccacaccctctcagcagcagttgtgacagctggggtcacacagttgattcactgccataggggaaaagtggaggagggagaggggcagagagcgaagaacaactcaggaaaatgaaggaaaagcagaggcagagagcgaagaacaactcaggaaaatgaaggaaaagcagaggagaaattaactgactggaaaaatgacaatagttggaagacagacgaaaaagggacgagtgcatcagagtgtattttggcacttattactctatctcctttttatactacttcgctttttcaacttaatagttaaggcacgtcggtctagtcttccccgaagggagcttgccaggctctgcgacaggcttggaagttggagcccgggccctgggttctctcagcttccagctcaggaggcggagtgggaggagcgggcctggcggccgtgggggcggggctgctccactaacggttactggtcgctgctgccgccgcgctcctcccccggctgcggcagaggcgcgcgcctgcgtcctgaggatcccgcccttgggccgccgggaacctcgcagagcggcggggtggccctggcgaggcgcggttgttgggggttcgctcgagcctcacgacgcccgcgactggggactcggaacctgggccaggctgggacgaggccgcgcgggagggcgcgctgggcggacgctggggccgcggagcccaaccgcccttgtcctggacgccccttggcggtccgcactggcgggtgccctctcccgaggggaactgaggcggggcgcctgccaccattcgtgattttccgtgactcaccctctcaacagtgtcccgtcagcccccgctttctggaattaagatgattttccatgggcattatagtcagaggaggttttctgtgagacatctgggaaaggtgactcaatgatcactcatattgttctatgatgttatacatttaaccggaatactggtgaacagcttttatatcttggaattttttcccatttttgaatcagaaatttaggaccaagaatcttctgtcacagaacctattactttgaggagtgaacttatattaacggtgctaaaccgtacatgaacgacttggtagatgaaaactttggaaaataggaacatttcatgtcatcacatgtatcctccagcattggggaaaattcaacagttgccttaaggcgggagtttaattgaggacatttactaaaaagttacttattctgtttgaaattctcttctgataaacatcttcccgggataacgaacatctccaggatgtgagagccgagcgcgtgtccgcggagtgcttgagcaacgcagaatggcttcggtgctgcgttccttagaccccgtgcggaccctgctgagccctcagcatctgtgagtgagtccctccgcgtcaccttggcctcccgtgtagctagatcagtcttccgaccccttgttctacttgcacagatttctgattaacctcttctgctcctccagagatgagtcagggctccgtatcagctccccaaggcatttgctggcttctgacatttacttggaggactttgggctgcgaaagggcaaagtttgccgttctcatctctttttttggtgcctgcccccgggtcttgacctttctctggagtcttctctcctggttctttacccacctctttggtttctcctgtggttctttgtcaaggtgtcccctagatgtcacactctgaggctcagttgtggctgagtcttgcattgcaagtgtttttgcaggtgtctctgcgaagcgtggatatgggatggtgaaagtggcagtgtgcacagagtgtttgggattagatgggcaggtggaagggcgtctaggtaggacccctttgtcctggtgtgaggtaatgaggttctagagtgtgctgtcaaggtgaaactaaaaggaaaggatagacaggagactttgtgaaagacgaaattatggtagtttggtaacaaatggatgcagggactggtgggtgggtgtagaagaaggcagaaaatcttgccaaggacattgcaagtcctgaatcagaccaggaaaattaaggttcaattaacagaaataagtccagagggggagctaattttggaggaagtgtggtgataaatttgcttttctatgtggtccagctggtggagagacatcaagaagcacttagagaaatacaggaaatagagaggtgggtgacctaagtcctacttcctatcctgtctatgtatatataacaaaggccaaatgaattcatgtgttgaggtctgctttcctatttctaatagcaatggcataaaatgaattctagccaattctaaagtcactagtagatagtaatattcacgaagtagccacaaatccagggctctaactcaagggagagagatcgggactggagatagaattttcacaagtaactgatgcatggcacttttctgtattttggtaaatgtattgagaagatgattgcagttaagtagctaactgttccagatactatccgaggcatgaatgatttgtcctggagtaggtgtgctgtgtcactgtagcatatctactacaacagacatgatatgtttccatacattatctcatttaacactcagaagaacttcaggagtagttattactagtccattttgcagaagcttacagataagattcagagatgaagcatcaggtctatctgatttaaacccaggtctatctgatttcaaagtcgatggactttttgttatttcataccataatctgtcagggtgtgagtgggggataaaagaaagttaaacaaaactcttggaaacagagaggaagggcttaaaccattaaaattaacttcagaagtcaagaatgaagctcgggcagaaaacaagtagagggcacagttctgtcccgatttacagaggatgggtttgcgacctttctgatgcattaacttagtaatgctaaggtgtgccatccaaaacgatcacctgtatataagccactctttcacagaggtgggtttttcttttcttttttaattcccatgctgctcaaaaccttttagatttgaattattgggaagaatatctcagggtaggcaggaagccaaaggggttgagagctgcttgtcacttgctggttttgcttggtatgggctcggtcagcagtagggacttccttagtcctcagtctttctaggttaactaccaccctcttggtccttgtttctgttttgcttttcctggcttggacatggaatttgtaagtgccacacattatttcctgtcccatgaccatacttaagctataaattatagttttgtttcttcctgatccttttccttcaacaccaaatgtgtttgtgcctcaaaccaggaagttggaaatgttatttaactttcctgcattttaattggtcacaaatctctccccttacacacacgcccccaacttttgaggagtcttgagaatctccttaacgtccttgacagttgatcaatgaaagacatgtagggagatccagattgcaatgaatattgtattatttgcttaagaatttgaagagttattgcttcgtagtaaatgaagatgagcatattgaggtttataagggaggctgaggttcacttggccagagattcagatgttcactttattttataatcatcctttttaaaaaacaaaatagactgacatgggcaactttctcaagatttcatatggcacattgcatgtagggataaacagtaccaacattatttgcttggagtgctttaggatcgaggaatggggaagcctaagcaaaacccccaaatcttggcaagctcaggaggagggagcagatagcactgctggggtgatctgtgctgcttgaatgctcttttggagaatcacttccctgtagataggccacagattacagtttaccaaaagcattgactgtcagacccacatagctggtttccattaacatggttttgctctaggtctttttcaagtcctctttttttgtttgtttgttttttcttttttctttttttttgagacggagtttcgctcttgttgctcaggctggagtgcaatggcgtgatctcggctcactgcaacctctgccttcagggttcaagcgattctcctgcctcagcctcccgagtacctgggattacaggcgcctgccagcacgcctggctaattttgtatttttagtagagatgggatttcaccacgttggccaggctggtcttgaactcctgaccacaggtcatccacctgcctcggcctcccaaagtgctgggattacaggcatgaaccaccatgcccggcctcaagtcctcttttaaacgtggaaacttcttcctgcattacacagttcttttctcaccctcttcctgcctcccttcctttcactataccttagctatactgaattggacatataattcttagctcatgcatggctttcttttaataattagctaaacaatagcatggtcatatatgatgatatcacccaaccagagaataacaacattgtccgtatttacctctgtacattttctctgcagcctgtatgcctgtctctcttacctctttgtgctgattgttctgttgccttttttgtagttttcatagtttcgtcagtgtgcatgtatttatacatttatgtatgtatgtatatgtgttgtttgtgtatatatgttcacatgtatgtgtagcctaaatatagcacctaaacaatattctatttacttttagtcatttatgaacttcataagaagcttattattctgtatagagcaacttggagctagcttatttcactcagtagtatgttattaatatccaactgtgtgtacagtttaatttgtttttccttgctgcctattattccacttgattatgtcacataatttgggtcgtttgtaaatttttgttgtgagcaacagtcctcatatgaatcttcttatacatgtttgtgaagcaccggtgcaaggcatcaactagttctaagaggcttgctttaaaatttagtgggaatatgtacatgaaaatgagaactggccaggagcggtggcttatgcctgtaatcccagcactttgggaggccaaggcaggtggatcatgaggtcaggagatcaagacaatcctggccaacatggtgaaaccctgtctctactaaaaatacaaaaattagctgggcgtggtagcagacacctgtaatcccagctacttgggaggctgaggcaggagaattgcttgaacccaggaaatggaggttgcagtgagccgagattgcgccactgcactccagcctggcgatagagcaagactccgtctcaaaaaaaaaaaaaaaaaaaagaactgtagcagcatgctcagatgtgtgattcagaagtgaagctagaatgaagatgatgtagagaaagccaggaggccagatgggagattgttataaagccaggagatgttgagagttagtatgattggaaatggagaagagcaagttagatttgagggagattggaggatggacatgctggggcctagaggttaatggcacatgtgactgagagagagacagacagacattttccccatgctttccagctgaagtgcctaggtagatggtgatactattaaatgaggtacagaatagagatgagagataagtattggaagggagccagccttggaggggattagtgtgagttgggtggtagttggaaatgtagaatttttggaatggtgaaggatgtcctttacaccctgtcaaggaagtgtaggttagaaacgtggtccttcaggtgagattttgagtcatgttctgcagactgttgacctgtaagaggtcagcccataggaacacacaggaatggacactgatggggagaaggctgatctggcttattgaccatagttttcaaaaaaggcactcgattgcctgctcctgtgcatcacagtgacacctgtggtaccctgcctttatgtgaaacggaaaaatctccaaaggaaagcagacatcaaggtctttttctggaaagtcatttcagggaagttatagaccaaagcagctcagagatgggaagcctcatttgtccctttcttccacattactcccctttttaaatagccacctctgtggcagtgtattccaaagtatacatctagtaatgccttcctacaggatgatctttgaaaataaatttaaaaaaaagctgctaaaatgtgggaaatactatttagtataatcctttccaagaaagttgctatacatattaatatgttaaatgtcctaaaaactaaattattccaccactttttttgttctctaatatctgtagaggtctcagagaaagctgttatgagtgatatactttagaaatggaaagaatggtttgtttatgttaattatcctgattcatcattaaaatttaaattatgttaaaaatgtgtatttttatctatttgtaattatttaagaaaaaatctttgatctttccattaaaaatatttttggacgggctgggcgcggtggctcacgcctgtaatcccagcactttgggaggctgaggtgggcggatcacgaagtcaggagatggagaccatcctggctaacagggtgaaaccccgtctctactaaaaatacaaaaaatagccaggcgtggtggtgggcgcctgtagtcccagctactcaggaggctgagacaggagaatggcgtgaacccgggaggcggagcttgcagtgagccgagatcgtgccactgcactccagcctgggtgacagagcgagactccgtctcaaaaaaaaaaaaaaaaaaaaaaagatttggactgaatttctgttctctggaatatttgcttctcctgagcaagtttcttctcagtaagaacagttaataaacattacttcatgagtgaaaagaattttgaggtaaagttttgaattgacagtattacggacaatattattttttatacattttcctttctttttctttcagttatctggattagagatctgattttcaaaagttgtcatgtttttgtaaaccttcaaccaaaaggcttaaaaggagaaggtataattttaactttaccaggagtatatgctgtatttacttgcataaagacagaaaacagccctggtttctctgtgtcacttgttgtcatttataagctttggctggaggggagcaatgtcaaggtgcatggcagctggtgttagagctgctgttcagtgagctatcccagaatgcagggatgtatttagtttgtcatgactgggtcaggtggagcaggcatgcttctcagaacttgatgaaagtttggaatacccagaaactgagctcaccatctgccagagatatgtctaccttatctctgagttttatgccccttcaacatctctaaaactctttgatatcagagaggccaatggaatcaatatgtaattcctcactgttatttatggactactgaggacagccacaagcttttctaggatcctggtgctctgcttaaaaataaaaaaaaattaatatgatttaaaataaaggcaacaacaacagtggcctttgggccctcccataagtacagataacaagtagttgggtagagtgaccataataaatacccatctcactaagccttagtattcatcttgctatactttgacacagaagttctagcatctcatactcatttactataggcctcctttaagtccggatttcaattagtcaacatagaagactatgaatgctcttttcagacacttaaaccaacatattaagttataaatccttcaggagtatacccatggtaatgaatattaccatatttagtcttatattacatcttcttttgtctaaaagccatagaatgtacatccatagttgttcctcggacttatgccaagaaaaatgtcaagacctacagctctcttagtacatgagccatattcctcagtgcatgttctctacttctccttctctgcgaagctggatctcaatctcctatgctttagaggaagtgaaagatgctggcaaacatgggaataacttacccagttgaagcaaacgaaaagacttacgtatagagttgctgattgtctcaaatcagggtggggggtatgaaattcttacacccaaaagtaatgttcagtgttttcagtttcaaagttgccactcttgtctttgtttatataactgtctgcaacccatttctcaggatcacactcctcccaatccatgtctttcctgtagcacaagagaacttggatggtcacatattcaattggtaatgtaactctgtatccttccaaattaatctaggcttatcagtctaaagttattataaagttataaaggcgagcaaaccaattcaaggacccactttgatgtgttttgtgaggttcttagggtctctattggagaattaattgggagctggtagaaaacagatggcctgcgcaaaggagttgagaagagattttaatgaaagaacatggttatttacacatggttattaaggttaagagatccaacaagcaataatgtcacataatagaattaacaagatgaaatctgaatgggtaagaagaaagagtggttttattgactgacaatggtagctgtgaacttaggcaaaggaagagggcaattgccagaccataggctggcaggaagaagtagagttaaatattctgacctctccttccaccctccaatattctgatgatatacgaaaaacagcaacaacaagacaactttgtggtgggggaacaaagaaaaagcatcggttattacccaacaactttaactcaaaatgtgattgctttattctgatagatacagttcccagagttactctcttgaggtagtctagtttctctcatttgacactcacttggcctcccagtgagagttcttaaaaattataataggggtaggtgaaagccacaggggctgagcaatggtttaaatagtctctcacaaaatacaaaagaccggggaagagggatttgaaagcagctttgttttctttacttggcaacttcctggagcttggatccctgccagttaaacctctgctctgggtgtgccaggggacttgttagagtgctacaatataccagttaaaaagttttaattaaatagaggaaacgacaagcaatggcacctgcagttgggatcccaggaggagaagaacttgttataatatcctttgggtttctaacttagctctccctggcattctggacagtaatgaagccccaagttcattcaaaggcatcttggcaacagtgaaatcagacaaattttgacaaaaagtttaaggtttcacctgggaccagatgcaattctcatacaaagtgctggactatctgcttattattaaacacactgtgtctgtatttgtgaataggaagacaatagtgtgttccattaatttgaggtagaacagcaaaatgagtccctcttgatagctttgggctcatttaacaaccatgcttatgttccatgacgtttatccacatatgattattattcactggaataaactgatccttccgagaatagtcctagttccctcatataagtaccaatttcagtatttggaaaacaatccagattcataactggaatctttcttttagtattgtgactgtgtctcagcagttataataaaattgtcactgtactaaaaataccattaataataaagtgtggaaagacatattcagctctcttcaaaagtagctatttggttatttaaagttagctcatacgttttatgtatttataaagctcaagatcttgggctagattcttaacaaaaaagttttcaatttgttgaaaggttcagtcaagtcagtgaaaaacaaaaatcctaggatagattgaattgacttattttaatctaccaaattatttttatcagttaaagtgttttaatttctgccctcgtgtagagaaaagtattgattaaacaagaaaacttcttgagtaacacaaactccattggttttgttgatgcagaaagcaaaactgtaaaatatttgaagaggtttattttgagcccattgtgaatgaccatggcccatgacacagtctcaggaggtcctgagaacacgtgcccaggtagctgggttatagctcgcttttacacattttagggagacaggtgcccaggtagctgggttacagctcgcttttacacattttagggagacagatgcccaggtagctgggttacagctcgcttttacacattttagggagacaggtgcccaggtagctgggttacagctcgcttttacacattttagggagacaggtgcccaggtagctgggttacagctcgcttttacacattttagggagacaggtgcccaggtagctgggttacagctcgcttttacacattttagggagacaggtgcccaggtagctgggttacagctcgcttttatacattttagggagacaggtgcccaggtagctgggttacagctcgcttttacactttttagggagacaggtgcccaggtagctgggttacagctcacttttacacattttagggagacaggtgcccaggtagctgggttacacctcccttttatacattttagggagacagcttcccaaggtatctgggttacagctcacttttacacattttagggagacaggttcccaaggtagctgggttacagcttgcttctgtacactttagggagacagaagttacaggcagacataaatcaatacatgtaaagtgtacactggttcggccctgaaaggtgagacatctagaaggtagggtgtgagagagggcttttcaggtcctgggtgaattcaaagatttccaaagattggcaatgggttgaaaaagttaagttttgcctgagaagagttgaagtcagcataaagaaatgcttgagtcaagatgaggggggtagtggaagccaaggttcttgttatgtccgtgaagcctgtaagtaacaggcttcagagagaatggatggtaaatgtatcttatcagatcttaaaaaaatctgggaaagacctggtaagtgaaggagattccctacagaatacaaattcctcttacgagagagggctttgcagggacatttcaaaatatgtcaaagagaatatattttgggacaaaatactttgatttccttcaaggcctgctctctatcatgtgatcccataccagagtcaggtcggagttgggtatctcactgctacaaagaatctgttttgtcagccttatgatctctagtttagtgttaatgctggtcccttgtgcctaaactccacagggatgagggtatgtgtgacccgccttttccattatggcctgagctatttcttcaggtttcttgggatccccttggttaagaggaggatccattcagtcacttggggcactcagaattttatttgtgcgttacattatctctctttcttgctggcttacattatatttctttcctgctacttcaatgagtatgctcctaacctcagttactttttatcattttctactcaatgtcccaccttcccgactgcttaaagatgtcttttggattgaaatatatcttgggcctcccacaatcttctcacctcatttttttcattgtgccaatttaaaagactatttcattcccacacatgtttaacttattgttgttgttattatatcatatataacagatgctaatactaatttaaatatttaggttttaggggatggatactgaaggggaatttttatcaaagattataaaatttcagtgagacaggaaaaataagctttaatgatctattgcactgaatgatgactataataaataattatgcattatatatttaaaaattgctaaagaaaatagattttaaacgtttccaacacaaaatagaagtgtatgaggtgatagatttgttaattaccatgatttaatcattccacaatgtaaacatgtattaaaatatcacattgtgctccatcaatatacacaattcttatttttcaattaaaaatataataaaataaattaactgcagacagtagtttgactcctgtgtattaagccccttttacataggccagaagcccaccacctactctagcttcacaccaagtgtcctgctttagtcttctgtctctcacatggcccctttattcacctttatatatgggaatgtgcctgcctctagtgaaagagccagcaaatttatagttcacctctacctactttgtcatattttacctgttccaggtctgcagagagaggagttttttgtcatagtaaacctttgtattaatacctaaatacacatagattttagaagaacattatttttcttaggtaggtgtccatagacggagctgagattcctgtgcaattgacctcaatttataacttcagttttcctgtgacacctacagcgatgtgtccttatgatctttttgcttgttttggaccccacaagtgaggtcttaaatttattatcgtaaagtaatattttattgctcttttagatagctatctgtggatttgatattgtttggacctgggtccccacccaaatttcatttcaaattgtaatcccctgtgttggaggtggtgcctggagggaggtgattggattatggggctagatttctcatgaatagtttaccatcatcctcttggggctgttcttatgatactgagtgagttctcttgagatctggttgtttaaaagtgtatagcccctccccgctctctctctgttgctcctgctcccaacatgtgagatgcctcgctccctctttgatttctgccctgattggaagcttcctgaggcctccccaggagcctggaagataccagaatcacacttcctgcacagcccatagaaccttaggacaattaaacttcttttctttataaattacactgtccaggtattttttatagcaatgtaagaatggactaatacaggcttcattatggaagcgatcacctctttatatagtcattggactgctgtgattagaaaattcacagcaatgagttggtctcattttgtatatattttattgagtgtttgccatatttaggttacctctgggatggggtgcaattctcatacacaatatacagaccgtttacttattagaaggatgtctgtgtttgtatcaggagtgggaggacagtggtgaactcattaatgtgattcagtagaacatcaaaatgagatcttcattgtggctttggaatacatttttgacacttttaaaattaaaattattttagttcatattatgaaatatattgtacacaaaatccatctaattaatatttacaaatttaaaataaaataacctgtaattactacacatagaagaaatatatatcaacaatttatttgagctcctggtgttctcctcccatcttctctggagaaccacaacattcttaattttgttttgtaaatcatttatctttacacttttatcataaatgcccatatcttcaaatatttgtgtgcatgtctcttgagaatcatatcaaaagcattttgtttgtttgcacttaacattttgcttgggagattcattcatgcaagtactgatggttaagacattttaaaaatatataactgttacatagcatttcactgtttaaaaataactatttgtattttctgtcctccagttttctgctatctagaaaaggctctttgttaagacttttattctaaggcagatgggaagtcaatatagggtcttgtgcagagaagaagtacacatattatttttgctactctgtagggagtaggttgctgagggtcaggggtagaagcagcaagattacataaacatttcataaatacacgaagaataagtggcccaaagcaggtaggtagcagtgactatggtgagaagcggccggattctggatgtctttggaggtagagccaacagaaatattgtagactggctgtagcgtgtgtacagaagacagcactcatgggtgaccccaaggctttgggccagaggtgttaaggggtaccattgtgatcagaagtgggaggcaaagatgtgcctggaacagatatgggatagggaaatatcagaatactgtacatctgagatgtctaaaagccattcaagtggaaaggtcatgtgggtaattggatgtggaactgaatcagtaagtaaatatatacacaatctttaggaatcattaagacaaaggaaaataacccaacagaaaaaaaatgtctgcaaaaggcctgaacagatagttaacagagtagaaagtatggatgatcaataaacatatcaaataatactgcatatggataataatcatggaaattaaaataaaaccattaggttgtactccatacttgctatttttcagcgaatatttaaatgagtgaacatactatgtttgaatgaggatatggagtgaaacgaactctgatgcattagcaatggaaatgtgaatttgtgtatctctttgaaaaacaacccgcatttacctagtaaatattctaagatccatttttttctgtcctagacagaaagtcaagggcctcaaaaaggctgctccaggaccctttgaagtctagtttccagtcatattttgctgttatctctcactgatctcatcttcccattctccattccaaccacacaggcatctatgctgttctagaatatatactccacagttctgcttcagagttggcacgctaggaattttcttttattagactctcttctccgaaatatctatgagactcactttcttattgttttaccaatctgtgctcaaaagttacttactcaaggcccagcctgagctctctactgttacccaccagtattattgatctgcccgagtttgctctttttcctctttactatgatgctgatgaccttccatcatgctatgtaatttacttatttattatgattattttcagtatctgctctctccccaccccttccctgcacacatacactcttatcctaaagtataatttgctcataagcagagattttttttattatgatattttaagttctagggtacatgtgcacaacgtgcaggtttgttacatatgtatacatgtgccatgttggtgtgctgcacccattaatttgtcatttacattaggtatatcttctaatgctatccctcccccctccccccaccccacaactggccctggtgtgtgatattccccttcctgtgtccaagtgatctcattgttcaattcccacctatgagtgagaacatgtggtgtatggttttctgtccttgccatagttttctgagaatgatggtttccagcttcatccatgtccctacaaaggacatgaactcatcctttttttatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgcgatggctgggtcaaatggtatttctagttctggatcccataagcagggatttttttttgttgttgttatttcctgatgtatctcaagtgcctagagcattgtctggtacatggcacataaagttagctaggtagatgctagttgaaggatgaatgataaccagttacatgcagcagcatgcacccatgtgtgtggtgatgaatatcagagcctctcaacatttaatgactctcattaattttttttgagcaaataatttgagctttcggtttccttaccttaaaaaatgaagataaaataaatcataccagtgttgccctttagtagatgaaaatataatactttggattttgtaagagaccttttttattatttggggaaggttttagaattttctctttgtctttgatattaaacttcacaaatatgtctatgtttagatttttcctaatatatcatgttacatttttaaggggggactataatcctgcttcacataaggaaaacacttgtttcttcaaatatatactcttcatatgtatacttatttatttcattctggtgatgctattatgttgaagtcttatctggattttctctgagacaattcttctacattcatcagagtaatcaataactagttatgtcagatctgttaattaaaacattttttagtgttttttctagatatttatatttgtacttattattcctacttacttctctttatatttttctcctttatgttaactatgaagtcctcatttgggggttatatatttattttaaattttactgtatgagaaattaataatttttttatctgacaacatactttcattttgcttgtttcattttactttatttaaggagtttgtttttctcagacagctcatatttccctagacatattatctaccttttctttaaatgtatttttgtgacaagtattgaatccaggccccaatttttgccccttctataaatatacttgtggctatatcctacaattttgaaaagtagtttcctcttattaaacaatttttatttcctgatctctctatctctatttctttcatcaatggagtgagatcacagtctctcttttatattgtcctaataccatagcaaattagaaagccattttacagtttctaaatacatgattcttatttaggttgtttttcttttggtaaatagtctatttaatttatttatggtgccctaatggaaagtcacttaataaattgtgcatttgaaaagaatatgagtgcatgaatgtagttgaatgattcaaatctttacatctctcattttgtttacttgatatgttgaatttcccctaacattgtattgtgaatgttgtattataaagagaaagttgagagacttcttcatatacatgttcagtaaacactcatatacctatgaacatatacatgttcagtaaacactcatatacctatggcctctgtatcatccttatagcatatctatcctatttgactttgatttttaaagacttttaaagactttttaaaatttttaagtttctttttaagagatggagtcttgctctgttgcccaggccgaattgcagtgtttattcacaggtaccatgatagtgcactatagtctcaaactcctggcctcaagcaatcttcctgcctctgcctcctgcgtagctgtgactacaggcacataccaccccacccagaagacactttattttttcacatcagttttaggttcacagcaaaataggaggttaaggagctttcccatgtgcctcctgcctgcacacatacacagcctcccccttatcaacatcccacaccacagtggtacattttgtacaactaatgaacctacactgatgcataatcatcacccaaagtccatagtttatctcagtgttcactcttggtgatgtacattctgtgagtttggacaaatgtataataactgtgtccatcattatagcgtcttacagagtattttcactgccctaaaaatccgttattgctctgcatcctctccggaaactggtgatgtcagcgtttcatatttcagtcatacaagtaggtgtgcaggggtaacttattattttaatttatatttccctaacaacatacgatatggagcatcttctcatatgcttatttgccatctatatttcttccttggtgaggtgtcacttaaggtacttggcccatttttaattatgttgttagttttcttattgttgagttttaagggttctttttttcttttctttctttctttcttttttttttgagatgaagttttgcttttgatgcccaggctggagtgcaatggcatgatctcggcccacggcaacctccacctcccgggtttaagtgattctcctgcctcagcctcccaggtagctgggattacaggcatgcaccaccatgcccagctaattttgtatttttagtagagacagggtttttccacgttggtcaggctggtctcaaactcccgacctgaggtgatccgcccacctcagcctcccaaagtgctgggattgcagacatgagccaccatgcccggcccttaagggttctttacatactttaaataagtttttttttttctttttaatttagtgatggaatcttgctgtgttgcccaggctagtcttgaacttctggcctaaaacaatcctgccacctcagcctccctaagtgctaggattataggtgggagttactggacctggcaatggataagttctttatcagatgtatttttgtcaaatattttcttccagtgtgtggtttgtcttctcatcctcttgacattgtgtttcacagagcagatttctttaagataaagtttgaattttcaatgatttattttatgaattgtggcttttgtgttttatctaaaaaagttatcgccatgcccaacatcatctaggttttcccctatgtcatcttagggttttatagttttgcattttatatttaagtctgtgattcattttaagttactttttgtgaaggacttaaggtttatgtctatttattttttgcacgtggatatgcagttgtttgagcaccatttgttgaagactattattgctctgttttactgcctttgcttctttgtcaaatatctgttgactatatgtacgtgggactatttctgggctctagcctctcctgttaatctgtttgtctattagcaataccacactgtcttcatcactgtagttttataataaatgtcaaattcaggtagtataagtcctccaactttgttattctctttcactgttgctctagctgttctgggtcttttgtttcttcctttagctattaggaaaagtttcttaataaatacaaagtcacttgctgggattttgagtgggattacattgaatctatagatcaagttggaagaaccaacatcttgacaatatcaggccttttaatgcatgaatgtggaatatgtctccacttattaatttcttctttgatttttttattagagttttatagtttttctcatatatgtcttgttcatatttcgttagatctatacctaagtattttaattttgggtgctaatgtaaatggtgttgtgtttcaaatttcttctttttataatgtttagaaattattattttatttttaaaattttacagatagcattgtatatttttatcatgtgcccataatattttgaagtatatatacattgtgggattatgatgtctagctaattaacaattgcattagctcacctagttaccattttagtaggaaaagcactcaacatctactctttctgcatttttttaagaatccaatcatcattaattatagtcactttactgtacaataggtctcttgaatttatttctcctaactgtaatttagtatcctttgacaaatcttttcctattctctcctttcccctactctcctttccttctggaaaccacttttctactctctacttctatgagatcaatttttagaaattccacatattaatgagatcattcagtatttgtgttttgtgcctggcttatttcacttaacataatgtcttctgtagcacattcatgtagttcctaatgaaataattttattctttttatggctaaagagtattccattgtgtatatatatcacattttctttatcagttcatctgctggtggacactgaggttgattccatatcttgactattgtgaatatggttcccataaacatgggagtgcagatagctcttcaacataccaatttcattttctttgaatatctacccagtagtggaattggtggatcatatgggagttctatttttaattttttgagaaaccttcatactgttttttaaagtggctgtacgaatttacatttccaccaacaatgtgtgtgggttcacttttctccacatcctctccagcacttgttattttaagtctttttaattatagccatactaactgcattgaggtgatatctcattgtggttttgtttttcatttcccagaacattagtactgttgatcttttttttgtatatacctgttagacatttatgtgccttcttttgagaactatttatttaggtattttgcccatttttaaatcaggttcttggtgtttttttgttactgttgagttgctggaggacttttggttttggatattaacattttatcagttaaataatttgtaaatgttcttctattctgtagattgtctctttgtggattgttttatttgctgtgtagaagctttttaatctgatgtaatcctatatgtatatttgtgcttttggtgtctatgtttttgaggtcttatccaaataatcctccccagaccaatgttataaagctttctcctatttttttctagttgttttatagtctcagattttacatttaagtctgtaatctattttaagttgcattttatatatgatgagagataagggtctaattttagtcttctgaatgtgaatatccaattttccaacaccattcattgaagaagctgtcctttccccattgtgggatcttggcacctttgttgaaaatcacttaactgtacatttatagatttaattctggtatctctattatgttccattggcctctatgtctacttctatgccagtatcatgctgttttgtttactgtagtcttgtagtagtgtattatgaagcctgtgatatgatgtcttcaggtttgttctttttactcaaaattgctgtggctatttggtgtttttttttgtggtgtcataagaattatagaattttttttctgtttatgcgaagaatgtcgttggtattttgatagggattgcatgaaatctgtagattgctttggggagtatagagatttttatttattcttccaaaatgaactcaggctatctttccatttatttgtgtttttcttcaagtttttatcaatgatttatagttttcagtacagaaatcattaacctccttagttaagtttattcctaagtactgtattttattttatatttttgcctattgagaatgaaattctgttcttgacttatttttatagctgaaaaattagtatacagaaatgctactgatctgtatgttgattttatatcctgcaacttttctaactttgttaatcagttctaaaagaagttttctgtgtatgataacatggcaccttcaagcagggacagtttaacttccccctttccaatttggatgccttttattctttctcttccccaattcttctggctaaaacttccagtactatgttgaataggagtgccaaaagtggacactcttttcttgttctatattttaggggaaaagctttcaacttgtcctcattcagcagaaagttagctgtgggtttttcatatatggcctttatcgtgttgaggtacatttcttttgtacctaatttgttgagagttttgatcatgtaggatttttgaattttaccaaatgcttttctgcatctatagaaatgatcatgagtttcttgcccttgattctgctgatatgatatatcacatgtattgatttgcatatgttgaattcttgtatccatgggattaatcccaatttgagcatgataaattatcttttcattgtgctgaattggatttgccaggttttttttttattattatactttaagttctgggatacatgtgcagaacgtgcaggtttgttacataggtatacatgtgccatggtggtttgctgcacccatcaacctgtcatttacttaggtatttctcctaatgctatcactccccttgccccccaccccctgacaagccctggtgtgtgatgttcccctccctgtgcccatatgttcttattgttcagctcccacttataagtgagaacatgcagtgtttggttttctgttctgtgttagtttgctgaaaatgatttccagcttcatccatatccctgcaaaggacatgaacacattcttttttatggctgcatggtattccatggtatatatgtgccacattttctttatccagtctatcattgatgagcatttgggttggttccaagtctttgctgttgtgaatagtgctgcaataaacatacgtgtgcatgtgtctttatagtagaatgatttatagtcctttgggtataaacccagtaatgggattgctgagtcaaatggtatttctagttctatatctcagaggaatcgccacactgtcttacacaatggttgaactaattttcactcccacagtgtaaaaatgttcctatttctccacatcctctccagcatctgttctttactgactttttaatgatcgctattctaaacgggtgtgagatggtatctcattgtggttttgatttgcatttctctaatgaccagtgatgacgagctttctttcatgtttgttggtcgcataaatgtcttcttttgagaagtatctgttcatatcctttgcccacttttttatgaggttgtttgactttttcttgtaaatttgtttaagttccttgtagattgtggaattagccctttgtcagatggatagattgcaaaaatttcctcccattctgtaggttgcctgttcactctgatgatagtttcttttgctgtgcagaagctctttagtttaattagatcctatttgtcaattttggcttttgttgcaattgcttttggtggtttagtcatgaagtctttgcccatgcctatgtcctgaatggtattggctagcttttcatctagggttttttatggttttaggttttacgtttacgtctttaatccatctcgagttattttttgtataaggtgtaaggaaggggcccagtttcagttttctgcatatgactagccagttttcccaacactattaaatagagaatccctgttgcttgtttttgtcaggtttgtcaaagatcagatggttgtagatgtgtagtgttatttctgaggcctctgtttatagaatccatttgaaagtgttctttcttcttcaatattttggaatcatttaagaagaactggtgtaagatcttttttaactttttttataatatgaaaaattataatatgaaaaaactataaatcgatcaggtcctgggctctttttattttttgatagggaacttattactgattcaatttcttcacttattggtctattcagattttctattttttaataatgcaatttttgtaggttttatgtgtctaagaatttatccatttcttctaggatattcagtttgttgtcatataattgcttataatagtctcttatgatcctttgtgtttctgtggtatcatttgtaatgtctcctttttcatattttatctatttgaatattgtctcttttttcttagtttgtctacctaaagatttgtgtgtttatctttaaaaaaaacccaactctttgtttcattgaccttttacattattttttttctctattacatttacttgtgtttttttttcttattacttccttccttctacgaatgttttttttctggttccttgaggtgtagtgttaggctgtttattttagctctttctccttttctgatggaggcatttattgctgtaaacttctctcctagaactgtttttgatgtgtcccataggttttggtataatgtgtttccatttttgtttgtttcaaaaatttttaaacttttagttaatttcttcactggccctttgtctattcaagagcatgttgtttgtttaattctcatgtctctgtaaattctgcaaattttcttctggaattgactatctagttttataacattgtggtcccaaaagatattcgatagaatttcagtcttcttaaatttgcctagattatttctggggcctaatgtatagtctgtcctgaaatatgtttcatttgctgttgagaagaaagtatattttgcagcttttggatgaaatgttattttaatgtctgttaagtcatttggtctagaatggactttagatcctttgttgcttttttatccagatgatctattaattgatgaaagtggggtattcaaactccttactattattgttttgcaatcatttctccccttagatttattaatatttgctttatatatttagatgctccaatgttgagtgcatatatttttataattattataacctcttggtgaattcaccccttaatcattatataaagatcttctttgtctctttctatagtttttgacatcaagcctgtgtttttctcatataagtatagctactcctactgtcttttgagttccattttcacaaaatattttgttttttttcctttaattttatccctttccttataggtgaagtgagtaacctatggtcagcattttgttgggtcttgttttaaaaactcactcagtcccggcgcggtggctcacgcttctaatcccagcactttgagaggctgaggcgggcggaccacgaggtcaggagatcgagaccatcctgcttaacacggtgaaaccccatctctactaagaaaaacacaaaaaaattagccgggcgtggtggcgggtgcctgtagtcccagctactggagaggctgaggcaggagaatggcgtgaacctgggaggtggagcttgcagtgagctgagatggcgccactgcactccagcctgggcaacagagcgagactctgtctcaaaaaaaaaaaaaaaaaaaaaaaagattattcctaatagatacggtcttactttttgttttcctttgtgtttgtgcgttttctctagtagcatatttttattccttgctttttattttagtgtgtctattttaagattttgccttgtggtcaccatgaagcttacagaaaatatcttgtagctagattatttatcctagtaacaacttaactttgatcactaaaaaaaccttctaaactttaactcctttcttactttccacattttgaattgttgacctcatttatgtttatcatattacatacctttcaacaaattattttagttgttatttttaatagctttttatttaaccttcatagtaaagatataagtaattttcacactgccatttcttttttagagtattctgaattcgactgttttcaaatgtttttttattactcagtgatttttttctttcagctcgaagaactccctttagcatatcttataagccaggtctggtggtgataaacttgttcagcctttttaacattttttattttttgctttggaaagtctttctcccttatttctgaaggatagatttgctggatacattattcttggttggcagatttttttctttctctagcactttgaatgtatcatcccactatctcctgccctgaataatttctgctgagaaattttctgcatgctgtattggagctcccttgaatgtgatatgttttttatctcttatttctttgagtatttttctttgtttttcatttttgataatctgattatgatgtgctttataaactcctcttttgttgttccattggcagcctctgagcttccagtacctatttgttgtctttccccagatgaaaaaatttccagccattatttcctaaatatgttttttagacattttcctctctcttttccttcagaaacttctattaggcaagtgttagtttgcttgatggtatcctataattcccataggccttttccatttttgtttattcttttctttttacttctctgaattgataatttcgtatgtcatattttccagctaactggtttttctgcttgatcaaattagttgttgaagcattgtatttaattgttcaattaaattattttattctttattttgaggatttctatttggttcttatttatggtttccactgctttgtcaaacttttaatttgttcatgaattgttttccatatttcatttaactttttatatgcatttgcttgtaatttcttgaacttaagaggatacttctgaggtcttttttggtcatttcatagatctcctagtttgtacttgtaagcataaaggaaaatgagtatttaatatagaacatgtagaattaagtatttatcatcttgagaaaaatattctattattatttgtaattgtaattggcataataaatataataaaaagtaccttatttaatttcccaaatatcttattatatttttaagatattaccttataaatatgtagacagactaaaattgaatagcagtgtagaatcttgaacatttgagaacttgaaaaatgacatggttgtttttggattaacctttttcattcactcattaatcttttgttgactgaataaagatatccaagtgtcgttattatagtaattttctttcctaaatttcatgatttggagagcttggtggtaagattttttgctcattacaagtattgatctgggacagatctggtgctgcttaaggaaagactaataacatgtcccaagttctcctggttatttttatttaaatactgctggggaaaaggtggtggaaaattattttattccatttgtgtatataaatcactatgcatttttttactttttatattttacatgttatcttagcaaaaagaatattaatagtttcaaccaagcaaaataaatatgaaggctggattattaaaagtgacttttgcatttttaaccacattttatctttgaatttagtatcatatacaggagatatgaaaataaaagacatttatttttataacagtattaaaaatctattgaagtattgattgaagaaattcagttgaagtatttttgtaaacattgtgattatgtgggttattaagatacatacaaatgtggttttaaaattcaacaagagtaaggccaatatattttagcatgtgtaatttgtaaaaatacatgtttgtatttgtagtaaaacttatacacaagatcaaatatgtaaatattaaaggagaaggagttgtatatgtatgtaaattgtttcttatttgaatgacatttagatactgtcatctaggtttagctatattttacagtacaaatttaattaaaatatatgctatggaagtattttaatgattttaggttgaagttataaaaacattcccatatttatttctttccaataaggaaaatttgtcagagcatataacacaccatttattcttcacttcattattttatctaccttttcctatgtgtcttttaattcttaatatttactaaaatttctatatcaaggaataatacacagagcttttaccttcaagttatttagtattggaatagtgcacaaaattataaacattgagataatgcaggcagaataaagtacccaagtaggtttgagaaatgcaccatcagctttcactgaattatgaaatcccaaatactgctgaagggtcaacaatgaaagacagttgtactgagaaggtaaagttttgaacgtctcttcatttatatagagggtttccccttgatagggaactgaggataaatatttgaagaaatatgatggaggtttccagcaatactcataataattgaaacatctaattaaaatagggctaacatcattcatcagcctcacaatatcagctgttttccaagaacttcttatcactgggcctcttgtttttttatactaatgtatgtttgtttgtttcattcccctcccccaacctccacagaaaaacccttgtgaagagagaggatgggtgttcacaatttgttcacggtgactcagtttatccttatagggctctcttacttctccaatgagcactaccttctttttgtggcccttgccattatctgtcaggtgttcttggtgcgaagtggagacattctcttggccattgggactgtgattaagttgcacactactcatgtattattttttggcaaatgtgtccatcttagacatattgtgttcatcagctactatacctaagatgcctaagattctctagactgaggatcacagcatttcttttgttaggtgagctttgcagccctatttcctagtggcctgggctgggaagaaagctttctcactgttacggcttatgactggtgtgtggtcacatgtttctccctttgttacatcctgatcatgaacaaattggctctgtccagctggtttatgggacctgagcagctgggtttctaaatttcctcctcctccacgtagtgtctaccctctgcctgtctttctgcaagcctgatcgagttaaccagtattactgtgatatctcaccgatgggggccctgttgtgccagtccatgcacctggcaaacatgcttgttttagtggaatcagttatcttggggatcagtgcttttctggctgcctttaacttttacatatacatcatctccactatcctaaagatccagtgtgtagagtggagtgcaaagtgcttctctacatgcacttcccacctccttacggtctgtttgttctatggcatattgacatttacctacatttactccttctccagtcaacactcacatgtctaaggcaagcccagatctagccacagacaggctcatctctatgctatacagagttattaccctgatgtttaacttcatcactgacaacctgagaaacacagaggtaaaaggagcctcagaaaggttttatgtcattgaacatgtttatagaaaccataatttaaaatataatagaatgactcaatgttccacttttaattcatagaaaaagtaattttctattgatatatagaatgtatacctacataggcgtataaatttatagaaaatacatatacatataacttcagttatatctatttatatgtatatgtatatttctatttgtgtacattgggaacttaacatttatcagccaaagtagactttttttttttttttaagttctggggtacatgtacaggatgtgcaggtttgttatgtaggtaaacatgtgccatggtggtttgctgcacctatcaacccatcacctaggtattaagaccagcatgccttagctttttttcctgatactctccctctctacgccaccctccacccaacaggtcctagtgtgtgttattccctgtagactttttcagaataaatcaggaactgttagtagtaattacactggtataagatgtttaaaataggcctgtcttaggctgggcgcggtgcctcacacctgtaatctcagcactttgggaggcagaggcaggtggattacctgaggacaggagtttgagaccagcctggctaacatagcgaaaccctgcctctactaaaaatacaagaaattagccagatgtggtggttggtgcatgtagtcccagctacttgggaggctgaggcaggagaatcacttgaaccccagaggctgggttgcagtgagctgagatcgtgccactgcactcaagcctgggtgacagagtgagactctgtctcaataaataaataaaatggtcctatcttaagtaaacttggatctataacacttaactatattcatactcatgcttgtacccatagccatatttatgtctaccaatatctatattgtgtgtgtctatatggtttatatctggctttcaacctgtatttaatctagctgtaggtgttttctttaatttttttcttttaattgttcatttacacttggaaattgctaagagagtgaatcttaaatgtaatcacaataaaagataattatgtgaggtgatggatatgtaaattcattttgtttgataacttcacagtttatacctatataaaagcatcacattgcatactataaatatatgtatatgtgtgtgtgtgtgtgtgtgtgtgggtgtaaactataccttaaggctgggggaataagctaaagtggtcaacataacctattatatgataaagatatatctatgttggaaatttttctgatattgttatcaaatatgtaagatttaaatgacagtattttcattatattatttgtaacctgtgtaaatggaataaaatacccatttatggctatctggtgaaactgttgagaagtaaagcctgtgcattgatcacccttctatgtttgttgttattgatacttctcctttttgttgacataacatgctatgacttcttctgtagttttactttcaacctacttgttttgttactttatgtgagtttctcatagacagtttatagttcaattatgtatttttatccagtgtccaatctctgtctttcaatttgcatatattattgcatcatttacttttaaggtaatcattaatatgctacaatttgtcgactttttaatttgttttgtgtttgtttcttctgtcttttatttctctgcttttcatttattgattttctgatgttttctttaagatttttaaggattctaacttatgtatagcatttttattacatcacaatgtatagtttttttataccaactaatgttgttataatttttctttcaaccataaaatataatttaaggaactcatgagagaaatatagtatattgtaattatttctctttgtacaaaatttgttttttcctgtatgacattgtggctttcctatctctgtagaaaaccatatatactgtactcttaaaaatactaagagagtgggtatacagtgtttccaccatgaaaatgataattatgtgaggtaatgcatatcatatgttaattaactaaatgtagtcactccacaatgcatctatacttcaaaatgttaggctgtaaacaataatacataaattttatgtcaattatttttgaattacaaaaaaatgaatgcaagttgatctcaaaaagatgtcataaagaataaataaaatgagaacacaatatcaacaaattatatgaacctaacaaaatagtctaaaaaataaaccaatagtattctattttcagaaatatcaaatatgtaaataccttaataaacttgaaaatgcatgcattaaactaatactgtatactatactctcccaaaaaaagagtggagattatttaccagcacatataaaacaacttaaaaatggataatttatttcaccctaaaaatgagtctcaataaattccaaaggttcaaagaattacaaatattgtggaatgtgtaatacatgtatgcacatgtggatatatgtatatctgtacatataggtatatatatgtgtgagtgcacatttgtatgtaagaccattatgaagctatctctagattatattgttaagtaaaaaaaaagtataatgcagaaagggatttttaatatttgcttatattacagttatgttacatataacatataatgaaacattgcatatatacatatatataacagtttatgatatatataacatatatgtataacagtttatatccaaggttatataacatatatctaaggttatatatataacagtttatgatatatataacaacatgacattacatatacatatacagtaaagttatatataatatgttatatataacataagtgttatatatgttatataacatgttactaatatatgtcacatatataaaacaaaatgttataattataaaacaaaatgttatacgtgtaaaacatgaaatgttttatcattttctttatcaatttatctgatgatggacacaactgctccagatgtatttgtaagacaaaattccaacatgttttcataattgtggaaatatattgtaaaaatatgctttactaatcacagcaaatgatatatttcttccaacttgttataagatgtgttgtatattgtatatttttattatgtagcctcagttttggcattctcactctctcaacctaactttatttcatgatttagtttgtgacttcaaatctgcatttatgatacatttgctagtagatactcatagcaactgccatagtatagacacccatttctcatcccatctatgttacatccaaattttttcaggggtgccaagtgcctaattttagaatatactcttccaattggtacttacaacttgaaatggtgtaataatatagctatagccaatgagatgtagcttatacttactgggttatccttataaaaataataggcagtgcttcatttgcctcatgaaatctctgtccttagccttcattctacttgggttatggatgagacgcctagtaatacaaaagccattcatgatcctagggaaaacaatattgaagggcagaacaagatgactgaaggtgcctgtttcattgatggacccattgaaccgccatacacactattgactgcctgcctaatgtcagactaatgttgcatgaggcataagtgtactcactggtttaaaaggactggagtaatattctgtcactttttcctgaacacatggagactttagagtttgcccaataattttattcagtagagcacgatttttctccaatgaaatctaaataacgtaatgaggttcaaccccagagtagatacctcattatcacaatgctgtaagtgaatgaacccagcctattaagcaagggaaaatttatcacacacactacttctctccagctcacattcacataccaacaaataaatggcacaaaatacacaaaatgttttgtgatatttgcatgtatgatgtgcacatgcacatataggtaaatatttgtgtatatgcatatataagtattcgaagttatgtacatatttttggaaaatgttggaatatatattatgacatatatttatgtgagggtattgtgcatattgctttatgaatattcttcacataaagagtacagaattttggagacaatgagactgctaggaagaaggcaggaataagagggaagggaaaattggagtggaggtaagtatgaaaaaccagtaaaatctgagatgctctagaagatggttctggagtacagaagtgatgttgcatgttgaaactactagtgtttcagaaatgcaaacaccttcctaattcctgcctgcatctccctattctggaagctgtacaccatcgggtttaatgtgggagtcacaagagtatagagtgcagctaccaccttgtctctttcaaatgtatagctggaagcagggcggatataggtgtagattacaggagaatagtaaagggtcaccactgtgagatgagatgagcatgttgagaaggccttcctcttgccttctactgtgcggatacggagaatagcaacaatgataaaaccataggagatgcaggtaagaataaagtcccctatggccagggtaatatcagcaacatacaccatcacctcattgattcttacagggctacaggacaaagccagcaatgggggtatctcacagaagaagtggtcaatggtgtttggcccacagaaagtcaacctcatgataagagctgtgtgcacccaggaattggtgactgcaatagccatgaccatgctgagcaaggctacacacatatggtggttcataatagtactgtaatgaagagggaaacaaatggccacatagcggtcataggccatggtggtgaagagaaccatctcagctcccagagaccatgtgaacaagaagagctgggacatgcagcctgcatatgaaatggtattttctgatgttagcatggtccccagcatcttcggtatgatgcttgttgtgcagatgatgtccacaacagccagtgtcagaaggaaaacatacatgggcgtatgcaaggtgttgttatagattttggcaatgatgatgagcatgttgccgagaaaagccacaagatagacaatgagaaaaaagaggaagataattccctggagttcaggctttttggtgaggcccagaataatgaactcagttacaacgctgtgattcatcctgcttgggtgattgaatggcagtaattgcacagaataaacaactgaaaatggaaagaatccctgtgttgttaggagataacatgaggagtgtgtgtacttagggacttaattcttgattggacacaactttgcagcaggaattcccatttgatggagttctgtattccaggcaatatactctgttttccagactaatcccattctctgatgtatgttcctccattgatgactcaaactgaagccagtggttgagaagaaaaatattttcaaaatgccttcaaatattttgatatcattttcacttaaaacttgtctaaatacacacacacatatatatatatatacacacacatatgtatatattctggatatgcatatatatccaatggagctgtaatacaaattattacatacctcaataatttagttaattgcatggtacatttaggtgtccttgagatatacacgagcaaagatacttgaaataatacaagctgacagggctaattatagtgaggatatttcagatgaaaaatgcccaacctagtattttgaggctgtatattcatgggaacattgactaatgtatcacagtccaaatactaaacaatttaatcaaatgtctgtattagtagtttttcatcggtttgagaagcacattgccaaaattcactggaccagctatttgttttgctgttatataatggcaagataattggatttaaaaatataaaatgtagggttgtgtcttcatttcatcatagctatagactggccatttaagctctgtaagatttggatttattatttctaaacattgaataaattgaaataaatatcagatgttagagagacagagccatgatttctaaaggatacccaagcataaatggcaactggagttttctggaaaataatttctaggacacaagaaaaatctgtgtcctatgttattttcccccaaaacttccatagcattctgttttctgttttcttttactttcttttctaaaaaagatgggggtctcattcttacccaggctggtctcaaactcctgacctcaagagatcctcctgccttgacctcccaaactgcagggattacaggcatgagccactgcacttggttgctgtccgttttcttttatgcttatttattttggtacatttgtatgcacagacagttacacgaattcatggcttttggaactattatgattagatgaatctagtgaaagtattcaaaatagttgtgaatttagtcataaatttatgtttatcaatgttctttaagttttcagagatcatattgtacctctggtatctaaacagagacataaataaaaagtgtttttgagtgtgcgtccacaaatctagtctgttttgctctctcatgccttgtagcctcaataatttgttaaccaaattttagctactgataaattcatctttaactctttaaactggaagaaaaaaatagagcttttgtctaatccataatccatttcagaatctctagctttagtattaatttactcatactgaaggaatgttacagccaccattatttgggtctttgacatgtgacaggctctatgttaggtcctctgcagagatgatacaattttgtcctcacaagcacattgagtctttaatatttttatctttatgtagttgataagcaaacaatgcatgggagtaaaaataatagtaggtagattgtgtgtctcataagtgccaggattaacacctagatcatctgactccaaaaaatttgctattcacctttctactatatactttcaagcaaaacacaaaataatatggcaagtgtacacaaaaactaagaaatataagacagatctgaaagaatatggatttttattttgaatacgagatgatttggaagaggaaaatatagacaagatagttgattcttaaaatttaattcaaatattagaatctttgaaagatctgaactgaagtgatattaactaatttaaaaaatactatgtgttgaatatgttttcaaatagtaagcggttctggtctggtcatttcatcttaatcataaatctgacgtcaaagcttcttgagataaatttataagataacagacccctttcagctttttggtgatcttaatcaccaaaaacaggcactcaaatataaactgagctttcattgttgaagaaaaaagctttgtttttttttttcttggagaactgtcacttattaatgtaagtactgttatttatcaatgttatttatccacgtaactgttactgatcaattttcctaaagcagggtatgaagaaggagatcccagtcccaagtacacaagggcaagtttcaaaaaattcttaaagttcacaggagatggaaaagtgcacccctgttccaccatctctaagttaagagcaaaggcaagggaacctgaggattctgtttctcttttcttcttgtaatgtcctcacccccttctctggagttatgacattggtttgcttgactttgttctcactgcgggttccttggtttgggtggttattgtgtgtgaaggaggctgaacctggaatgacactgtgacacagttcactgtgaggagagggtatctactgactatgaaaaccttgttcaggatgtccatcattggcttaaggtggagatatgtactattttctatccataggtgtccaaacagtggtcagtagtttctcttgaaattctgcaattgatgttagtctgacttgcatgctactgtaggctccaaaaaagccacagtatccagaagaagagggcctgcctgcatcagcaggaaagtgtctttctccagaaatagaaagtctatttctatttgctgcaaatcaaaagccatttactcctggccgtgtccatccctggtcatctcctctgaaattatcaattcagctctagtaattatgtttaatctagcttagattttctattgatcaaaatctggaggcaagaaaaatcagtgaaatttagtttgaatcattataatacatatggcctaatcttgaccctgtctgtgaccttccatttttaagacattcttcaagcctcagtccatccccattggttaaatggagataacagtagtaaactcaccgagattctttgaggattaaataatgaatatgaatctttagccctattctggggacttattgagctaccaatcaaaggtaaaaataattattatttagagttccaaatatataattttgaaaaatcatgttttagtatgtgagtattcagtcgttaataatgagggagttttttactatttaatggaagaaatttccagaaatgtatttgaaaagattgaataaatattataataatttaagaataaccagattgggttagggcaataaaagataattcaattaattctataataattataataaaggtgactttattcattaaatatttaaaggccacagtttatgctaatcattatgctattagattatgacgatgtagaaaatgtaatatacattctcagttatttcagcatcagtgataaaacaatgaacaataaactaatattctttgggaccatgagaaaatcattggagttataaaacaattttatatagtaacatagcacacttaatttggtcttggataaaataatgaaaatactaaccaaaaacatgagtgtgatatctgaaaccctagcacccgtgatttttattgcttagtcaatattcctttatatttaccatttatactgttcttctttctcctgcatatcttcccttatatgggacaatttttattctcatgaataactctgcttttagtccacaggaatgtggtattgtctccaaaagtaagcaggttttgaggagtgcgattggaaagggaagaggaaagagaagataaattccaataaaactggcctggtgtgtggttcacacctgtagtcccagcactttggcaggctggggtgggcagatggcttgagcccaggagtttgaaaccagccttggtaacatagtgagacctcgtttctacaaaaaatacaaaaattagccggcctgtaatcccagctacttgggacgctgaggcaggagaatcgctggagcctgggaggcggaggttgcagtgagccgagattgtgccactgcactgcagcctgggtgacagagccagaccctgtcataatgaaataaaaataaaaataagaaaagataggactacttgagattattatattctaaggtaaggaattattttgttgttaagtagtcgataagggagaaattttagatttctgagagaggaagtagtatgtgacataccccagttttagaaagccagccctgaaggcatcatagaggatgaattcagagggagacagtatttgtccatcttaaatggagactgtgtttacaggcaccacctggtttgtagaacattatcaatttaagtttaacaataggatttatttataataatgaattgccagaataaaatgaaagtgatatagaattgccagaataaaatgaaagtgatataaaactacatacagaaaaaacttagaccattttgtctggcaggatgcagtgcactgccaaataaacactggcaaccttttcctggaaggagtgaattgaggtcacattctgtttacttactttagaacaccaaacatttactaataatacacaatgatgcttgatttatgtgccattcaccatgctattttgctgaatcatgaggataagtttaagaattaatagggccgggtgcggtggctcacgcctgtaatcccagcactttgggaggccaagacgggcgcatcacctgaggttgggagtttgagaccagcctgactaacatggagaaaccccatctctaataaaaatacaaaattagctgggcatggtggcacatgcctgtaatccagctactcaagaggctgaggcaggagaattgcttgaacctgggaggcggaggtttcagtgagccgagatcgcgccattgcactccgacctgggcaacaagagcgaaactctgtctcaaaaaaaattaataatatttatgtcactattttacatatgaagtagttggtgaaatttggtagttatcaaatgtgcttattgtcacacagtcagacactggcgacatggaaatctgaatccagggagtctaatgacaaaattcactcatgttgcattttataagccaatgttatacctatgtcaactccaacagcacagtttattcttatgtatccattacatcattatcatcatctccgtcttcaagtattttcatcttcattgtcataataaacaatatcggcacacgtttaaagggcctatgttgtctaaggcaaggtactaagaactccccacagcagccactgtgttttatggggacagagtgatacaaatttcctcgtactctcatattcctgaatgacttctgtcagacagtttcattctaggccactttctattaggtagggctacgtcagaggtgattctagttcaagcatcgtttaaggagaatgttacattctcttcagcttagcttcactgttgaagtactagaaaagaagtgaaagtagctacttcttaattttctaggtttcgaagtgatcagagaggtaggaaaggaagatcagtgtgaaggcagtataataaattgtaaaaagagaaaaggtggcggagattaaggagagtcaatacctgcatacaaatcatggccctaccctacaaaggataatcaaccacttggttagccagggattgtccaagttttgccactgaaagacccacatcctaggagacctgtcagtctcaggcaacctgggaaagttggtcaccctaggacatctgaagccaatgcaattcctgtctgaaagcattttattctctatgtttgggaagacattatttttcacatttacattgttttctaagttttggaagaaatctttttttttttaaattcaactctgaacatgccactcaccattttatagagtctgtcacagattcttatatatgtaggtagaatatgaacactaaatgagtaaatgaaacccttgtaaggttctatttttgagaggcgttttaagcagcttggagcatcctgatacaatgagaagttttgcaagctaattcttaaactatttagctaagtctttatgataattaaagaaaggacatattctaaaacaatttctcatacatgtcaagcattcccataacttggtaaagtatgttaacctaaatttagttgactgtcttttaaactccaacttttgcatatttgatatgaaaggaaaaattttgaaaggctggcaggcaatataaatacttgcatcatcagtattttgatacattgatagcataaaatcccctgttttgaattaaagtacaatccgcggatggattgtgtgtgtgtgtgtgtgtgtgtgtgtgtgtgtgtgtgtgcgcgctatggctaaaaaggaattaaatatgttacctggctcaaaaatatccctactcaggccatgattttatggtaaacttaagaattagacagtctgcccacaaatactcactgtagttttttgcagagtattgtcatgttcaaatggtgacctgtattaaatcactgtaaaaaactaaaagtacagtagctcttgccagtttgctatcaaatgagctctttcatgcttgctttagtattggtttatttatacttaagatcaatgaaaagcatggttcctgactcaaggacaagggaccccaaggaagagcatcttgaagtgatttgctattagttacattaaaatgtatcccagaggaacagtttttaaaaccctgaactaattaccaattatgatgttcaatcacttggtctttgtgtgtcaacctttttctgtgaagaccaaaaggtatcccgagataatgtcttcatggagtaggaaacctgaataatgagacacagtggaaatgctggtgggagatttaaagaataaatggatggacattgttataaaagcaattacatctgcttcggagatcttctcccaatataaacttagacagtgttaaaagaaaaatcttagacaagttaaatttaacagagttcatttgagcagagaaaataaaaaatatttatgaaccagataacattcaggaccaaaagcagtgcagagagcttcatcctacaaggcgttgcaggcaatatttatagctggagaaatggaaatgacatgcggaaataacttgattgactagagttctgtgtttgctttatttggatgttttggcaggtttcggcctacagttggctgaaggttaggctgctatgattcgctgagattttgctacttgttataatgtatgctctgaagttaggttgcaggttgtttacacattaagttaggttacagtttaccatgtacacaggcagatttaggacaaacagttcaatttaataagaggaagagtggtaggaaatgaattccaagatgaaggttaaagcaaagtttgtcatttagtcctctactctgtgcaggcctggaggatcttacaaataaaatatgaaatgcaatttggttttcatttgtttaatgtaacacgcaaacccttcagctaaatttctttctgaattgtttgaaaaactgttctgtacatccttttgctgtttatgcatacccaaacacaaatgcaactcatctgtgtgatgtacgcataatgaaataacattgtctctatccctcttgctgaatagcctcatagtttgaaatgttcattagaattcaaacacacatttacatgtttaccatgtatttctttctcctatttgtttatcttaaagaaaagttacatgggtaaatatcagatcactttaacagctttttaaagcttccagacagtgatctaaatgcttatttcacatttattgtaagcatagtattactaaatattagttaagtatatcaaactatcaatatgagagcaagtaaggggcaggaattatatgtagttgtcatcacacggccaaatagaaattaatcatttgcctttaaagagtgtttgctgttgagccagttgacataatttatcttgctttagtaatattctttacaggtaaaataacctactcatttccacaatgataaaacattgttgttttatcgctttgaacaagtacattaaaataatacagaacagttgaagatgtgatgactgcacaatgaaccagaataacattgaattaaatgtattcgtaaatgggtggagaggaggtatttggtggaaaaaaaaaaagctgaaatacttgagccaattaagtcccttgactccaaacccatccctacgcactcagatcttggatgctggattgggtgaaccctacaaccacatcgctgttagcgtgttggcacctcatgaactctgccagtagggggcaatagaggtaaactgtaagactagaggagaaaaaacaggtcccttccctgtttgcttctcctggtctttttggtgaagttctagaacttctagtattttgacttttgattttaaataccccaggatgattggaatttgccttattcttattttcagtctgtcaaattaagtcatgtatcattagaagcaatactgttgtatgcgccagagaactggttttatgatctatttgtagtagaagggctgccttgtcattatcaaaggttactcttcagaaaagttgcttgccttattagctatgtattctaatagcataacgactataccaactttgttttgtttaatttttcatggtatatatttttccatcttcattttgggtgttttcttcgtgttcatttgagaatgtgttaagtgtaatacagttttgttttttaacaaaatcagtcagtctttatgctttaatttcagcactttagttgcctttaatttaatttcagacacatttgtgtttgctttatgaatatattattgttatttggctcatctatgttctttctccctgttttatcttactttatcttattttattccacatttccatctatgaggtgagtagtcatgcatttctacaccgatttgagtgtttatgcatttttgacttattatggtcaagtagaaattacttattttaccactttctagagacactgtgcttttagaacactaactactttagtcccttctttgtattgtttttataatggattataattaaacgcatatctcaaaccccaccacccataacttttattgtttaatcagtctgtattcctttgcatgtgctcttatattgcttttttcattgttcttccactctcctgcccatttttcccatttgggccattttcttctgcctgcataactcttcttttaatgcaaacctacaggtttgctgacaagaaattctctcattcttttatgtattaaaattttttgttggtattagttttggaaattatgttttctgggtatatgattttacgttgactattgttttatttagcacattaaagatatacctaaattgtcttatagcattcacagtttatgttgaaaagtcaactgtcagtagtattgttgcttatttgaacaaaatgtcttcttttcctcttattgcggcatttaagcttatctttagttttagcaattttagtgtgatgtctctaggatatgattgaacttttatcttgcttgaagcttgccaataatatttatctgtgggtatcattatttatgctgcttctgcccccctttttaaatctgtgttcctcccagggtgaaaataacatgcatgctagaacttttcactatggtttttatcttacgtgttgtaccttccaattatgtttcttctctttaaatattttttattaactcatattcaagcaagtaatcagatcgtctactggatctaacattccgtcaatcccaaactattagctgttaacttcaggtagagtatttcatgcttttataattctattgaatattaattttagacatatgtatttacttctaatatttctagtttttctatctgcatcttttcatctctcatctctattttcatctcatattctcttcaacatattaataatagccatattattttatttgtttattgttgattcatcaaacttttattaaataaaatttactgtattgtaaaaagggaatttggggtagtttcttcaatggcacagttatacaaggtagctgcagactgatctctagatcttttttttccatttttcgaattttctttgcctatttcccaatctcttatcccctgaacacacacagacacacacacacacatccctacacactttgtgtccctttatggggacacacttacaatagtcacttactatgcaagtttacaagtttatggctagggaggacactgaagaacaaatgcttttatatacctttagtgggcttttttccacatttttcaagaacacaagacattgctattaactatggtcaccgtgttctacaatatatttctttaattcattccttctatccaactggaatttttcatcctttgacaagtatctccccagctgcctccccaccacaccaccactactatcctagcctctggtaatcaacacgttactctctttttctgtgaatttgactttttacgctccacatgtaagtgaagtcatgagctatttgtctttatgtgcttggcttttctcacttaacgtaatgctctccaggtttatccattctgttgcaaatgacaggaccctttaatggctgaatggtattctcttgtgtacatataccatattttcttacccattcatctatgatggacacttaggttgactctgtatcttgactattctgaataatactgcagtgaatacagaagtgcagatatatttttgacttagtgattcaatttcttttatgcacactcagtagtatgatagcagaatcatatagtagttttatttttaacttttcgaggaatcttcataatggctgtactaattttgtatttctaaaaacagtgtgcaagagatccctttttaccatatcttcaccttatctttcgtattcttgataatagccattctaacagatgtgaaggtgatatcattgtggtttcaatcttcattccccttcatgcttaataatgttgaacagtttctcatatatcaattggccatatgcatgacttcttttgagtgatatctattcagatccttggaccattttttaactgagttatttgtttttttctttttcactatagaattatttgagttacttagatatttttggctttaacctcttatcaaatgtatgattttcaaatagttttttccatttcataggttgtctcttcactgctgattgtttcctctgctgtttacaagctttgtagcttgatgcaatcacatttatttttgtttttgttgtttgcaattttaggatcaaatccaagaaagtcattgccaagaccaatttcatggcacttttctcttatgttttctttttgtacttttactgttttaacttttacctttgtgagtataatctattttgaattaatttttgcttacagtgtaagataaggctctaacttgattcttttgcatatggatatctagttttctcagcaacatttattgaagagaccgccctttccccattgtgtgttgttgacatatttgtcaaaaatcaattggctataaatacatgtatttattgctgggctctctattctgccccattgatctgtttgtttttatgtcagtaagttgttgtttggatgactatagctttgtaggagatatcagagtaatactgaccttgcaaaatgagtttaaagtaatttctttctattccaattttgtaattgtttgagaataattgttactaatgttttccttaaatgtttgatagaattcagcattgaagccatttgatcttgacattctttttttgatgggagatttttaccactgattcaacgtccttattcactattggtgtgctcagattttttttttttttaataataccgttgtggtaggttttatgtgtttaataatttgttcatttcctgtaggtgttccaattagttgacttataatagttaatgacagtattttatgatccttcatatttctgtggcatcagttgtgtaaggtcttttttaatcttttattttattgagtcttgtcttttgtttctaagttattttgtctattttttcaaaaaaattatttttttcattgctcttttgtaacgttttgtctctattttgcttatttctgccctaacctttattgtttcttttcttttaataattttcaatgaagtttgttcttatttttctatttacttgtggtgcaatattaggttgtttacttaagatcttacttttttgatgcaggtgtttattggcataaattgaattttgagaactgattttcctacatcccaagattttgatatgttgtatttttttatttgtctcaaaaatgtttttaatttgccttttaatttcatcatttaccgattggttgttcagaagcattttgttcagtttccatgtattagtaaactttccaaagttcctcctcttgttgattcatagttttatataataaaatacactataaattttaatcttgttaaatctgttaagacttgttacgtggcttgatgtatgatctattctagggaatgttccatgtgcaattgagaagcatgtgtattctgcagctgttggatggaatgttctgtaaacatctgctaggtccatttggtctagagtgcagtttagttctggtagattttacgtatctaggaatttcttcatttctcctagcttatccaatttgttggtgttttcttgttcgtaagtgtctcttatgtcctctgtatttctctggtatcagtagtaatgtctcatttctatttctatgtctcatttttatttctattttatttgagtctttcatgaggctgtttgtcaatttgtttatcttttaaaaacaataactcttaattttgttgctcttttccattttttgtctcttttatttaaatctgctctgaatcttatttctctctctctctctcttttttttctctaactctaggcctaatgtgttattttttccagttctttgaagtgtaattttatgtctttttttatttgggagcctctttctttttagatgtaggctttttttttgctataaacttttgtcttattactgcatttttaaatcccatacattttggtatcttgtatactcattttgtttgtctcaagatatttttaatatcccttttattttctatttgaaccgctggttgtttcaaaacatggtgttgaatttccatatatttgtgaattttctgatatttattctcttcctgatttctagttttatattgtgtactcatgagaaatgcttgatagtatttcagtcttttaaaatgctaaggcttgtgttgtggctaaacacatgatatgtcctgtaaagggtttcatgtgtgcttgagaataatgtgtattcttctgctattgaatacataatatacattctgtataagtgtgttataatttaatctaaattgtagttcatgtccaatgttttcttattgattttcttggtggataatgtatccattgttaaaagggagtagagaagtcccctgctcttattatatggcagtttatctatttctttatatgtactaatatttgcagatctgataatattaatattttaccagaaggtgggaagggaggagaggtgaagagaagttgcttactgggtacaaaaatacagttagatagaatatattctactgtttgtagcacagtatggtgactgtagttagcaaaaattaattgtatatttcaaaatagctagaagtgaagatttaaatgtttccaacaagggaaatgatcaatctttgaggtgatggatattctaattaccctgatttgataatcacacattgtatgcatgtatcacagtgccaatatgaaccctataaatatgtacagttacagttatactttgataaagatactgcaaaagttaaaaaatgaaaagaaagatcgaggaggagccaagatggccgaataggaacagctccggtctacagctcccagcgtgagcgacgcagaagacgggtgatttctgcatttccatctgaggtaccgggttcatctcaatagggagtgccagacagtgggcgcaggccagtgtgtgtgcgcaccgtgcgcaagccgaagcagggcgaggcattgcctcacctgggaagtgcaaggggtcagggagttccctttccgagtcaaagaaaggggtgacggacgtacctggaaaatcgggtcactcccacccgaatattgcgcttttcagactggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaatgcagagcgcctctcctcctccaaaggaacgcagttcctcactagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaaggttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactgcaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaatcactaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagacttcaaaccaacgaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaagtcaataaatgtaatccagcatataaacagagccaaagacaaaaaccacatgattatctcaatagatgcagaaaaagcctttgacaaaattcaacaactcttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcatctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacttaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagttaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcgtgggcaaggacttcatgtccaaaacaccaaaagcaatggcaacaaaaaccaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagtctggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaactgagagtataataaaaaaaaaaaaaaaaaaaaaagaaaagaaagatcatattaaaacaatgaggaaaaatcttgatgatattcatttataaagaacggatgtgttgcactgtgtaatagtgttaaaatacagtttaaatgtgcagttataaaaatgttgttactagtgagggaaaaaataaaatgaaataaaacaaaaacttaagcttggaaatagactctagcatacataatgttttggtatttaataatttttgcatttaaaatcagtaaagaagtaaattatctagaaagaaattgtggagtaattaattagtcctttgggacacaataactcagctcaaaaccacattctctaaaccaaaattaattacaaaacaaatatgatttcaaatagtaaaataaataaaactacagaagctatcagaatttttaagaattatcacttcaatctaaggatttacattcttgtctgaacacaaaagcaaatacaataaaacatgactaacaaaaaattcaaatttattattgaaattattgtaaagaaatacaatataaaatataaaaatattggaaaagaatatttgggatctatatgacaaactaaattcaatattatgttaagattacaattaatttagtggcttaaaataacaatgaaacaaatttattaacatacatttatatagtttagaagtccaagattggtttcactgggttaaatttaagccatcagcagaattatatttccttctggaggctgtagtgtagaattgattttcttgccttttttggtttctagaggccattcattttccttggctattatcagcttccttcatgtgagagctaggatcgttgtactaactccttcctgccctgccatctttctcgttctcttacatgtgcctccctcttctacttttaatgaatgttgtgattacatcaagcccacctgaatcatccagaataatctccctatttttagatcagctgataagtgaagttaattccatctgaaaccttaattctatttccccatgtaacctgacgtatttacatgttctagggattagaacttagacatctttgagagctcattattctgcttattataattgcatgtctcaaacatcattgatgaggcaagttttcattttaaaacaaaacttcaaaaagtccattgcttttgttatcacaaaaaaattgttaactgactcacctgaacatctttacatgaaaatatttatttttgaaaagactttagtgtctgaagtctggatcaagtacaaacttcacattcaactcacctgcccatgtctgggcaagtacaaaactcacattcaactcacatgcccatgtctggcaaaattgctacggtgaaactaaaactaaagtaaaatgtacaaaatagcagaataaactaaaacaaaaaataacataagccctaaatctgaagtagcatatttcaataaaccatcaaaaactgttaaaccaatctcatgcagtataattttctataaaccttaaggatatttgatgacaatacaattttttttaattattattatactttaagttttagggtacatgtgcacaatgtgcaggttagttacatatgtatacatgtgccatgctggtgtgctgcacccattaactcgtcatttagcattaggtatatctcctaaagctatccctcccacctccccccaaccccacaacagtccccagagtgtgatgttccccttcctgtgtccatgtgttctcattgttcagttcccacctatgagtgagaatatgtggtgtttggttttttgttcttgcaatagttcactgagaatcatgatttccagtttcatccatgtccctacaaaggacatgaactcattttttatggctgcatagtattccatggtgtatgtgtgccacattttcttaatccagcctgtcatttttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacgttttaatgattgccattctaactggtgtgagattgtatcccattgtggttttgatttgcatttctctgatagccagtgatggtgatcattttttcatgtgttttttggctgcataaatgtcttcttttgagaagtgtctgttcatgtcctttgcccactttttgatggggttgtttgtttttttcttataaatttgtttgagttcattgtagattctggttattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggtttcaggtctaacatttaagtctttaatccatcttgaattgatttttgtataaggtgtaaggaagggatccagtttcagctttctacatatggctagccagttttcccagcgccatttattaaatagggaatcctttccccatttcttctttttctcaggtttgtcaaagatcagatagttgtagatatgcggtgttatttctgagggctctgttctgttccattgatctatatctctgttttggtaccagtaccatgctgttttggttactgtagccttgtaatatagtttgaagtcaggtagtgtgatgcctccagctttgttctttttgcttaggattgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatgatggaaggacaatacaatttttttaagttgaaatgttggctgacttgtcatttggcaaattatttttttttgatttgacctcatgaagttgatttttcagttaactgtttctgtaagtgaggcttttaaaataaataaataaattagtaaattcaccttttgagcaattagtttgctgtgaatttggtcattcagtaaattagtcatgaatagattttgatgaattggtttagatcaaattggcccaatttgtagtaataagtcctaaggttctgggcaaggttaattaaggctgaataactctgggctagctgaatggtgagtatttttatttgccaagtggtatcctctatccaatgagactcaatctcagagcagtttgctattatcctgaactgcatggacatgctatgtttttgatcctcaatcaaggatcctggattcagtacaaggcagatgagttagaaaggagatttgagaatgtagaaatccctcaatgctaggatttgctgttttgagggctgctgaaaagggagatcaatgagaatgtcttggttacaagaaggaggtacctcagaaggctcaagagggaaagttggtaacaagggccccgtgtatgtcagggaaacagatgtgttctttcttctgatagggaaagaccacccacatgagcctaaaaagaagctgtggaccgcagcacagcatcaaatgcaagggctccttttggcagtctggctttacccatcctcagagcttctctggaaaaccaaagatctcctaatttttagtggaagatgggtgtggagagaggaaacaagcctcatagaagcctgtatcccataattaacctaaaatcagtctcagaagaaaggacttcaaaagagaggataaagataaatgaacttagacatcccaacagtgacagcagggcaggcagaacgtaggccatacataggctttctgacctccagagttgcttaacacctggtctttgtggcttctttcatactctgggagagaaatggtgtgctaccaagcaggagacattgattcaaagtacattctgcaggctgcaactctatctcccttataacctggctatcaaatcaaccaaggcgtgagggaaggtggaggacaagggagatgtgagggagcaggccttgcctgttcttggatccttgacagacagctcttctagcctttgttcaagattcctatgaagagtcttcattctgtaattgggtttacctgtgtagtcaatcagcggggtcacttcttgtcagcccccttccacccagtccccaagtgtcctgctagggcacctcctctttccatacaaatgtggcctccagatcaagaattcattgactatggtcctctcccatgggaggatgtacacataggaattgttcactctctatttgagggctgtgaagatgctgcaaatgacaactagaataaatacagagcacatgagctgtgaaaagcccatgactccgtataacaggaattcttgctgttaggtggcaggcttccctgtgtgtaccctgttagaaaaatacatgatattatacatgaaaaaccataatcaatgataaaatgaatatcaacaataaaataattcaacatggtagcaggatataaagttaagatgcaaaagtcagtagcattcatataacaaatggtagccataaaatgtaatgaatagttaaaacccaacttaccaaaaattgatctgaatccatgtgaagaaaaccataaaacatcctgaaagataccagatagacaaggcaaggactagaacagtatggaccatttcttctcactccactctactaagcacaaatataaaacctggacaactataaaagtgaaaccacagaggaacgtttaaatgtggtaggaagaatgcaacctagtttgggaacccaaaactggatgaacaacacagtgatggggtatcctagtcccccacttgactcaagaaggagaaacagacccaatctttttaaattcccaacataccaacaaacacagaccagctaggcttaccctcccacaggtcaaaccatactgcattactataagagcaagagcaaaatgatctcactaacaattagaaggcaagggaagcactctacactcttgtcaggcctgagaccctccaatccatctaaacctgctaaccctactgctgagcagagccagcaagagggactctaccaaaaggagtaatatttctggaaagtctctatcccccagcccctagaacagcagtccttaacctttttggcaccagggaccagttttggggaagacaatttttccacaggtggaggaggttaagggaggattcaagtgcattacatttattgtgcactttatttctattatatatatatatatatatatatatatatatatatatatatatatatttatttatttatttacaactcaccatgatgtagaatcagtgggagccctgagcttgttttcctgcaaccagacagtcccatctgggcatgatgggagacagtgacagattatcaggcattagattctcactggagtgcacaatctagatccctcgcatgcacagttcacagtagggctcacactcctatgagaatctcacgccatcgctgatctgacaagaggcgagatcaggaaccataatcgtctgtggccaggggattggggacccctgccatgggagaccccaaagtagccaaagaccaccagcaaatatgattatcccaaaataggcacagtgagaggtcaaggaaacctcttttctccagaaacctgatactcctctcccatgccaattgggcctatcactactgatccttcagctattgaaaagacaatacaaccaactttatgctcataaattcaacaacttagaaaaaagaatagaccaatttcttaaaaattgtaaactacctaaactcaacgaagatgaaagaggtaatatgaatattcccataaccactaaggaaatttaatttataaattaaagcctctgacagagacattttcagtccaaaatggttcactaaagaattgaccaaacttttaaagaaaatattaatgtggattttatacaatatcttatgaggttaatttttgttttgttttgttttgtttttgagacagagttcgctcagtagcccaggctggagggcaatggcacgatctcagctcactgcaacctccacctcccgggttcaagcgattctcccatctcaacctcctgagtagctggaattacaggaacctgcaatcctgcctggctaatttttgtatttttagtagatacggggtttcaccatattggccaggctggtgttgaacccctgacgtcaattaatacaacaaagaaaatataaaaacagtacacacaaaaaaaattacactatttcttatgaccagtgactcttatgagcctagatataaaatctttaacaaaatatgaaaacaaatctaacaatgtataaaaagtatgggataacacaacaaaggacatttactccaggtatgcaagcttagttcaatatttgaaaattaatagaatcaactatgttaacagggaaaagatgcagcaaaagcatttgtcgaaattcagctcttatttataatcattttatttaaaattttcagtaagtcaaaaatagacaaattatcttaacctgctgaagaccatctacaaaaaatctacaggtaacatcagacttaataaagactaaatgcttttccaaatagtagggaacaaggtaagaatgtccattttcatctttcttactcaataaaaaggtactggaagttctagcttctataataagagaaggaaaaataataaaaggtatagagatcggaaaagaagaaagaaaacaatctctagttgcagatgacattttgtctatgtagaaattcccaaagaatctgcaaaaaaaagataaacatccaattttaaaaggatcataagacatggatagatatttcactagagaggatatacacatggcaaataaacacatgaaaatatgttcaaaatgactagccattaaataaatgtaaatttaaactgtcacgggctatcagaatgactatttttttttttaaatcaggataaagaaaaactggattgcttatgcattgctagtgggaatgtaaaatggtacggtgcctctggaaaacaggttcatcaggttcttataaaactcaacatgcaattattatacaatccgacacttctactcttgggtgttaatcccacaggaatgaagatacatatatatacatatatatttcatatatgcatatatgtatatacatatatatgcaatatgtcccatatatctatatatacaatatgtcccatatatctatatatacatatatgtcccatatagctatatatacatatatgccatatatgtgcatacatatatgtatacacgtgcatacataaatgtcccatacatgtatacatgtatacacatacatgccccagataggtatatgtgcatacatgtcccatatatgtatatgtacatatatgtatgcacatatatgccatatatgtatgcacatatatgccatagatgtatatatgtatatatacacatatgtatatatgggtatataaacatatatgtcatatgtatatatacacatatatgtcatgtatatatacacatatatgtcatatgtatatatacacatatatgtcatttgtatatatacacatatatgtcatttgtatatatacacatatatgtcatttgtatatatacacatatatgtcatttgtatatatacacatatatattacaaacttgtacatgaaagctcgtagatagaagctttcttcataattttcaaaaagtgaaagcatcccagaagtccttcaataggtgaatggttaaatgaactgtgaaacatacatagcatcgtatgctacttgaaataaaaagaagtaaactattgatatacataacaattttgataatctcaaagaaaccatgctgagtaataaaaggtaatactataatattacaagttgtatgatccacttataaaacattgttgagataataaaatgttaggaaaggaaacagattggtggttgccagcgataaaggataagcagtggaaaggaagtggttgctataaaagggcaacataagaggtccttttggtgatggaactgtttattatctttgctacagtggtggataaaccttcacatgtgataaaattatacagaaataaattcacacacacaaataagtgaaagtaaaactggggaaattggaataagattgtgaattttatcaatgtcaattgctgtttgtgatattgtactaaagttttgcaaaatgttaccattgtgagaaactagtaaactgtaccaagaacctcttagtattatttcttaaaactacatgtgaaactaaaatgaccttataataacaaattttaatggaaaagtatacttgcataaattgaaatgtaatctatgttctaagttagaaagtctcatgaaatggtcagttctaaagttatttttatacatttaatacaaaagcaatgaaaactgcaagctttttggtcaagctagacacatgatcctaaatcatgaaaaagtaaatacgtaatatcaactagaaaaatactgagcagaaatagttaggaggcaggatttgctgtattaaattttaaaattactgctgagagtataatagaataatgaggcattggagcctgtttgaaaggagagaagaaggaaagagaccaggaagtgaggggagggagatagaagacaaacctagaaataggtcctactacatatagaaatttaacatatgataaaatcactattgcaaattactagggcaaagatagttttttaaatatatggagttagaacaactgtatagttatttgccagaatcaaaattagattcattcctcatgttaaccacaggaaaaaaaatggttcagagatctaaatgtaaaactggaaatgtggcaattacaaatactaggaaaaaatggattttttttctgtaatctcagagtagggaatggccttctaaccaagacttaaaatctatgtgcaatagaaatataatctgtttgactacataaaattaaagtaaaatacaggggaaaacaccatgagcagttaaaaataatggagaaaaaatatgtgtggcatacattataggtgaaaggctaacatccttaatatataaaaagattaaacattgactaaagatttttaaaatctatggaaaattgcaaaagatattagagcaattcatatagagatatgaaaatcgttattagatatatttttaatggtgaatttcacaataataagataaatgcaaattaaaacaaccttaagataccacttctcatgaaactggcaaaaatgcaaaaccttgacagggcattctgttgatgggaatgtggagaaacaggcattctcacatattattcatgataatacaaatgatgcaaccccattttggaaatttgggttatatctaacaaaactaactaaacatcgacccaataatttgctgataaccagaaaatagatctctgacagtacaaaaaagatgtagaaaattattcatcatagcactatttataattgctaaatattgcaaaataacttcaatattcaggcatagaaaattgattgaataagcttttgtacatctacacaatggaagcattatgcaaatgtaagaaaagaatgcggtagatctgtatatagcgtttcaaagaaatattgctaagtgaaaaaagctaactactaaaaaatatagagtacaacctcttgtatagaaagaaaaggaaaatagagaaagcatatctgctagcctacaaatgaaaacacagaaaataaaagtaaaaaacattttagtgtattagctacaataggtgaaaagtgggaagaagtaaaaggtatagggcagggaatatcccttcttgcatgtatcttcttgtgcatttttgacttgtgaagcatgttaatattcttcatattcaaaacataaaatctataacaatgagaaacatggaagtcctaaaactgaaagaaaatgaaagcaaataaactcaagcatacttgaaatgaatatcagatacacactgaaggaggaaaaagaagacagaataaaataacaaaaccagcttagtaataatatagtccttgatcatatgtaatgttatgggtggggtgaaatgtgggagaattgctagcaaatcctgaactacttttaataaatgtatttgtttatttatctaagttttgttttaaattctggggtacatgttcaggtttgttacgtaggtaaacttgtgtcatgggggtttgttgcacagattatttcatcacccaggtattaagcctagtagccattagttatttttctggattctcttcctcctcccaccctccacccatgatacgccccagtatgtattgttcccctctatgtgtccatgtgttctcaccatttagctcccacttaaaagtgagaacatgtggaatttggtttctgttcctgggttagtttgctaaggataatggtctccagctccatccatgtttctgcagacgacatgatctcattcttttttacagctgcatagtattccatggtgtgtatgtaccacattttctttatccggtctatttgtgatggacatttaggttgattccatgtcattgctattgtgaatagtgttgcaatgaacatacgtgtgcatgtgtctttatatattgtaatgatttattttctttttggtagatagtaatggaattgctgttttgaatataatgactaaatataatttaattttaccctcaccattgtacaaaaattatgtgtgcatagatttaatttttagattgattgttatattccttcagtgctgtatttgttgtacaaaggcaatttattatggttaaacctatttttttcaaacttctattttccctgatggggcatctattgtttttccactgccagtaatttattactggaagataattctgaataatatgtattttatctacaaatgtatcatcgtaagttataggctaaagaaagaagaaagaaaagtgaatcagaattctagtagtcaagtatatttgcttgaaaattaattatgcaaattatgcttaagtggggtgtgtttttaaatcagtatagaaagaaaagacctgagtcaatgaaagcattctgttcatttcgatactccttcacttaacattaagttttagatacaattccatatcaaaatgattcattcacttgaaaagctgaagactacattcttcttttcagtactgaggtgagtagcagaagtagagaggtgttgaagataactcttgttgagatagatagtaggtgctgcttttggaggttttggaaattgaggcctaacctatggaaacaggaaggctattcatcctcagagggtagcaatctgatttttattaggaattttgatttttagaaatctccaagaatatgtttaggaatgccatggatctgaaactaatcctcagaatgaataaatgaagggaacagatcaggtacgcagtgttttttatgagtactgtattagggttctctagagagacagaactaataggatatatattaacatatatatacatgtatggagagtttactaagtattaacttacgtgatcacaaagttccacaatcgggtgtctgcaagctgaagagcacggagaaccagtccgagtcccaaaactgaagaacttggagtcctatgttggagggcaggaagcatccagcccaggagaaagatgtaggctgggaggctagatctttccttttcatgtttttctgcctgctttatattccctggcagctgattagattgtgtccactacattaagggtggatctgccgtccccagcccactgactcaaatgttaatctcttttggcaacaccctcacagacacacccaggagcaataccttgtatccttcaatccaatcaaattgttgctcagtattaaccatcacaagtccaccctttgtcaacttgaacccatacacatctcctgaaatcatacctaatcttcaaataaagacaataataaggtcataattatgcctaacataatacaactatccctcatacaactggaaacacaccaatccccaactcaaatactattacataaagttaacaatatttaaatgctgatatgaagtcaataaattttatgtcacatgataaaggaaaaaagaaataaaatacagatattttctcaatacaagtgtatacatgcacaaacatgtttttaacaaaagaaggaagacatactcatgacaattacagtccccatttctgcagctggtcatgtggtcacagttggtactgatgactaccttcttctattacccattctgtattccctttgccctcagcaagcacctcaacacatcgtggttattttcctgatggagtgacccaaactttcattcctgaagggtctgggccatttgtagtcctgcctggattgggctgttgtagtttcccattgacattaatcacagggcatggtaatactaagagatgccctcatggatctcctggttttcatgcatactcttcttcacctccgttgtggagtagtagactgatttcatcttgatagcctgggccaatcaccccagccaacacggtaacttccttcttagcctgttgacttaaagataggaggagcccaaagtgtccaagtggcaatcttaacttccagtttaataggatcattgttgtgtctcctggtggcagcattcctccctctggaacaaagacctctagacaagaagaacgtaatattgtgggaacaggaagcaaaaattttgctactggatcactaggagtgatggtgggtggtgccacttccatttccacccactgaatcctggatccgtgaatcctggctatgggagaaacagtaccatatattggacgctgattcagagcatacatggccttctgaagaactttgccccagccgtgcaaagtactgtcacctagttggcattgcaattgtgacttgaaaaggccattcccccattctatcaatccagctgcttcaggatgatggggaacatggtaagaccagtgaattccatgaacatgagccactgctgcacttcttcagccataaagtgagtgccttggtcagaggcaacgctatgtggaataccatgacagtggataatacattctatgagttgatggaaggtagtcttggcagaagccttgcatgaaggataggcaaactcccatccagagtaagcgtctattccagtgagcacaaatctctgccctttccaagatggaagaggtccaatataatcaacctgccactgggtagctggctgatcaccctgaggaatggtgccatatcgaggtctcagtgatggtctctgctgctagcaagttgggcactcagcagtggccgtaacaaggtcagccttggtgagtggaagtccatgttgctgagcccatgtgtaacctccatccctgccaccatggccactttgtccatgggccaaagacgtgggcgatgacagaggtggctggggaaagaggctgtgtggtgtccatggaatgggtcattctgtccactttattattaaaatcttcctctgctgaggtcaaccattgctgagaacttacatggggtacaaatatcttcacagtttttgtccactcagagaggtccacccacatgcctcctccccagatttctttgtcaccaattttccaatcatgcttcttccaagtccctgatcatccagccataccattggctacagcccatgaatcagtacataatcacacatctggccatttctccttccatgcaaggtgcacaaccaggtgcactgcttgaagttctgcccactgggaagatttcctttcaccgctgtccttcagggatgtcctagaaaggagctgtagtgctgcagctgtccactttctggtggtgcctacatatcatgcagaaccatcggtaaaccaggccctagtcctctcttcctctgtcagcttatcatagggaactcctgatgaggccatcggtgcaggctttggggagagaaggcaggtggcaggagtggagactatgggcatttgagccatttcctcatgtaacttgtgccttcaggatctgctggagcctgatcccatatatactacttccagttgatgatggaatgctgctgtgcacaacccactttatggctggatgggtcagaaagcacccagttcatgataggcagttcaggtcgcatgttgacttgatgacttatagtcaatttttcagtttccaccaaagcccagtaacaggccaagagctgtctctcaaaaggagagtagttatctgcagaagatggcagggccttgctccaaaatcctagaggcgtccactgtgattcacctatggaggcctgccaaaggctcccaaacagcatcactatctgccactgacacctcaagcactattggatctgctgggtcatacggcccaagtggcagagcagctggcacagcagcctggacctgttgcagagccttctcctgttctggaccccactcaaaactggcagcctttcaggtcactggataaatgggccacagtaacccacccacatgaggaatgtgttgcctccaaagtccaaataggctcactaggcgttgtgcctctttcttggtaggaagggccaaatgcagcaaattatccttcaccttagaaggaatatctcaacaggccccataaccactggaaccctagaaattttactgaggtagaaggtccctgaattttagtcagatttatttcccatcccatcctttggcatgcaaatgtctcaccaataagtccaatgtgtttgctacttcttgctcttttgatccgtcagcataatgtcatcaatgtagccaatcagtgtgatatcttgtggaagcaaaaagtgatcaagatctctctgaataagattataacacaaagctggagagttgatatatccctgaggtaggacagtaaaggtatatttctggccttgccagctgaaggcaaatttcttctggtgtgccttatagataggaatggagaaaaacgcatttgccaagtcaatggctgcatgccaagtaccaggagatgtgttaatttgctcaagcaataaaattacatctggtacagcagctgcaattggagtcaccacttggttaagcttaaaataatccactgtcattctccaagatccaaatgggagagttgaatggggatgtggtgggaatcaccacccctgcatctttcaagttcttgatagtggcactaatctccacagtccctcaagggatgcaacattgtttttgatttactatttttctaggtagagcagctctaattgctttcttttggcctttttcaccataatagccctcatcctaccagtcagggagccaatgtgagggttctgacagctgctaagttctgctaagttctggcactggggaaatgaccacaaggtaagtctggggacccactggacccactgtaagtcagactgagctaaaattccattaattacctgacctccctaagcccctactttaactggaggtccacagtgatattttggatcccctggaatcaatgtcagttcagaaccagtgtccagtagtccccacaatgtctgatcatttccctttccccaatgtacagttaccctggtaaaaggccagaggtctccttgaggaaggatgggagaaagactcactgcataaattgttggtaatgtagtggggtccctcctcaaggggaccgagcctccccttcaaggtagctacgcccactttgccttttacagttgagtgctgctgcttggcccctgactccttgggatccaattattttcattgtatttaaattttgtagttgagtaactgcagttcccacagttagatgtgacatacagagaagagcaattacagagctcttcaaagatgcaggtgctgtcctcacaaatctaattcgcaaggcattggtcaagcgtatatcttttggaccctcccagctgggatgagtaggtctaaagtgactaatccaccctaccatcccaatctccctaagcctttggatctgttcctctgcattaaaccaacagagatcaggcatttctagctcactcacagtgggccatatttcagctaaacaaacaaataaactattagaaccttttttagctccctgatctgcaacattaaaagcagggtccctacttagtgggcccaaatcaataaattcagcctgatccaactttatgttccttccaccattatcctatacccttaatatccattccatgcctgttctccaaatttctgtttatataaattacagaactcaaacagttctttttgagtgtagcacacctcctcaagggtcacactctcaacctcacctctaggggcccactgcgactttagtctagttataggtctggaagtaaacagaggcattgggggtggctcctgaggagaatcaacattatcttgcctggcaactgcatcaggggaggccatcactattgcctcggtcagatgttcaatggcaggaagcatccagcacaggagaaagatgtaggctgggagcctaggccaatctctccttttcacgtttttctgcctgctttatattccctggcagctgattagattgtgcccaccagattaaggttgggtctgcctttcccagtccactgactcaaatgttgatctcttttggcaataccctcacagacacacccaggatcaatactttgtatccttcaatccaatcaagttgacgctcagtattaaccatcataggtaccttaagaggtagactttcgacatagatacaacttctgaaagttaatatgcatcattctcacaatgagatatcttcccctattttcttcagacatatagctttcttgttctgtattataccactttacttttgaaaccagaaggggtttcaaatcatacaaacaagcaaggtctgaagagtagcttcttttcttttttttttttttgagacagagttttcgctcttgtcgcccaggctggagtgcaatggcgcgatctcggctcactgcaacttccgcctcctgggttcaagcgattgttctgcctcagcctcccgagtaactgggattacaggcgtgcgcctccacacccgactaattttgtatttttagtagagacggggtttctccatgttggtcaggctggtctcgaactcctgacctcaggtgatctgcccgccttggcctcccgaagtgctaggattacaggcgtaagccactgcgcccggcctgaagaatagcttctattcagccccttaggcatttctttgagaagcagactactttgtctactttgtacacatgtgagtcaatatgagtaagacaaacagaatatccctgtagcctatgttagcctgctggagcccccattttccacagccatacaataatgaggaaagggaggagaagggacctatcatgtgttgatggttgaaaaggaaagtattttgctttctgtggaatgcagtactttagaggaaaatcagatagttattacaattattgtttcctatggttatgttttccctgaaaccactggatgttctatacttgctgacttgccaatggaatctttagtatttttccttttctatgatcaatgttgttatgcaagaaacttctgttgctttgttcaaactctcctgcagtcccgtttatctacttttcatcctccactttttggattgctttgttcactatccttgtgaaacaaatgtggcaccttgtaatgatcaagttctaattccatatctgtctgtttgactataccttatcaaaaaatactatgctgcaataactgcacacactctaatttcagttacatgttttaattcatttaacctttgcctatttctcttccctcgtgttccacaaatgtagttctcaatattttatactaagacaattttgctaatctttaaaaagaaacaagaatttagagctgatataccaaagcactctttttattgcagatgtctctaatttataaaccaaagtccagagcaaacctaattcaatgtataattattttttgcttaaaaatcccatttgcttatgtcaaaaactcccatttttatcatacatgataatgtatagaaaatacagtattgcttgttttgtttgtttgttttttctctgtgtaccaagaaagatttgccctattcctccacattcttacttggaacctctgtatagatgcagagaccatttacaggacatctgttgtggtagaggagatttattttcccttccatttcttcagcagagtctctcttacttccttattacgaagcgtatagatgaaggggtttaaaactggagtcaccacagtgttcaggacgtggacagctttgatcagatccaaggcatctttgatagaggtgcggacgtgaaggaaaactgtggacccataccaaatgagcaccacggtgagatgcgaggagcacgtggagaaggctttgctccggccactggcagaggggatcctgaggatggtgctgatgatgtacacataggagacaaaggtgatgaggcatgaactcaggataaccacaacagcaatcacaaaggccacaagctctactgcctgtgtgttggtgcaggccagggcaatccagggtgcaatgtcacagaagaagtggttgatggcacgggggccacagaaggacaggccactgatgagggctgtgggcactgcaatggccacgaaaccacacacccaggagcccagggccagctgcgctgagagcaggctactcatgatggctccgtagtgtaaaggatagcagatggcaagacagcggtcataagccatggctgccaggaggaagtactctgtgcagcctaatgagaaaacaaagtacatctgcaaaagacagcttgtaaatgatatggtctgacttctccccagtaggatggccagtgctttgggcactgctgctgtggtataccaaatctccaggaaggagaggttgctcagaaagaagtacatgggggtatgcaactgatgggaggtgctcaccaacatcaagatagccacattaccactaactgtgaggatgtacatcaccagaaaaagcataaagagagagagctgaagagtttgagaaccaggaaagcccagtaagagaaagtcctggggcagagttttgttgcctgtgtccattgtggtactgaaaccagaaaacagagtccccgcactgagccctttaacccaatcacacagtcctagaaagataaaaagaatggattcatgaaagagctccaataattaaatgtaattattggagatatgatgtaactttcattgaatgcctgctctgtgtttggaggcatagttaatatcagttattttaatgaaacagtgagatatgtattattataaccaattatcagtttagaaaacaaatgtgcaaaaaacgtcagcaattctggaaagactgcactaatagctacatttcagctccaagattcaactccagtctttctgccttcatcccactctgagccacattccagctcagtcccagattacatctaaacccagaaagcgctgactgaatttactacattttaactagactctgcatggcccctggctgaaacatgtaattttgtctttgtttagaaattggcccagtaaacctaagttctagtcacatacgtatttagcagttgtagcttctaaattgatctaattcataagatttgtcttcaaaaataatgttcaaaagtcaccaaaggtaactttaaaattagtttcaaaatgagttttgtcttctcttgatgatttcatgtttaaacattatatgacagatacttctcatcaaaaaaaatatatttccatattgaacaatacactgaagctaacagtctaggaaatcctgatgcccacttggaagtgagtacactgaaagcaggtgaagggcaaaaaatcattgtgaaaccagtttttaaaattctcatagtttatttctaagcactagttttgagaatagagtctgtaaattcgaaggtcaattgggaagctattactgtcaaacgtacaggtgaccaaaacctatgtttaggagacagagttttgaagaaagacagtgaagactttggcggcttcattctaggaattcccttataaatagaaatgttctctctccatcctcatgtgtcctaccctcgcgttcaccaacgccgaatgttgtttcccgcataaacccaaagctactgcatgtatccactgtcgctaagggcatttagactataaaatgggtctacaaagtaaacggtgcatacattggctttacctcattgatggcagaaggggcttccaagcagtgcttctcaagctctaatgggcacatgaatcacctaagggtattgccaaaatgcaaattttgattaatgcacccttgacatgcagcctatggtttttcatttcatatgtttccaaatgtcactggccaggaccatacactgagaagcaaggatctagcatctttctcattttataaaaaggtaataaatctgcagctttgcttgactgggtaatgaagaagtacagagtatgccaccataaaatgtgctcctctggcactggattattttgaactgaagacaattgtgaaagacaaaaaatagagagacacaagaaaaactctctggccgccccctttctaccaggaaggattggatgatttttaatcaccaaagacaactctagggtcttatcatcctagagaaggcaacagaggaatatactcaacagaccttgcttaaataacccttatattccactaatctccccatatatctaccttcccacaattcatacccctgagaaccccttcctttgtcttgtcgcttctctacaaatttattgtatttttgttaaaatactatataagaccaagttctaaccaattctttgaattactcatccctgaattctcccgtgtgtatgtgcaacgcacttgtcaataaacttctgtttttttgttgcttatatgtctttggtgagtctaaattgcaggattccacccactgaacctaagatgggaagaaggaaaatatttttttcctcctttacactggtaaaggagcctagattatgaattcattaccctaatacagaaaaaaatgccctagatactgatgggtgacatagaataagaaacacaaagaaagggtgttctttaacaataaatactaaataatatatttgcagatttcttaaagctaatatattccaacatatgtgtcattcacggccaaccagtacatgtaataactatttttgaattcaagtgccaatgtcaactgttaatgtcttttggtataatccatttttttttctttaaaggtcatcagggagcattgttaagaacagcaaaaagtagctaacatagtgaatggtgaattgccagtcactagactgttagctaatgtgatctttgtaaatcctgttagcttgcttttatcctacttgtttcacaaatgagaaaaccaaaacacaaagaagctgaagaagttattcaaagtggagccatgactgtcaatccaagacgtctgattctggagccaaagcactttgaacttgaggctttcagatattttttataggttcctacggcatctgattggcagattttaaaaatattttaatttatgttccaatagaaatcgctgggcaaagctattttgaaaagctagtatgaaataattctatcttaattcttaacttctatgagtaatgtgaataaggcaattatactcataattttctatattcaaaattcaaaaatcattttgataactaaaaattataaaataaatatccagaaccatattatgaaatgacatttttgtattttacttttacttatgctgctgaatttgtcagatgccatgacctaatatttacgtgaagcacatgatgatcaaccccacatgtgaaaacctgtatatattgctctagactcgagtgtttctcgttttacttctaagacagcctaaatggaaatctgtggatgtgacttaacaagagcttaaaataaaaatcagagaaaaatatagtttgatttattaggttgaagtaaattaccttttaatttttcagattaactaacagattaatctttcttatataagtcgattgaatttttaataatttttttgtttgagtataagtaattttaatttcttacatctgaaaaataattttaaatacataatatgacagttattttttcatagaaacatgcactatcttatttaaaaacacctacattaaaattgtttcttactctcaggaggttttcagtattgattgaatactataatggatcaatcatataccacaattttgtgattacaaatttacccatctggcggacgtggtgactgacacctctaatcctagcactttgggaggtcagggcggggggatcacttgaggacaggaatttgagaccagcctgggtgacatggtgaaaccccctctctactaaaaatacaaaaattagccaggtgtggtggtgcatgcctgtagtcccagctactcgggagcctgaggcaggagaatcatctgaacccaggaggcagaggttgcagtgagccaggatcgcgccactgcactccagcctgggcgacagagtgagaccctgtctcaaaaaaaaaattagaaattacccattgatgaaacactggacagaacttgtcgaatgcataatcacccttttcacttacccagttgaaattctttctgccataaactccaaaagctttgtctcttgaccttacttttactcattttttattccatgattttctttatttaaaaataatatattttgattgcaattattccctctatatctctgtttttctttgattatcttgctgtttaatagtgtgcttccttcggttgacatccattactcctttattaactcaaactttcataatctttgaaattagagctcagtctttttctgtttccttttgttcttatgctctgaccccattctgtcctagttccattccacttcccttttgttgttttatattttctccatctctcttcatcataattggcacgactctggaaaccacttgtttttaagtaattgcttatgtacggatgaatcttctgggagatgaagtctctctcaggtatctagggctagttcaaaaagacatgatgcccttgcactaaatctttccaaatggatgacttcagaatgttttcagttatttaatttaaacaactaaattgtaaagttattggaacaggaaaaggatatctctttgggctttatatatgctaatctaagtattttgtcttgcggagagtttttagcaaatacagccatttaataagttcaacaagtttgtgaaaaactctttaaaacagatcaaacagaataaaattggacaaatgaccttaactaaaaatataattaagtactatgaagcatgatataactagaaatttaaaattatctctgaattaaaaaaaaaatctgcctggctgttcatcagactaaaatagcaagggaagaaaaagccagttataaatatatcagaagacaattttacccaaggacatgttggagttgtaaattgtcataatgattctcttctttgagtgataactgttttctcactgagaaaatttcttatttaaaaatctttcacatcagaaatttgttgttttcaatcatatggataagaaaaaaatatggcaccctttctaggagtacctaattcacgctgacagagacatacaacctcacattctattcgaggagcagagcttcagataaaaagtttctgaacacaaaatttctcatgtatcttaattttgtagtttccaaggaaaaagaacatttgtgtccagatctgatgttgaccttccataaggagctttctttgctttccgcctattaaatcacttcttttaaatttcacctcaacttcacccttccccaaatttaaaataattgtcttttacattgtttaatgagacgccctgtgatccttgtgatttgcagccccctttacgtccatgggtcaataaagctgactgctggactataaggatgcctctagaagacttaggctgattgagctcaggtaaaactagaagagtgaaaacacatgccgtgatccttctacagaaatatttcctaaattctagaaaattcacttgcaaacttataattgttctacacaattaaattttagttaaaggtatattatcatctatgtgcttgtagggtagggaaaatggctttccttcacccttctaagttctttgacagggctacaaattaaattgccacaagacagactaacaggagaaaaattacattcaataatgttcatatacacaggagtcccacaaaatatgagattcaaagaagggccacatgattgaggcttatataacacccttagctgtagataagattaaggggtagggatctctggagcatagcgttgacaggttatgggagcatgagggggaaaaatgtattgtgcatacacattgtcttgttatgcagataaaaagtatatcagataatgaaagttgccctagagcagccttcttcctgatacagatacattttctattgtagattttctctagagatgtagttttttaaaaaataaaaaagtagccatgtctgcagtttctcaaagtaacctgctggaaatttgcccaagaagtatactttgaggtgacgtattctgatctcttacagtcatattttggagttgtatcctaagccccaacacgttgataagcatttttttttaagttattgagaaataaatcactatgcaaaacaacttaagaaatagaaaagaaacaatagaatttctctcctttgctgtttatatttaatatttttagtttgtttgttcgtgtgaaacaatctgaaaatatattctacagtaacaccagtaatgcttatgtttgggctcagaaaatgatacctcaaagtatgacactttggcatgctgagtactttggaaaaactggatagctatatacagaagaatgaaattggaccctgtctcacacaatatgcaacaatcaatgcaaaatgaattaaaattccatgactttggtctgagcaatgatttcttggataagacccccaaaacactggcaacaaaagcattagacaaatgggattgcatcaaactaaaaggcttctgcatagcaaaggaaatagttaacaagagacaaactgaattaggagaaaacttttgcaaaccatatgtctgatacagagttaatatctgaaataaataagacactaaactcaatagcaagaaaacaaataatctaatttaaaaatgggcaaaggacctgaacagttatttcttaaaagaaggtatatagtcaacaaatatatgaaaaagtgcacagcatccctaaagatcagggaaatgcaaattaaaaccacagtgagacatcacctcacacctgttagagtggctatcataaaaaagataaaagttaagtgtcagtgaggatgtgaacttcagtatatttaggtttgtaattcatctgaattttattttttgtatgtgtagtgtaaggtggattttaaaaatatttaattctatttttttctacattattttcctttctagtcattccttttccagtaatgtatgatttatcctctgtcatattctggtcaccattcatgaatggattgagttttcttcctttggtccattttctatctctaaacaaccataatctttcaattactgtaatattatagacatgtttatatctgaaaagccattactctacttcttactttttcatcttaaaaattgttttaattttcatggctgttaagttgtgtatatgaatgttttaaaaacttaagttccattttgaactactttaagacttcaaatgaaaagtttattggttacttatggagaatcaacacctttattgaatcttctcatccctgtacacagtatataatccaactactttcattttgttcatactcttaggtaacttaaaaaattatattctccaaaagttatttttccccattgatgagttattctcagataccatatacttttcaatgttcttgtgaatatgtaatccatctttagtttcttttactgtaggactctccttggtcattttgcccccaaatttgactttttgagcagtctcatcagtctcttacaggatgtctcatattatttgtttgttcagttgtttctcatgtggtattattaaatttgtatcttctgtttttctgaaaactggaagttagttctgaggcttgattaaactccaggttaaatattttaagagaatatttcaaggatgatgtagtctacatattgtaacatatcaggaggcacataagttattttactattattgttaccagtttgatcaattagattatggaggctaccatcattctctttattgtaaatatggaatagatagtttgaggttaaaagcttgtcattatgaagatatctcattttcttgcaactctttttctagtggtttcatcatccatggctgattcttgcctgaatcaattccaatatagatgattaatattatgaatttttaaattctattatttcttaaatatttactagctgtcaatcttctaaaaaatggttttttatcaatttttccctggtaattaaaacatattatagaaaaataaggcactgatataatttggacagctgtcattaagatggctaactagaaatgcccagcactcacctactccacaaagaaggactgagatagcaagtaaatagccaaatgttgacggcactgtctaggagagaatgctggtatccagcagggaagcaaaaggaaccttctgaggtatggaaattcaaaatggcagcatagagaaggaagtaaggcagccagttggatgggctaggagccaggaagtacttcccttctcatatggaaaaaaggtaaatgagagatccatgtaagtacacatgtaggcacctgcacacactgtccagaggctgaagagtggtgtgtccagcctactggaacccacacaccccacccaggagcctgagggccagcctgtccagcctgctgtttctacagccagcatccttgttacacactcaaaggtctaaagactggcctactgagggtttgctgccactacagctagcacttgcacacaccaccaaaaggcctaagcaccagtcaaccttgtgtcctcatcttcagcaaaggctagccaaagcatctgcaaacaactgcaacctaagccactaaggaacgcacagaaactactgacattgataacagtaaaagaaatcatacagtggctacagtatggtgcatatccagaaccaaagccaaagcaatctgcccaaccaaaattgaagccacatatatagtaagaaaaagtatttctttacagaagctactccataaacctggaagaagtgactgttaaatgcgatgcacagatatcaacatagggatgaaagaaatacaaaacagcaaggaaatatgacacctacaaaggaagacaataattccccagtaaaagaccccaaagaaaaggcatataaaatgcctgaagaaaaattattctctgaaagaacccgagtgagatacaaaagaacacagataaataatacaaagaaataagaaaaaaaatcatgatccgaatcagaaattcgacaagaaatagataccgtaaaaaagaacaaatagaaatcctggaactaaagaatttaatgaatggaataaaaatgtaattgagagcttcaacaaaatactagatgaagtagaagaaaaaaattttgaacttgaagacaactctgttgaaataattcaggcagacaaagaaaaacacaaatactccaatttgattattatacattatatgcctgaatcaatatatcatatgtaccctataaatatatacaattattgtgtatcaataaaactaataaagtataagaaaaagaggactataattataaaatatcagatgctactaaaaaaacaaaagggaggacactgaaaaatctcaacagattttccacaatgcacgtaatttcttaaatatttaaaccaaaaatatttcaccaatataatttaactgagggtagggtaacagtcttttctcttttacaactctgcctactcaactctgacaataggtagatgtacatgtcaacataattgattcatgtttagcatacatttttttctttaaagggaaagaacaaataattgtgtgattttccctctggtagaacttaaaggaaattttatgtgtaagatatatcatgaaagtttaatttaaccttatttatatttttagcatcttattttggtatggtaaaaatcaacatagctgtcagaggatatttgggacatgattaaataagataacatgtgactcagaattattacctggccatctagttaattcaatggttaataaaacattagtaacatgattgaaaaaagagcataataattgagaacaatcttaggaatatttgtattttttcttagataaataagaacataacaaagtcaatataaaacccagaaagttattgtaataagacacagaatctctaggggggttatatagaaggtaaagaaaaaggtttcacattgtagacactcgtggttaaaccaaaggaagtctatcacaactgaatgacttgggaaatcattttaacacatttccaagcttctcttcagaatcagatttaaaacattattctttatacagggagaggtgaaggcctttctgaactatagacatgcagacacatagaaacacacagttctcagaccttcagaactctgcctggtctgtttctggaaatactatttactgggtgaccaccacttgcctaggagaccttggctcagacatgtcttctcacctctgctttaggtgtcctgcagattgtttacagatctgggcacacctctaaaatggccttagctcactgtgttatttttgcctagtattgttcttgctcagctctagctagattctcaggggagtcatgtgaattttatctgggtagtataatgcaaatgcattatactgcactcattgaatcacctcagcatttttaatttgttctcagtgaataaaatagagaaaatgggttattaagagaccaaagatgaaagcatcatgttaaacagaaccaattctttcagaaagttataatacaaaggcagaaatgctttgtcatagaagaataccaaatgattactataacactatgtattatcctgatgtaatgcaattaagtgacttagaaatagtcagttaggctcttgagtatttatttcttcagggaaaaaataatttgagtatattgctttcttttctcaggtctttccaaagttacaaataaggaaagtttcttgtgatctgtaaggcactgtatcactgacagaacttgaaagtgttaaatgaagtaagcctcctgaccatatgttttctgcagcaaccttatcagagcacatttcatgtcattgttccgcaggctgtaggttacagggttaaatactggaggcatcacagtgtagatcacagaaagcagcctgtcaataacagatggtgaatttgaaggtggcttaagataaacaaaataagcagttatgataaaaacagtgaaaacagtgagatgggggaagcatgtggaaaaagctttggactgacctttagtggtagggatcttcagtacagtggagaagatataaatgtaagagatcacaatacagatgaaacaagaaatgcttaaacatgcaccaactccaatacctgcataaattaccattagtgtttcagaacaggaaatccttagtaatgaaggaacatcacagaaaaactgtggaatcacactggagccacagaaaggcatggaaaatgtgccagctgtgtacgcagtaccaaagagccctccaatggcccaggaaacacttgccattaacacacagactccagtattcatgattacctcgtagttcaggggacagcagatggctacatagcggtcataggacatggcagtgaggataaatatctctcctgctgagaaggaagtcattaaaagtagctggaaggcacatcctagaatggaaatggaattgttgtgggttaggttgttgacaatgaattttgggattggaacagacaccaggaagacatccaaaaaggataagttcttcaggaagaagtacatgggtgtttggagctttacgtccagggtaatgagagtaatgatgagaaggttactcattagggctgccaggtaaatcagtaggaagagcacaccatataaaatccgcagcttctggatattagaaaaccccataagaagaaatcctgtcaccaaggtgacattggccatactagattctcttcagtgcctgtcaaggtgagaaaatatgcaaaaaaagaataaaggagaaaaaaattaaaaaattagtctatacagactagcaagagtcatattgatatacaaaaatattcagtggaaaggagtcatgtacctacctaaaatggctctccatttacttaaaacttcattgttcattttttaagataaactccatgagtaatgtgtaaattccattagactttatgagttttacctaatcctatagcctcaaacttaatttgttacaagacacatgtaacttgactaaacacagaagcttttccaacccactgagaatttgcatcaaattattattatgccatgcttcatgatgaatcctttgctttcagaaaagcaatccaaaggcccatgtctttagattgtgttagtatccctaatatcctatacaggtgcaaaatatcaattatcatgtgatgttgtaaacatgaagtcacacttacagatgtattgaataatctaacacaggtaaataaccttctctattctaatgatagtaagcaagggaaaataaacaaggatttgttgttcaatgtttgtattatcttgaggtcatgcaattctaacataatgaatatctcacttagtgtagaaataaaaaatgaattatttagcaaaatttcatgttctttgaatgtgcatatgtgtactaaagccacatcattataagggtggttgatttgtttataaaggaattttgacagggcaccatgataaaatggctttcccatcctaactgaataatttttcttgatcatggtcagttgtcggtaatttactttgtaaaactatcaaatatcttctttcagtgtttaaaatatttccctcaattattagttactgatgtagagttatttattctttattgaaaagatcaaaaaaatgttccatatatatcagacatcaaactagatggtagagatttaaaaaataaacaactttgttttttcctaggagctttgtgttgatgggaggaggcagaaaaagaacaaataaattagtaaacaagataaactcagattgggggaggcattaagataatacaaaggtgttattttagagattaaccagatgaaagggctttctatgtgggtgacctgagggctgacaacaaaatgaagagaagaaatacaggacaaagatctgtagagaagatgctttaggaaaagaagcttaaaaaataaagtaaaggttacggacatttggatcacatgtggagaagcagtatatagtgaacttggaaaatgtggtagagtgattaaataattctgaagacatttattagcttacttcaatggtcagtctggagaaatacacaaggaaggacaaaagggaggaggaagataattaattgtttttttgtctgccctaaatttccttaatatctacaagattttatttatttatttatttatttatttattttttatttatttattttttttattttttattatactttaagttttagggtacatgtgcacattgtgcaggttagttacatatgtataaatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcagtaaacatacgtgtgcatgtgtctttatagcagcatgattcatagtcctttgggtatatacccagtaatgggatggctgggtcaaatggtatttccagttctagatccctgaggaatcgccacactgacttccacaatggttgaactagtttacagtcccaccaacagtggaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttataaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaggtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagcttgaagtcaggtagtgtgatgcctccagctttgttcttttggcttaggattgccttggcgatgcgggctcttttttggtgccatatgaactttaaagtagttttttccaattctgtgaagaaagtcattggtagcttgatggggatggcattgaatccgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtatgtaagaatgcttgtgacttttgtacattgattttgtatcctgagactttgctgaagttgcttatcagcttaaggagattttgggctgagacaatggggttaatgcccacaagagaaagcaggaaagatccaaaattgacaccctaacatcacaattaaaagaactagaaaagcaagagcaaacaaattcaaaagctagcagaaggtaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactataaacacctctatgcaaataaactagaaaatctagaagaaatggataaattcctcgacacatacactctcccaagactaaaccaggaagaagttgaatctctgaatagaccaataacaggagctgaaattgtggcaataatcgatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaacaaaattctggcaaaccgaatccagcagcacatcaaaaagcttatccactatgatcaagtgggcttcatccctgggatgcaaggctcgttcaatatacgcaaatcaataaatgtaatccagcatataaacagagccaaagacaaaaaccacatgattatctcaatagatgcagaaaaaggctttgacaaaattcaacaacccttcatgctaaaaactctcaataaattaggtattgatgggacgtatttcaaaataataagagctatctatgacaaacccacagccaatatcatactgaatgggcaataactggaagcattccctttgaaaactggcacaagacagggatgccctctctcaccactcctattcaacatagtgttggaagttctggcccgggcatttaggcaggagaaggaaataaagggtattcaattaggaaaagaggaagtcaaattgtccctgtttgcagatgacatgattgtatatctggaatagctacaagattttaaaaattttgccttgaaacagagagtactttaacattttaccaacagaaatttgaaattaataccgtaaaataattccaatttttcaaccacatggacacaggattactcatcagatgtccttaaggagataattccatcacatctacacaagggtagaaatattcctcccagaataaaaagtttaatttgtcagttgattacctgaaattaaaacaaaacatctagcttccttcataaactccgtgtcaacatagcacatggttccatctctagacttttgataaaagactcaaagagctctgcaaagctgtggtagtttcttcacatggaaggatgcatactaccacaatgaggaagactatttgcctttcttttatttcaaatttgacataatttgtaaacgtctatagtcaagggactgcaacaaattatttttaaggcacttggctaatactttagaattccccaaagaaaaatgttttaaatattttctgaatcaccttgttaagtgattatctcttaagaccattagcagtataatcacatgtgttttctgtagggaggaaacaactgtttccaacgtaggtccagaacattctgaaatacactgttaaggacatgactcagtcttttagcagaaaaataataaagtactcaagtattcccttaattctacttatcatagagttataggctataggacagtgataaccaagctatgtaatatactgtataataatcatctgagcactttgctaaaaatgaagactcctgaaacatacaacaagccaacataacatagttgaagatttgcttgtagctctgttcccctttagacttaagagtttatattaagcctatggttaagttacttaaaatggtttctttctgttttcttttgaacatggttttgtttttcattcgaagcatagttatttcatttgatttggtttgcatttaattttaaagttttttgtcctttacttttgttgacagtttttatatgtaaaaaatcaatatgcttctccaaagtaaaaatacacacaaaaaccccacagaatactattctcaatgaaatgtcactctctatcctttccaccccattgctcgagatctacagaaaagcaatttcagggtttactggtttgttgtttgcaggtttcaattttacaaaaaaagatttgctcatgttttcttgttacttatagcatacgaagtatactcccttacatttgattctttaatgtaataaatgctggcaaacattagatacagtttatggaaactgccttcattatcattattttttaatggttgaagaatactccaatgtaaatataggtaatagtttattcaataattactatatgttttggtatttagttttcaaaattttgtggttataaacaaagctgccaaatagaaaccttgtgaacatttattaaattacaggaggtacacttcagggtattatataaatgagtcaaaggtggctcctgtagattggccctcacgtagtttacttcttcacagcaggctgtgacagttagctcaaaccctgatgacaccaaactcaaatcgttacaaatccagttgattcaaacatagcaaaaaaacctcacatgttttagtcatatataacctgcctacctctaccctgcataactgcacccaacatctgctagctataatgaaaattaaccctggggctataaaacacttcaaaccacttaccctgccagataatttttgttttttactgttttatttcctctttcttttcctccatttcttctttcctgccatttttcagtgattatttgaataatttttaaaatttcttttaaaaatttgttggttttctagctgctttttattgtgtatagctgccccaggaatgagaaaatatacatacttaactttttctaactctacttataattgataatgcactccttcttgtaaaataatatctttggcatttacacatgtattagtcagggttctccagagaaacaaaactgactggataaaaaaatatatatatttgaaggcctggaaatgggaactctgatgttggagggccaggagaaggttgctatcccagcccaagaagagggtgtgaattcacctttcttctgcctttttgttctatttgtactctcattggattggatgatgcctctccaccttggtgagggcgagtttctttactcagtctactatttcaaatgctaatttcttctggaaacaccttgatagacacactcagaaataatgttttaccagctacttgggcactgtttagtccaattgtattgacacataaaattaactatcatagcccatatatgaccatgtctgatactattaactttttttagtatttcagtatatttcttgtattatttatttcattctaaagatcttacttcagtgtttcttacaggcagttttgctgtcaacaaattcctcttaggcttttttaatctagtgctgtctttatttttccttcattctcaattacatttttgctggacatgaaatttttgattgatagttgcccctccaaacctttcaacctttcagtatgctgaggatgtttttctgttctctttgtgtaatcatcatttctagtgagaagtcattattcacagtattttttccctttatgtaatatattactaattttttcttgctgctttaaagattggtgcttatactttgctttcaatagttttactattatttatttttgtttgagttatttgtgtttgtcttctgactggtgttttttagcaccttgtacctacagatttctatttccctcagatttcaaaaaatattggccattatatctataattattttttctggcatgttctttttttttctccttccaattcatcagcttagataatttatatgctctatcttcaatgtacttactccctcagtaaaattttaatttcagaaatagaaattttcaattttgtaatttctgtttggttattttaaagtgtttctatttctttgtggagaaatcccatttgtatactgagatttcacatgtattgaaaacatatttttttttcttaattgagataaatgaccaatataagtatctttgtctgtttgcttcaacatctggttcatcttgagtttggcctagatttattttcttttcacatcttagtgggtttaatttttagatccctcatatgatgggtagaatttatcctgaatattatgaaagctgaattgtagagattctacattttattttatttttaagtgagtattatttctacatattaacaagccatttcttcattggtcttgaactacaatttttatttcatttgcagtagcttccatttcattcagatcttggtatggctgaatatctttcggtctttctgtgcatgtgtgattcaggggtaagccagagatgtgggtagaaagtgtttggcctaactttttttttgtattttactttaaagatctctacactcaggatttatagtccccagtcttctcttttctggcgccccagtccagaaaaaaataggatctatctctatccattttggccagcatcgtaagctcaccactgttgtgttgctgtatgaattgcacatatcccaacactgaaagctgtgatggaggaaactaaaatggtcaagcgcccttacaacacttctccaagtgaacagaaacctttggccacagtccgccagcacttattcaggtgttttttatattatgtttaggtttcacatgtgctttctgttggagaaaaggaggggtctgaggagctctttcctagtccatcttatttggaagtaaaacctctcttttagcaaaaccgagcatggccttaccaaatgacctagtgatttggtcccttggtacttacccaactgatttgaaaagttatgtgcaaacaaatcctgcatataagtgcttatagaagttttatttataatcaccaaaactgaaagaaactaagtagtccttcagtaggtgagtggataaagtatacttcaacaatgcagtagaatactaatcatcagtaaaaaggcatgagatatccacacaacaacatggatgaatcttggatgcattttgctaagtgaagaagcaagtctgaaagtctggcttctttcagactcagcacgcccttcccccaggcaggatatgtttgtagtaaagtctttttgcctggagtggtcctttgatctgggaaggctctgggcatgctatggttacttttccacccttttgccaatccaggagagattctttcttggctttttatttgaaagccttagtgggattcctagatataaaaccaatgaaagtacgaggtccccctgagactgcggccctcaggagtttcttactcttacaccatcctgagagcattcggaaattcatcaaacttgtgacccttccagtttattatttctgtggctttcgttcctagtgagcagatcttagctgtgactctctatattcacctgtctctctagatttaaggattaatttccataatagtggactaaagacgaaaagtgaatagatacacttacctcattatcagaaaactgatttgaaagatttgaagaaatttgtgacaaaaatcctcagtaacctggtattgaaggtaacctcttaaactgataaaaggcatctgaaaagaaacaaaaaccaaagaaatgcattggactatggaacaattcctattttacaaaccttctgaaacttaaggaaagacatttcctgtttatctgttcaatcatgctatctgctcattctactccctcactccctgtcctttctagccttcctcactctccctatataacaaaagccctttctgcctgaccatttagaggactacaggtatcatgcttggggaaattctttctattgcaatactctttttgaataagttatctgctaactcaaaaccaagaagaacaaaaacaaaagccaacaaaatgaacaaaagacaaaaccctgcaactaatatcatagttaatgctgaaagccagaatgtttattctgtagatctggatcaaaaaggattattctctcaccacctctatttagccccaagcagtgaaaaaaggtaagaaaaagaaaaagaaaattcattaaaaatgaagaagtgcaacttttcctcacaaaatgagtatctacgtagacattttgagaaatctacaaaacagctaccagagctactatgctagttaagaaggttgcatgataaaaataaggctgttacatggtattaaaaaacaaatggaaatggaaagcaaaaacaatatcatttatattatgttacaggttgaactgtgtctttccaaaattcatcttttgaagttctaacctccaagacctctgaatctgactgtatttggagaaaaatcctttaaagagcttattaagataaagtgaggccattaggatggtccccaatctaaacttactgatgccttattagaacagggattagggcacgcagagaccctgggggcacgcatgcacagagacgaccagaggaagaggcagcaagacagtgtccatctgcagcccgaggagaagattcagaggaaaccaaggcagctgacgtcttgatctcagatgtgcagcctccagaatcgtgagaaacacccactcacagacgacgtgtttaagctaccccatctgtagtattttgtcatggcagcctaaacaaacaaatacagatttggatcaaactcatgaagtatctactgattaatttaacaaaatgagcttgggggttgtgtactgatatgtactgaaataacaaaatgtttctgagaatcttttaaagacttaaaaatggagggatataccatctttattgctcaaaatactcaatgttgctaaaaatacagtgttttctacattgatctagattcagtccctgtcaaaatccctaggaataccttaaaaatcaataagctaatttttaaaatgtagataatgaagtcctatggggctggatgtcatatgtctcttacgaaatgtcataaaatgatgaagaagaaggtctaatctaaacgtcaacttcgcaatgaatgtggggtgtccacaagaggttgctggatgacagaaacaagctctaggcagcatagaggctgtccccaccaggatatctagaaagtcagtcattcaaagcaaactagcgagcaaataactggaaattacgtgaatataataagaatattacaagatcaaaatctgaaaataaactgtacctcatcccaaccctggagaagaccccactgagtttcattttgttgctgcttccaagggaagcctgaactcgtaggatgctcatgaggatgcccctggcatcacttaagaatgaaacagatgttgaaaattcggtgctcttgggaactttctatacaggcatctctcgtcatttgtgagaatctgaagggacgtcatcttccctggaggcttaaatccagagtgagaggagaaaagaaagatccaagggaagtgtgatggctcaaggacttaaacaaatccatgtttcagaccccaaagtcagagcactgcatctcccagtgtccttctcagttgaaactggactgagattattacactcaatttaaagagtctgtgtacacacaccaaaatttaaggtgtcacatgcaaatgaatgtctaggatccattagtcacatattatggatgcaataaataaaggtttattctcatgagacccagaaagatctccttttctgactcactggaggaaaaggtgtggcatcacgtctcagatctgaggtgagagtgaagagctgggtctccagggcttaaaacctatgaaataaaatataagtacaagtaaaagtgtgacctcccaggagagtcccatatagtcaatgaaagtctgtttaaagctgctttaaaagccttgctccttcttgaagaaggaagtgcctaatacagaggacatcaagcagagcttggagactgcacaaaagaaataaatactgatacgtagaggacagaaatggtcaatcaaaatcgtcgtgagtttaacccggggagttggggtcttgaagcaggaatcggtaagcatataggaaactgtttgcagcattcactagatctccctaagaattgaaaactagagctctctttgaacaaaaactgtgaaaagaagtcctaaattacttagacatttcatttttattttcttctcttctgaaattattttgaaataaatatagaactgtttgggaaagcattctcaccggcctttgttatgaatgttgcttctattgatcttactcgagaatggaaacattttccggggctgaagattccatatagcctttgttatgaatgttgcttctgttgatcttactcgagaatggaaacattttccggagctgaagactccatataggcctcccctcccctcccctcccctctcctctcctctcctcttcccctttgctctctcattctctccattcctcatattcttgacaaaagtgataaaatttgttgttaatatgatatagaaatggtaaagaaacatataaacctgaacttaccctatcttcccagccttcttagataccccttgattttaggattattttgtgtattatatgtattttcccagttttagattgattgagactcagattgcatatttttatttaatcatgtggaatttccctggaccaaataagtatataaatataatgaggcaaagctttattgttattaatgttatctgtaaagaaaagcacacagacttttaaactaatgctatcactcatttcatatgtaagcatgtgaaataaggtgaaatataaatcaaaaatgagactgaagggataaaaatctagcattggagtcaaacatcactggggtggaaggaactcaaaaggacactcactcactcactgagctaccctggctgtctctaaaacacacaggctaatgcaacagaaacaaggatggatggtttgctagtttggaggtagctcttggggtattttgacactgctccaggttttattccccagcaggtcaaacaaaggaggctttacttttggggcttccatgaattagctcatgttatgagtcaggctctccattattgctctaaagctagggccagtgctttctccaacaagaaagcccaaagtttgcaacatagtaagaaatttccatttgctcatgagtcttttcaacttaaaacattattttatttaatttttgtagacatagaggggtctcatcttgttgtccaggcttgtctcgaattcctggccttaagagatcctctggcctcagcctcctaaaatgctgtgattaccggcatgagccaccatgcctggtcccttttcaactttaaatcacttgttaatttagttctcagaaaatcacttgtactgaaatggacatattctatgaaggttagaggtacgactgctcatcctggaaaagctctgtttattcttgctcatcctctcggctgtgtgtgtgtgcatatgtgtgtatagagaaggaggagaatgtatgttgtaatggtctgctacattctctttcagttgaaaaactgctgaacaacaaagtgagactctcttgtgtctacaaaaataaaatattttttaagttgaaaagactcaagagcaaatggaaatctcatgctatgttgcaaactttgggtgttcttgttggaaaaagcactggcagtagctttagagcaataatggagagcctgacttatagctcaacatgagcaagttcatggctgccccaaacttaaagcctcctctgtttgacctgctggggagaataaaacctagagcagtgtctacataccctaagagctacttccaaactagcaaaccgtccatcctgttttctgttctgtgtgttttagagatggcctggaaaccaaaggggaaagtgaaaaaattgccattgaagtgatactaaagtaaaatcaagagaggttctaaagacaagatgatctgagggaaaaacatggccaaaactctccctcacgttggggtgtgcgagggatctcagatgacaatctctgaatgtctatcacataagaggacacactgcatctctggttagatgcagtagatatccctgtctgtcgcttcctgtgtttaattaaatccttcctagaatattatgttaatcatctggctaagtctcaggtttttgttcttttcatgaaaaatgacactatatatttgaaaactgatttgtgaaaataacgagtactttttaatttttgtgctatgctatgtatatggactaaagaaagaaaaaaatgatactataatcacattttcaccaaaggagtaaactttaatgcaaaaatgggagaataatcttaacatccttcagtgagaaggggatagtaaattagagtatcacctgaggataatgactattttaaatattgcagtaagtagcaagcagaaatttcattcacaacatttaatacacacaaaactacattaaccgggatatttatacatgaaaatgtatgccctattgcagttttatatataattgcatagccaaccctgtaattcccaaaggaaataaaatcactcaaaagtcatttcaagtaatgagggagagaagtgaagttctttgcttctttcacaataaatcttagtccaggactactaagtgttagactgatatacccacagttgttttacacctgagtccatgagaaatataaattgcttgatatttttaaactttttgtctaggccttgatgctacacataccttcattcaacaaatgaagaaacaaatgatactttttaatattagtatgacacttattttcctttactccatagggcgcttataattttgaactatgaccaatcagacacagatgatggaattcttgcttgtgagatttactgagaattgggtgctcctgaggctgcatgctttgctcttctcactgatctacctcacggctgtgctgatgaatttagtcatcattctcctcatgattctggaccatcgtctccacatggcaatgtactttttcctccgacatttgtccttcttagacctgtgtctcatttctgccacagtccccaaatccatcctcaactctgtcgcctccactgactccatctccttcctggggtgtgtgttgcagctcttcttggtggtactgctggctggatcagagattggcatccttactgccatgtcctatgaccgctatgctgccatctgctgccccctacactgtgaggctgtcatgagcagagggctctgtgtccagttgatggctctgtcctggctcaacagaggggccttgggactcttgtacacagctggaacattctctctgaatttttatggctctgatgagctacatcagttcttctgcgatgtccctgccctactaaagctcacttgttctaaagaacatgccatcattagtgtcagtgtggccattggggtctgttatgcattttcatgtttagtttgcattgtagtttcctatgtgtacattttctctgctgtgttaaggatatcacagagacagagacaatccaaagccttttccaactgtgtgcctcacctcattgttgtcactgtgtttcttgtaacaggtgctgttgcttatttaaagccagggtctgatgcaccttctattctagacttgctggtgtctgtgttctattctgtcgcacctccaaccttgaaccctgttatctactgtctgaagaacaaggacattaaatccgctctgagtaaagtcctgtggaatgttagaagcagtggggtaatgaaaagatgactaaagttgaagatgggaagtaactttttttgttgttgttgttctgccatccactagctgtttaaaattatctctattttgggataaaaatgtcatggagtcttgctactgataatctcaagcagtcagttttaatagaaatagaaagcaactattttcctacaatttttgcactttttttttttaaaattttgagacggaatctctctctgtcatccaggctggagtgcaggggcgtgatcttggctcaagcaattatcatgtctcggcttcccaagtagctgggattacaggtgtatgcaaccacgcccagctatttgtttgtgtttttagtagagacggagttccaccatgttggccaggctggtcttgaattcctgacctcaagcaatccgttggtctcagcctccaaaagtgttgggattacagcgtaagccaccgtgcccatctcttttcctatacttcttcacttgacatctgttattcatgtagaaataattaaagttttcctatgacaacttcaatgatttttactcttgttctgaagatccacatgcattgcatgagatttgtatgaggttctcatacctcaaaaagctttcatcttttcggcattctcttcagttagtttctgctttattgtcctatcttttccagcattctcttcagttagtttctgctttattgtcctagattttgcattgcatctcaggttttatcgattcaacgttctttatagcttctgattttcactatttggtaaaagttgtaattttaacttaaagttatgatttcaacttacttttacagtttaaaaaatgtactcaattttattgcattttacctatttgattcatgtgtgcttggtagattttatacaattacccaaacacttaggaaggtgattttctcatgtctttttaaaaataaattatgtttttggagtagaatatttttctcttcattaaaacttctttttctctaatgtgttgattcctgacttgtgcaaattgctttcataatgtattagaattaatgaaatagcatttagcactgtttctaacattgtgataaattatacattttctggacctttaatattatataacatttcaagtaccctaaatgtgtagaattgttttctactccttgctgcaggagacaatcgtcgtatcaccctatttgtcctcttgctgcttctttcctagagatggaaattaacatttgttgcctaatttcactgtatcagacacttttgtgtataccacctctattaatcctctgactgatatgaggcagcatgtaatactgttaagcagatgggacagctgagactgagcatctttttgtttatgttactcataacttaagaatgtaataaaatatgtttctagcctttggcaatacctttcaaactctgtatgctcactacagcatctttgaaacttggtccatattagcttcctcatgaaatcttctatttgcccaaattctacccaaatattaaaatctagcttagatttttagagtctagctataaaatattatgaaagtgcttaattacatatttctctgtctctaaactcttgtatgtcattgtatgtattgtatgtcagaaaataatttaaatatcttctagtgagctttgcacaaatatttgacagaaaataaatatatttttaaaatttgtttaacacagaaactggattatctaatgcctgcatggaaagttcatgcataaactctttgatttactcttacagtgcagttcacagttgtgagcatataatggttttgtcactacttctttaacactgcctggatcctaagccaattcatttcaatgcaccataaatttagttatgtgtgtttaaggaaaaataaacattgcattaaatgaacttatcaactttgagttgaatccctgttatagaaacattgaattggaatatgaataaaaaagtgtgtttgagaactgaaggcactggataatgactatatttttagagagcaaccatacagagtgagtgataaatcacacaagtatgcatatgttaaatatacatatagatacaatcaaagtttcaatggaaaaaaagggtaagaagtagtaacaggaagtgaatttttgctgttttacattcaaaccaaagaaagctgtaaattgtcttgaatctattggtcatgtagttctacatttaaagagtacattgctgatgtttgctctgataggttgtgctatgcaactctttattcaccattgtgacacttctctccttactttacgaaacgttcattgtactatacctacgtgcatcagatggagacataccacaatgattgagaaccctgcaagcttacagatcacttctgtgataccctccccgccttgttttccaaaattttacctttacagtgatgatacagatgaaagtaaattgaaatagtacttctatttcagttcaaaggaattccgagtatctggaaaaactagctttgctcaaatgttgaaacaaaatgtgtattgcacttttggaaagcttcttcacagtagtttgttatgggtttatggaaaagtctgaacttggtatggtgtgaaacagattgctttattattttatttcaaataccatgtaatttttattttaatcatgtaatttccagtctggttttcttatacctcaatattgaaattttgttgagataatacacacacacacgcacacacacacaccatgaagtggagactgtgttcaccactgtggaatgtaatctgacatcacaagattgaaattttgttgataatacacgcacacacacacaccatgaagtgaagactgtgttcaccactgtggaatgtaatctgacatcacaagattgaaattttgttgagataatacacacacacacgcacacacacacaccatgaagtggagactgtgttcaccactgtggaatgtaatctgacatcacaagaagcttatttaaaagacctcaccagtagctaattaaatcaaatgtctaatactagccacttaactgcttgttctaggaaagtgggcttctattctctgtggggctatatgacagaggataatcaatcaatatgataaaataatagggaattaagaagattacaaatatttgatttttccatttacaaatttaggaaactaatatgtggaaataatgatttgagacaacaaaacaacaggaggatacaaagatggggaaagacacaaaaaggggcacaaaagttttcaaaaatatgccttggaaagtagatataggttatttaattagagataggaattctacaattaaaagtaatttttcaagttaaatgtatctagaactatgctatcaaatatggcaccactagacacacgtgactactgtgtactttgaaatataattcgtataactaaggagctaaattagtacttttaattaatttgcatttaaaaattgatagtcgattcatttattggaacatttttaagtgtacttgaaacaaccagagtatggaaatctatttttttccacttcaaatttcataaagtctaaatacaaattatttccagtgaaagtttaatgttccacttcctgcccacagagccctccactggagtgcttcctgactgtggtgttccctaccagaactccccctaccagagcaccccctacccatggcactcctctctggagtgaccccacttgcagagcaccatgccagaacacctcccacctatgatgcccctgctgcctccactggagtgtctataatggcagcccccaatcatttcctattgagtgctgttgccagtggtctgggagcaccttggcccctccagcccaaccagagattggcctcaagggacaaagttttgcaccaatttttatttccaccaatcatctgtgacaatttctatggttctgcagtttcaggactaattgatatttggcaggccttttaattttaggcattctggtggtctgcagggatgtttcattatgtatttaagatgcatttcattcataattaatgattttgaacacattttcaaatgtttgttggcattgcctttttttgtgtgttgcctcttcaagtttcttcattattgatttataggagtttttaaaaaagtattttgggtatgagatctttgttggttatatgcatttccagtgtctttttgtaccttagagtctatctttttaactgtcttcatggaaacataagtctttaagtgtgttgtaattggtaaaaattttccttcatggttggatctttttctgtttcattgaaggtttatttttctaacctcacgagaaatattgaatatattctgctatattatgtttaaaagctttatattttaccattaaattttagatcaattatctacctgtaattaattttttgcacccggggtaaagtaggcatcaaattttatttttaaccatatggacatttaaatgaccgcatctttttctctgaagttctaccttggccactgctcatgtcatatatatgcatggtatagtttttggcccttatgttgcctatgcctgaacaaataccgtagtgttctaatgattgtaattctgtaatatattgatatccacagagcaaattatttttcctttatgatgaaagttttagctcttttcatataatttatatatgttttagaacagactacaaattttcacacatatacatgtgatagctgggatctttttgttttgtttactctaatgtaatcacgttaaatctgttgattaaggaaaatagaaatattaatcatttggatcttcaaatacataaataccatgaatttttattggtcttcattcctcaatatatctctgaccttcctacttggataaatattatctaagaagaacactaattttctttgggacaaattggttagggtcgaattctctgaggtttcttaatttcttctatttgtgggggttaagagttttggatgtattatacctcttcaaagcagatgccgaatcaaaatttgacatgaaagatatctattggtggaggacactgtccatagatctagatctttattattcccatgtatcttgatggatatgccaaaaatgtaagcctcttcttgttctttttaaatctaaccttaaggggtatacatgcagttctgctacatggctatattgcatagccatgggccaaggttgagcacagctgcctgagacatactttaaagttgcctcaaggagtgcttcagaaaacaaaggagaacctccagtttttaaagaaaaaggaacaaatcaggaaaggggagattatgaagttataaattggacatacattgtggaactatagggtaatggttactctgttcagtgtatggtattttatggctacttggtgtcagtctagagcccatgcagagagtggcttcaagagttgattatttagctcaagggaaggagtaagacatgactgttattgcacttcaatgcgtttcttggcctgaaaattaaaggggctatgactcctcacataaaaatatattctctttcttacctggaaaactaagaataatagtatattgaagtaataaaataattctataattacattaataaagccattgtgatctataattaggtaattatcacctatgaaatgcaaaggaaaatatatccaaacgtgattaataaattattacctaaatcatttggaaaaggagctaagaaaaattctacagtgatgctatgaaaacatacacatttaaaatactcctgctgagtgaaggggttaaaaaaaaagatggtagcttggaaaaaaaaatagaaagatgtcttttggctttttttttgatagtatgaaccataatgtagtaaaggagagaaaaaaatcttccctaagcaaaaccccaaagccagaagccttaaaggaaaagatcagtagatttaactagattgaataaaatctcatggacaaaatgtaatcacaaaaagagttttagaaagaagctttaatttttctttttttctttgtatttaagaagcatgagacctacaggacctaaattttctaatatatagaaaacttaagcaaagcaataaaaatcaaaaatatagggaaaagttataaaaagacatcagacaaaaaaattaaaacaaatggctcatatacttggtaaaacttgcccagactgactgacaaatatatgcacatcagaactaggagacatttatttctcctctcgtaatgttaaggaaggatggacctagattaaaaagttgaaataatctgtttttttgagacttccttgcatttctaggggtaaaatgaggcagctcctgtaaagtgttgttctttccaagggcaggatggtcgttaattgggttctactcccaggatatttacttaaccaattaggagaatcaccttaaaacagggaaaaaccatgggcacagccgttcatggttcttgccctgtctggacaagattgtgtacatgatcatctctgcagctaaaagaatccaatgaaattcatgccgttattgttttccaaactttttctgtccttttctttgcaaccctagttggatgtcttaacttctgtaactattcatcttttgtctttagattgtgaataattggtctactttgaagctcagaagagtcattgtgaataatatggacagagtaaaagagttatgacattagctgttagtgacattagctcgaagcccacaatagtcatagaaagggggagacttcacaacaccatctccctggtatccactggactttgatgggtggcatccactagcggaattcagaaaaatgaaggtgtgaaatcggtttttataaagaagagaaccatgctatggagaaggattactgtatcgcctcttcagaagccttgtatgatgccatcctgggatacagctgagtaagcctgcattcttaacatcgtataggacattctagcatagaagcctatggaatgaggccacctgttttcaaatccagcccccacccttgtgtgaccatgggctaattgcttaagctccccacagttccaatttctccatatagttggcatacaagggtttgttttgagcattgatgtaagttatatccagtaatatttgcaaacatcttagaatgtggctggtgtaggtaagtgctcttgatctcacattcccaaaagcacatttctcagaccatgagtcattcctgcctctgaccatcctgccaaaatgcatgccttctcaggtccccttattctgaagaaaataaaacaacaacttgttgttattgaaggactagagtgtgggaggatgatctgtatagacttcttgatatatcctcctacacataatccatggatctgacctcttagatacttaaaaaaggtagacagtttacatcaaaattatttgtaagcctagaaatattttcagaggcttaccaaaatacaagctttaatttcatttcaattgagatttgagttcatttgtttatctgaatcaatataatttaaaaaacatcttctaatatcttgccttggtctaagatggttaagagtttgccactgttttgacatgtacagttgggatcttcctttccatagtagtccaaggaagggaagagagacaaataccacttccactccaagcctaggcatcaaagccagggtgaatcagcctatgggaagtctgctagtatttgaagggacaaagacattctttccccccgtataaacacttctaaccatgaactgctaatgcgaagacttttttttttttttttttctgagacggagtctcgctctgttgcccaggctggagtgcaatggcgtgacctcagctcactgcaagctctgcctcccaggttcatgcgattctcctgcctcagcctcccgagtagctggaactacaggcgctcgccaccacgcccggctaatttttttgtatttttggtagagagggggtttcgccgtgttagccaggatggtctcgatctcctgacctcatgatccgcccgcctcggcctcccaaagtgctgggattacaggcgtgaggcaccgcgcccgggcctgttttcctattttgaaaatgagtttggtcccattagatttggtctcagtatttacgtaagtgcagcaagaatgatgattcaccatgtaggactttttgaattttctttgctggaattttttgtaaggaatctcacattagacttttaagtctcgagactagaaagccaaaccatggctcaccacaagatttcatttgtagtacttacagaattgaatgactgcctctcttcttgaggtctccaaaatatcctatggttcctgagagtaccggaaagtgaccttctatactcactgtaaggctaagcatgctataagccaggtaccaggctaattttttcaagaggattttgtaagccttgacctcataaagtcagcatagttccttaaaactgtctgatcatatctgattctatgaatgtcattttcaaatatgacattccattcaaaacctgagtaatataactgatatttctaattacatcatgttaggaggaaagattcttattgaacgtatgcaagtagttatgtcacaatgggaattagaatactcaataagcatttctaaattctggagggataagcagggataaatatataaaagttttatatctgtttacaaaagtatcatctacaaaattatttataatataatggctttaaaagaggtttcttacatccataatataaaacattaaagagctaatgatgttccaaaatagcaccataaaaaacaaccacacttcattagttcatctgccgtatgtaattgattcttgttctgctttaacttcggctaccagtttgaagaacccatcagcttctccattaaatttccggaactgtagacttagaccaggtgtacagtctcaaagttatttaagcaatggcatcagatgcttgtaccccggattacctgttattgttctttccatgggtcacagagatagtcacattttgttaaagatgaagcactctggcttgtagcggactgcaagagctttcagaaaagcatcagagtaaaacagactatctgtggatgacaaaagacttaaaatgattgtgatttaagagctagtgagaggtcatttaatgagaaaattcggttattccatggcataaaacattttaaatagtaactggaattatgactgatcacattataccaggacatattatggggcagccaaaaatgacaaaattctatatacttcataaaatttatgaaaaatttatatgaagaatattttcctatttacctatacaaatacagtctagggaaggtcacatttttttcttatgtgacaatactttttatgcacttgagcatatcaaacagacctaattttttttaatctctatttttatgaagtcaaagaagaaatcctttgagattttccagagccctatgggaaatttcaaagtcagttcaagtttaagattacatttatgatttaattttcggaaggcaaaatatcaaaaaatttgaatacttaattaaatggaatcacagatcaatgtgaaacaatacttagttatccatttagccaaagtgacaataaaatatttcaaaagtgaatatggagtggagtgatgttagcaaggtggccctcatctcctcacataggcatcaatttgaacaactacctacacataaaattaccttcacgacaagtaaaaattatgtcacgtgggtttagcacagaaataataaaagacttactgaataggataggaaggacagcttgacattccttacatcacccctacatcaagcccaggcagcacagtgtggagggagataccctctgtatgaaggaaggaaagtgaagtgaacatccaactttgcaatcagtaccagcaccaggcccttgaataaactctagtgccaggtcagcccccttggcttcatgcttcagactatatctgtggactaagccttgaagcccgtccaattggtacgtcaactcccacagctcagaccagcccctgtagactcagcctccagacctgccctaccaccagaccagcttccatggcactagactacaggccaactccacagactaggcttcggccatctttagcactgggctagcacctgcagatcccagctccaggcttggctctgtggatataggctccagacctacgcagttccaggacaaccattgtagccccaggtaccaggctggcctctgtggcaatagggtctaggccaaccacacagacaaagccactaggccagcatctgagaccttgtttccaggctgactctcatggactatggtctaggctagcccctcatggccacaagcaacaggccagcacacatggacccagatcctagacctctgtggactaaggccccaggcttgccccagtgccatgcttaacccagaccctggggtggtccccatggccctaggttcagaggactcaagaccaggcccacccctgcagacctaggctatgagcctataagcctatccctgtagacgcagcctccaggcctgtcccagtaccaggatgactcctgtgtactcaggctctaggcctatatgaacccaggcaccaggcccatcctagcaccaggctagccctcacagactcagtctcaaagctcatcccagcacaaggtaagttcatgtggacccaggattcaggttggttcttatggacacaggtaccaggaccaccactgaggacccaagcactaggtcttccctaatgtatgtagtcagaaagttcacccaagtggacctctgtgccaggtcagttcccatggacccagaaaccagacgcccaagtggacattagcctgaggttttccccagtggatctaggtccaggccagctcctgtagaaccaatagccaggcccactcacctgctgaccaaagcaccaagccaccctgctcaaggactccaacagcaagtctgcctatggatccagtcatatagttctcccagaatctctgggcaagctgatttgtgaagggctcttcctacatatgccggtctgtaaagatagaaaaggtgaaaaactactcaaatatgcaggcataaaaacgtggccacagaggtcgtaaagaatcggggaaacatgagagcaccaaaggaaaaaaaggaccggtaaccaaccctaaagaaataggatatacaaactttctaactaataattaaaagtaatctttttaaagtagctcagtgagtgacagaaaaatacaaataaacaactaaacaatatcaggaaaacaataaaagatgagaaatttgacaacgagatggaaatcataaaaaaaatgttggagataaagaacataatgtctgaactgaaaaattccatcaagaacttcagcatcaaactcaatcaagcagaagaaagaatcaatgagttcaaagacagttcacttgagattacccaatcattggaatgaaaagcaaaaagaataaaccatggaaattctgggacactatcaagaaaactaatgcacacattatggaaactgcagaagagttagaaaaacggaaataatgtttaaagaaataatgacagaaaataatatttaaagaaataatgacagaaaacttacgagatctagagaggacaatgaacatacagatccatgaagcataaagaacccctaatagatgaataaaaagtcatctgtacactgaactataaaacactgaaggaaattgagaagaaacaaataaatggaaagatatctcatgttcatgggttttaaaaattaatactgttaaaatgtgcatagcgccgaaagcatttatgtattcagtgcatttcttaccataattccaatgttgtttttcatagaaataggaaaaaatccaaaaacttgtatggaaccacaaaagactgcaaatagccaaagcaatcttgagcaaataaataaataataaaagaagaaaacaaacaacaaaaaaatgaaaacaaacctgccaaagctgcaggtatcatgctacctgatctaaaaatataatacagatatatttgaccattttaaaataagattgtttgttattttgctatttgaggtgattgcattccttgtatactctggatattaattatctttcagataaatggtttgtaaatattttctctttttctgtaggctgtcttttcactcttttgtttcctttgttttgcacaagcttttttagtttgatgtgatcccatttgtttatttttgcttttgttgcctgtgcttttgagatcttattgataaagtgatttcacagaccaactcttgaagtattttgcctattttgtcttttagaagttttattgtttctggtcttatatttaagtctttaatccattttgaattttgtaaagggaaagaggtggggatctagtttcattcacctgcatatggatattcagttttcccagcaccatttactgaagagactggcctttccccagtaagtgctcttggtgcctttgtcaaaaaccagttgactgtagatacatgaatgaatttatgggtttttgtattctgttttatttgtctatgtttctatttttatgccagtaccatgctgtttggtaactatagtattatattgtttttaacttttaggttcaggagtacatgtgtagatttgttatataggtaaattgcgtgtcgtgggggtttggtgtacagattattttgctactcaggtaataggcatagtactcaatttgtgaagggcttttcctacacaaatttcctacacctagttttttgattctcatgttccttcccctaccctcaggtaggcccttgtatctgctgttctgtattttgaagtttggtagtgtgatgcctccagctttatttttgcccaggattgcatgagctatttggggccttttgtgattctatgcaaattttaagatttttctttctatttctgtgaagaatgtcattggtattttgctagagattgcattgaatctgtagattaccttgggtagtatggcaatcttaaattaacatggaatgaatttaaataatctttccatttgtgtgtgtcctcttcaatttcttttatcagaatttactagggttccttgtagagatccttcacctccttggataaatttattcctatttcctatatttcctgtattttaataaatatatatttatatatttattttaataataaaataaaataaaatctttttaaattaatgccataattttattaaaaataatttataaaaataacaaattcgtgacatgagaagcattgttgtacaactttgcaaatttctttaatgtctggcttgacagaatgcagtgaatctcagatataattcatttattctgttgtaattgttttagttgaaatatgtaatacaaatgcacaattagaaaaggttaaaggagcaccttcactgcacattagaatagttcatactatacaaattgatctcttacaaaacagttgcagtttgcaatctgaaaccattagcattcttttttttaaattttattattattatactttaagttttagggtacatgtgcacaatgtgcaggtttgttacatatatatacatgtgctatgttggtgtactgcacccattaactcgtcatttaacaggtatatcacctaatgctatccctccccctccccccaccccacaacagtccctggtgtgtgatgttccccttcctgtgtccaagtgttctcattgttcagttcccacctatgactgagaacatgcggtgtttggttttttgtccttgcgatactttgctgagaatgatggtttccagcttcatccatgtccctacaaaggacatgaactcatcattttttatggctgcatagtattccatggtgtatatgtgccacattttcttaatccagcctatagttgttggacatttgggttggttccaagtctttgctattgtgaataatgctgcaataaacatacgtgtgcatgtgtctttatagcaacatgatttataatcctttgggtatatacccagtaatgggatggctgggtcaaatggtatttctagttctagatccctgaggaatcgccacactgacttccacaatggttgaactagtttacagtgccaccaacagtgtaaaagtgttcctatttctccacatcctctccagcacctgttgtctcctgactttttaatgattgccattctaactggtgtgagttggtatctcattgtggttttgatttgcatttctctgatggccagtgatgatgagcattttttcatatgtttttttggctgcataaatgtcttcttttgagaagtgtctgttcatatcctttgcccactttttgatggggttgtttgtttttttcttgtaaatttgtttgagttcattgtagattctgacaaaaacaagcaacggggaaaggattccctatttaataaattgtgctgggaaaactggctagccatatgtagaaagctgaaactggatcccttccttacaccttatacaaaaattaattcaagatggattaaagacttaaatgttagacctaaaaccataaaaaccctagaagaaaaacctaggcaataccattcagaacataggcatgggcaaggacttcatgtctaaaacaccaaaagcaatggcaacaaaagccaaaattgacaaatgggatctaattaaactaaagagcttctgcacagcaaaagaaactaccatcagagtgaataggcaacctacagaatgggagaaaatttttgcaacctactcatctgacaaagggctaatatccagaatataccgttagcattcttaatgaatcactcactattgcatgattttgtaacatcatgtattggtcatctagcaaatactggctcacagaatgatgcagaccttcttaatatacttcattatacaatgacaaagtcaattatgtgtattaacaacacttctaatctcatcagaaagatctataattattgagaaaacatcaagctcatgtgaataacacaagtttccaaaattcaaattttgatttgaaactcaaattttattatgagcaactcatatatacatatctatatttaataatatatagttgcaaatacctggaaggataatatttaatgttctcaacataaacaagtaataagtgtttgagatgatggatatgtcaattaccttgatctgatacctgtacattatatttatcaaaacatccctgtgtactccataagtgtgtatgattattttatgccaattaaattttaaaatgcaataaaaagatacagtaatcaaaaatggcatggtactggcataaaaatagacacatagaaataaattgatacattcatggtcaattgatctttgacaaaggtggtagggacacacaatatggaatggaccatctcttcaataagtggttttagaacaactgaatatccatatggagatgaatggaattggacccttatctgacaccatatacaaaaatcaacacaaaatatattaaacacataaacagaagaccagaaactataaaactaatagaagaaagcacagggggaaagctctatgacattggtatgcatgataatcttttagatatgactcccacaattgacaaaactaaaattaacaagcgctagtaaattaaactaaaagtcttttacagcaaaggtaacaaccaacagaatgaagagatgacctacaaaatgggagaaaatatttgcaaatcatacatctgataaggagttaatattcaaagtatataaggagttcaaataactcagtagcaaaaaactgccaaataacacaatttttaaaaagagcaaagtacttgaatagacatttctcacaagaagacattcaaattgccaacagatatgaaaaaatgctcaaaatcgttattcataagggaaatgccaattaaaaccaccgtgagatgcacctcacacttgtctgagtggctatgaaaaaagtcaaaagataaaaaagtttgatgagggtatggaggaaaaagaatctttcttcactatcggtgggaatgtagattagtatagcccttatggaaaacagtatgacgtttactcaaaaaattaaaaatagaactactgtacgatccagcaatcactattgggtatacatccaagagaaatgaaatcagtatgtcaatataatattggatgtcatggggtagtaggctgcccaacctgaaactggcctgggggatatttgaaagcctaacatggatggtctctaaaccctagcagtgtcctgcaccgaaacttctaagcttaaacagttttctacacctacactctagtgaaggattgaattcacttttgtgacataatcttttaactacagacacgtcttacccatttttattgggtaaaactgaagttacaatttacttcaccaatgcttttatttatttatttatattctgagaatctacatttttaaactgttattttagattcaggggtacatgtgcagatttgcacaggtaaattgcatgtcacaggagtttggtatacatattatttcatcacctatgtaataaacatagctcctaataggtattttttaaaccctatttggtattataaattaggtatacatgttagaagagctaaaatatctatatcaacattgttgcttttttgaagaaactttttttccctgaatggatttaaattttcttatgtatgtatgtatttggtcttccttgagaaagggtgcacgtgtgtgtttataaggttttaaatattatacatgtgttcgttcaagaaattacagaggtctgtgagcagacattttaattctagaaaaggacaagcagaaatgatcttagttcattctcagatgtaaaattgtagaaaggaaccggaataggttgaataaacaattagattggattggatggttaatatcttaaatggagtctatttaattgaatgacctcaaatataattatttttgcatacagtatgttaattttttgttaggaaagcaagataaaataaaacccaagggattgggcatgaggctttgttttgaaagaagttaatgtattccccatatgaaaaatgcagctgagaacctgatctcttctctaaagatattgtatacccaaagcactcctagttgttgggggagatcagttagcctctgccctataaagatggctgggagattctgagttcctccatgcctgagatcagttagggacacacatgacaaggacatgtgtcaatagaataaaatcattgactgtatttgaagtgagaggggattggaggaaagcatacatactttaaaacttgaataaattattttagtgatttttaagaagactcactatttaaaatgtgttctaccacattgtcgaattaacattagaatttatgcccctttaattctaaatctgaactcacagacaagaagtttaggaaaatttatcttaatatgtagcatttgggaactatatcacagagattctcatcactaaggtatatttgtactggagtcagaaactatttatcagctatgggttgtatgcagactatttaacttccctaagattcactttctgtataaagaatgctatatggtttttatatatttactcagaggatttaatgtgataattcatataaagtgcttaacacgatttccagcataagggagacatttaatagcagttggtttctcttctcactgttattgtgagcatctagtcacactttcttatcaccacattagtattatttaattcagtcactgaggtcattattgctgctgaaagactgtgcacttgagaagcattttctgaagtcccctcttcatatccctgttccttagggtatagatgaaaggattcagcatcggagccaccattgaatacatgatggttgacagagtgtcgctctcaggcatatggggggatgaagggctgaaatagacggcgatggctgtgccgtaaaacaacaccaccactgacaggtggcagctgcaggtggaaacagctctctgcttgccctgagtagaggtgatcttcagaacagtggagaagataagtccataagatacgaggatacagacaaggggcgtgagagccaatagacctcctactgcaaaaatgatcattacattgaaggagacgtcagagcaagagagctgcaggagaggattgagatcacagaagaaatgatggatgatattggaggcacagaaggacagctgtgctattaggacagtatgcaggagggcgtggaggtaagtaacaagccacagtccagccactagctggacacaaaggcacaggttcattctggcggtgtaatgtaaggggtggcaaatcgccacatatctatcatacgccatcacacacagaaggaggctgtccatattcacaaaagaaacgaagaagaagagctgggtgaggcagcctgcaaaagagatagtcttggtgccagtcaagatattcactaccatttgggggactgtagtcgacgtaaagcagatgtcaacaaaggccaagttactaaggaagaagtacataggggaatggaggtgagagtcaaagccaatcgtcgcaatgatgagcatgttccccaaggtggtggctaaatacatacagagaaagagcacagacaggaggtgctgctgctctgctgagctaggaagtcccagaaggacgaattccctgacaactgttagatttcttttttccatattcccaacaaatctagaaaaataagttattaaattgtaaaagccagcagtgttaagtctcttattcatgagagagagacagtgtgtgtgtgtgtgtgtgtgtgtgtgtgtgcatgcgtgcgcaggtaagtagcatccaaacttgcttgcttgaatgctttccaatgacatcttgtgttcatgatattctgtcttcatagtcacatagacatgctggacatgtcagtatcaacttctttcaagactgacttcttcccccaaaagaaaatgcaaattatgtgaataataaccattttaattgggttattttgccttgcctacagtaaccacaaaattcatatcgactttatatataaggttatttgttatttttttagtagtcaagctatttatgcttacccagtagaaatatttacctctaataaataattttcctcccaatctgatgcttatacttatgatggaagatatcctcatgttagctttcttttcttttaacgtatttggtcactgataactgcaagctcacctctgttccttgggttgaccattgctgttttggtctctgctcatcatttggtggagcctctgacttgtgtagtaagtcattgagagcccagtgtttgtggcctgtgctttcaggacccttccttgtagcatcttggtcatactaccttctctagaaggtgccagtattctcccatacctatcaacatttttcatagagtgtcttacttcttgacgtccctcactgtactctccaacttctcacttctgtatcaatccaatttataccttctttttaattataaaaattatcaaattatacaaagtgttgtataacaataagcaagcaaacatacatcattcatgtaatccgtactttccttcagcaaacatttattgagcaatttctatgatccaggtgctgtgcacaatttaggaccaaagtttttttctgactgaagcaaaatttgtgataccttcccaaacgttctccttgacatctgaggcctttctagtcttttcaaacctatattatttcagttatgttatttaagccatatggctatcaagtaaaggacatgttgtagaagtgggaagagatttggaatttttagtccaagtatcattattttctcacaatattccaagagttatctaggacttctattttattgatttgtatgacaaggatcctaatgaaaataacataatgtagcactagataatatacatgttctggttttatgctaagacagctgattaaccctagagaacacaatgcagtgtatttgtttctattacaatgttttgaattccaacttaatcagaaacctcactaacactaattattacattcatcttcctctgattcctgtcaactttaattaagttccatgcacccccttttacccaacttgaagcatgtcaggataaaatctgtacggaaaagaaactatgcatgtatttgcatgcctttgagggagaagcactctttcaaagacagtctccttcccctgtaggcactatcagttacatcatttttattaatctcatactcactatacaatattcctttcatgacaagcataacaattcccctttttcttggtctacttcattgtagttagtgaaattttaaggaaagaattgcgatttattatattgaatccttaggatataacacatatatgcacgtagtttgcacagagttggtgcaaaagagtgcttatggaaacaacaaatgaatgaaaaattctggagaaatcatttgattatataatgaatatatgagttttgcaagatatcttttaattctatattctcatttgcagcacatcatcttaatttcaaaattttctcaactaggatttggaaaaagttagtccaccattgaaatgcttaacagcttcgtcaaaaaacttccatgcattacaactcaaaggattatacattaggtatgtcttcactaaaacaaagaaaaaaatgtatgaatacatacccttttctgagacctttgccacctatgacttttctctttcctgaatatccaatcacaaaagcata
